United States Patent 11,098,302 (IDENTIFICATION OF POLYNUCLEOTIDES ASSOCIATED WITH A SAMPLE) - sequence listing, part 82

SEQ ID NO: 283382 - DNA, 773 bp, Homo sapiens
  misc_feature: GYAE6OF02GFHGH.8.53.E09.1.454.CMB.1.raw
  modified_base (243)..(243): a, c, t, g, unknown or other
  misc_feature (243)..(243): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacgagggtcctcgggcccagtctgtactgacgcacgcccgccctcagtatcgtcgggaccccaggcaggacggtcctccatctcctgcacgtgggacncacgaccagcagtcgggactaggttactgagttcgttacgagttcggtaccgtccgtacggttccagggccaaccgaccgccccacgtacctacctcgtaacttaactagaaacgtaaccaaacgtaaccgtcccggtaccctcggtaacgggtccttacgacgtaccgttacttcccgtactccgtacccttaccgtacgtaccgtacgtaccgttactttaccgtcccgtccccgttaccgttaccggttaccttaacggtttaccgtccgggtttaccgggtaacccgttccggggtacggggttacggtacggggttaacggttaccgggtaacggttacccgtttaagttaaaccgttttacccgttaccgggttacccttaaccgttaacccgtttctaaacggtacgtaaaccctacggtacggtacccttagggtaacgttttcgttaccgggtcggttttacggtaccgggacgggtaccgggttaaccgttaggtacccggtacccgttcgtaaccccgg

SEQ ID NO: 283383 - DNA, 690 bp, Homo sapiens
  misc_feature: GYAE6OF02H1T5Z.8.53.E09.1.454.CMB.1.raw
  modified_base (232)..(232): a, c, t, g, unknown or other
  misc_feature (232)..(232): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagcccgcctcagtatcgtcgggggaccccagggccaggacggtctccatcctcgtncacgtgggagcaacgaccagcctagtcggggcaggttatgtatcgtactagttcggtacccgctacggttccaacggccaccgaccggcccccagacctccttacaacttaatagaaactaacaaactaacgtccgacccgtcggaacgggtctcgacgtacgtacttcctcgtcgtaccctaccgtaacgtcgtcggtacttaccgtttccgttccgtcccttcccgtgtaccttaacttcgttacgttccgtaccggtcggtagggttaggaagtgtacggcgtacgttagttaacgtttacgttacgttaccggtacctaccttcgtaacgtacgaaccgtaacgccgtaaccggtttgttaacggttaacgtttcgggtccgtttccgggtccggggtaccgggtaccggggtaaccttaaccgggttcccggttaccgttaccggtaacccgg

SEQ ID NO: 283384 - DNA, 734 bp, Homo sapiens
  misc_feature: GYAE6OF02GCD1X.8.53.E09.1.454.CMB.1.raw
  modified_base (268)..(268): a, c, t, g, unknown or other
  misc_feature (268)..(268): n is a, c, g, or t
tcagctcgcgtgtccacgaccggtgctcgatttagagagagtgtgttggggtttggggggctctgcttcagctgtgggcacaagaggcagcactcaggacaatctccagcatggcctggtctcctctcctcctcactctcctcgctcactgcacgagggtcctgggcccagtctgtactgaccgcacgcccgccctcagtatcgtcggggaccccaggggtcaggacggtctacccatcctcctgccgacgtgggacacgacgaaccngcacggtcgggactaggttaatgaagttgttaccgtaggtttcggaacccggtaccgtaacggttccccgacgggaccaaccgtaccccggacccccgtaagtaccccttaccgttacctaagtttaacgtacgtaaacgttaaaaccaaaacgtaaccgtcccggtaccccgttaacgggtaccggggttaccttccgtaacggaaccgtttgtttcccgtccgtcccgtacccttaaccgttaacgttccgtacgggtccttaccgtttcgtccctcccgtttaccgtcggtactacgttacgttcgttccgttccgtacggagggtacgaggtagacgggtacgattacgttaattacgtccgtcgtaccctaccgtattagtacgataacggtctacggttaacgttagttagttcggtcgttcgggtaccgggacggaccgggttaaccgtggttacccgg

SEQ ID NO: 283385 - DNA, 809 bp, Homo sapiens
  misc_feature: GYAE6OF02JIZNR.8.53.E09.1.454.CMB.1.raw
  modified_base (260)..(260): a, c, t, g, unknown or other
  misc_feature (260)..(260): n is a, c, g, or t
tcagctcgcgtgtccacgaccggtgctcgatttagagagagtgtgttgggtttgggggcttcagctgtgggcacaagaggcagcactcaggacaatctccagcatggcctggtctcctctcctctcactctcctcgctcactgcacgacgggtcctgggcccagtctgtactgacgcacgccgtccctgaacgtctcggtccggggccccagggccaggacgggtcctccgtactcctccgtcgcctacggtaggggacncgaacgaaccgacgacgaacggtcgggggtactaagggtttatcggtaacgttcgttaccgtaagtttccgggtacccgtaccgttaaccggggttaccgaacggtacccgaaccgaccccggacccccgtaacggtaccccttaccgttaaccgttaactttaaacgaccgtaaactaaaaccgtaaacctaaaccggttcccggtaccccgtaacggggtaacggggttccctaacgttaccgggttaaccctaatttacccgtcccgtaccgttaacccgtaacccgtaacggtcgtccggaccttaccgttcgtaccgtccccttccgtagttccaacgttcctcgttaccggttacgtaccggtgggtaacggtagacggttacgacggtcttaggttacttaacggttccgtacgtaccgtacttcgtaagtaccgaactacgtacgtaccgttagttaaccgttagtttccggaagttcccgggtaacgggcccgggtaaccggtaaccgttacggtacccggttaccttaccggtaacccg

SEQ ID NO: 283386 - DNA, 804 bp, Homo sapiens
  misc_feature: GYAE6OF02F0IIW.8.53.E09.1.454.CMB.1.raw
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
tcagctcgcgtgtccacgaccggtgctcgatttagagagagtgtgttgggtttggggggctctgcttcagctgtgggcacaagaggcagcactcaggacaatctccagcatggcctggtctctctctcctcactctcctcgctcactgcacagggtcctgggccctagtctgtactgaccgnacgccnccctcagtctcgtgggccccagggcaggaggtctccactctccgtagcacgtgggacncacgaaccngctagtcgggactaggttaacngtagtnttacgtattacgggaccgtccgtacggttaccgacggtaccaacgacgacccccccgtaagtaacccgtcccgtaacttaacgtttaaacgtagtaaacttaaaacccgaaacgtaaaccggtccgggaaccccttgggttaacccggggacctttcgtaaccggttaaccgttaaccgtttcccgttacgttccgacccctttacgggaaacgtttccgggtcggtaccctttaaccgtttccgtacccggttacccttcccgggttcggtactaacctttcgttccgttacggttaaccccttccgggtaaggggttaccgtaagggtccgttagggtaccgttacgttacgttaacgttttacgttacctcgggttaaccctaacttacccgtacgttacgtaaacccgtaacgtccggaacctttaggggttaacttccgggttttccgggtaccggttttacggggtttacccgggtccgggggtaacccgtaccgggtttaacgttaacccgggg

SEQ ID NO: 283387 - DNA, 649 bp, Homo sapiens
  misc_feature: GYAE6OF02FWRHT.8.53.E09.1.454.CMB.1.raw
  modified_base (181)..(181): a, c, t, g, unknown or other
  misc_feature (181)..(181): n is a, c, g, or t
  modified_base (185)..(185): a, c, t, g, unknown or other
  misc_feature (185)..(185): n is a, c, g, or t
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (291)..(291): a, c, t, g, unknown or other
  misc_feature (291)..(291): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
tcagctcgcgtgtccacgaccggtgctcgatttagagagagtgtgttaggggtttgggggcttcagctgtgggcacaagaggcagcactcaggacaatctccagcatgcctggtctctctcctctcactctcctcgctcactgcacagggtcctgggcccagtctgtactgacgcacgccncctnagtatcgcgggcccaggcagnggtcncatcctctncacgnggacncagacngcngtcggntagtatgtatcgtatagtcggtaccgcgtacggtcgacggtcaacnccgacccagacctctactattaananaaactaacaactacgtccgtccgtacgtacgggtactcgacgtactactcgtaccgtccgtaaccgttaccgtaaccggtcgtacggtccttacccgtttcgtcccggttacccttccggttacgtacctacttcgtcgttccgtaccggttacggagggtggtaacggtagtacggtgtacgttcgttaactttacgtacctacggtaccttacgtacttctaacgacctacgacgttacgtacggttaacgtttcggtaacggttccggtacgggttaccggacggttaccggaaccgggttagtccccgttaccggtacccgttaccgg

SEQ ID NO: 283388 - DNA, 169 bp, Homo sapiens
  misc_feature: GYAE6OF02HFL3W.8.53.E09.1.454.CMB.1.raw
  modified_base (165)..(169): a, c, t, g, unknown or other
  misc_feature (165)..(169): n is a, c, g, or t
tcagctcgcgtgtccacgaccggtgctcgatttagagagagtgtgttgggtttgggggtgtggtggtctccactcccgccttgacggggctgctatctgccccctggtcactctgttcccaccctcctcgacacgcgagctgagcgggctggcaaggcgcatagnnnnn

SEQ ID NO: 283389 - DNA, 798 bp, Homo sapiens
  misc_feature: GYAE6OF02F9V3T.8.53.E09.1.454.CMB.1.raw
  modified_base (286)..(286): a, c, t, g, unknown or other
  misc_feature (286)..(286): n is a, c, g, or t
tcagctcgcgtgtccacgaccggtgctcgatttagagagagtgtgttgggttttttggggggctctgcttcagctgtgggcacaagaggcagcactcaggacaatctccagcatggcctggtctcctctcctcctcactcctcctcgctcactgccacgacgggtccgtcgggcccagtctagtacgtgaccgcgacgcccgccctcagtactccgtccggggaccccgagggacgtacggacgggtcctaccgtacttccctccgtgaccgtacggtcgggaacnccgtaaacgaaacccgtaggacgtacggtaccggggaccgttaaggtttaacgtaggtacgtttacggtttacgtacggtttacccgggtaccccggtaccggttacgggttacccgacggacccggtaaccgaccccggtaaccccccgaagtaccccgttacctaaccttaacgttaaacgttaacgaaaacctaaaaccgtaaaccgtaaccgttcccggtcccggttaacggtcgggttacctcgtaccgaccgttactttccctccgtacgtaccctacccgtaagtccgtacgttcctaccgttcgtcccgtccgttaccgtacgtacttagttcgttcgtacgttccgtacgggtagggtaccgtaggtacgtaggtaccgttgttaacgtttattacgttacgtaccgtcctaacgttcgactacgaacgtacgcgttacgtagtaccggttagtcggttcgttacgggtccggtacgggtaccgtaacggtccgttaacccgg

SEQ ID NO: 283390 - DNA, 916 bp, Homo sapiens
  misc_feature: GYAE6OF02JF4WJ.8.53.E09.1.454.CMB.1.raw
  modified_base (856)..(856): a, c, t, g, unknown or other
  misc_feature (856)..(856): n is a, c, g, or t
tcagctcgcgtgtccacgaccggtgctcgatttagagagagtgtgttgggtttggggggctctgcttcagctgtgggcacaagaggcagcactcaggacaagtctccagcatggcctgtctcctctcctcctcactctcctcgctcactgcacgtacggtcctgggcccagtcgtcgtactcggacgcacgcccgccctacgagtacttccggtccggggcccctaaggggacacggtacgggtcctaccgacgttcctccgtacgcaacggtacgggaccgacgaaacggaacctacggacgtacggtcggggtacgttaaggttcgtaggttacgttacgttacgttacggtttaccgggttaccccggaccggttaaccgggttaccgtacgggacccaaccgtaaccccgggaccccccggtaaacttacccttacccgttaacgttaaacgtttaaacgtaaccggtaaacctaaacccggtaaacgaaacccggttttccccgggaccccgttacggggtttaaccgggtttaccgaccggtttaaccggtaaccccgttaaccgttttcccgttaccggtcccgtacccggttaacgttaaccggttacccgttacggttaccccgtttaaccctttccccgtaacccggtttcccgttaccccggtttacggtacctttagtttacccggttccggtttaacggttccggtacccgggttaacggggtacgggtaccggtaggttaacgggtacggttacgttaacggtttaaccgtttaaccgttacgttaccggtaccctacccgtttagaacctttacggaacctaaccggtcgtaaccgggttnttaacggtttgttacgtcgttcgggtacccgggcgggtaaccggttacgtcgtaaccggg

SEQ ID NO: 283391 - DNA, 154 bp, Homo sapiens
  misc_feature: GYAE6OF01DV86D.22.3.A03.1.454.CMB.1.raw
  modified_base (139)..(154): a, c, t, g, unknown or other
  misc_feature (139)..(154): n is a, c, g, or t
tcagacatacgcgtcacgaccggtgctcgatttagagagcgtcacagggggatatcaaacgaactgtggctgcaccatctgtcttcatcttcccgccatctgaacgcgtatgtctgagcgggctggcaaggcgcatagnnnnnnnnnnnnnnnn

SEQ ID NO: 283392 - DNA, 138 bp, Homo sapiens
  misc_feature: GYAE6OF01A6DH5.22.3.A03.1.454.CMB.1.raw
  modified_base (138)..(138): a, c, t, g, unknown or other
  misc_feature (138)..(138): n is a, c, g, or t
tcagacatacgcgtcacgaccggtgctcgatttagagagcgtcacaggggatatcaaacgaactgtggctgcaccatctgtcttcatcttcccgccatctgaacgcgtatgtctgagcgggctggcaaggcgcatagn

SEQ ID NO: 283393 - DNA, 140 bp, Homo sapiens
  misc_feature: GYAE6OF01A4NMH.22.3.A03.1.454.CMB.1.raw
  modified_base (138)..(140): a, c, t, g, unknown or other
  misc_feature (138)..(140): n is a, c, g, or t
tcagacatacgcgtcacgaccggtgctcgatttagagagcgtcacaggggatatcaaacgaactgtggctgcaccatctgtcttcatcttcccgccatctgaacgcgtatgtctgagcgggctggcaaggcgcatagnnn

SEQ ID NO: 283394 - DNA, 137 bp, Homo sapiens
  misc_feature: GYAE6OF02I2EKW.22.3.A03.1.454.CMB.1.raw
  modified_base (136)..(137): a, c, t, g, unknown or other
  misc_feature (136)..(137): n is a, c, g, or t
tcagacatacgcgtcacgaccggtgctcgatttagagagcgtcacagggatatcaacgaactgtggctgcaccatctgtcttcatcttcccgccatctgaacgcgtatgtctgagcgggctggcaaggcgcatagnn

SEQ ID NO: 283395 - DNA, 522 bp, Homo sapiens
  misc_feature: GYAE6OF01DDEX3.52.60.F05.1.454.CMB.1.raw
  modified_base (240)..(240): a, c, t, g, unknown or other
  misc_feature (240)..(240): n is a, c, g, or t
  modified_base (316)..(316): a, c, t, g, unknown or other
  misc_feature (316)..(316): n is a, c, g, or t
  modified_base (335)..(335): a, c, t, g, unknown or other
  misc_feature (335)..(335): n is a, c, g, or t
  modified_base (429)..(429): a, c, t, g, unknown or other
  misc_feature (429)..(429): n is a, c, g, or t
  modified_base (514)..(514): a, c, t, g, unknown or other
  misc_feature (514)..(514): n is a, c, g, or t
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaaccgttntgcttattggtaccagcaagaacgccacggccaggccctgtgttggtgatataataaggacactgagaggccctgngggatccctgagcgattcnctggctccacctcgagggacacgtagtcacgttgaccatcagtggagtccgaggacaggaggacgagctacgacctaccgactgacaatccaanagacagcaggttggttacttatgttactcgcaacgtcggaacgtagtcaccgtcgtaggtcacgccgaacgccaacccatgaccnctcgtccg

SEQ ID NO: 283396 - DNA, 526 bp, Homo sapiens
  misc_feature: GYAE6OF02GSV53.52.60.F05.1.454.CMB.1.raw
  modified_base (243)..(243): a, c, t, g, unknown or other
  misc_feature (243)..(243): n is a, c, g, or t
  modified_base (409)..(409): a, c, t, g, unknown or other
  misc_feature (409)..(409): n is a, c, g, or t
  modified_base (509)..(509): a, c, t, g, unknown or other
  misc_feature (509)..(509): n is a, c, g, or t
tcagcgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtaccaaaaccgtttntgcttattggtaccagcagaagccaggccaggcccctgtgttggtgatatataaggacactgagacggccctcgaggggactccctgacgcgattctctggcctccacctcgagggacacgtagtactacgttcgaaccatcagtggacgtccaggcagaggacgnggctgacctaccactgtacaatcaacagacagcagtgttctagtgtcttcgctaacgtcggaactacgtcaccgtctaggtcacgacccaagcccaaccnctcgtactctctacccg

SEQ ID NO: 283397 - DNA, 487 bp, Homo sapiens
  misc_feature: GYAE6OF01C4E0M.47.85.H08.1.454.CMB.1.raw
  modified_base (466)..(466): a, c, t, g, unknown or other
  misc_feature (466)..(466): n is a, c, g, or t
  modified_base (472)..(487): a, c, t, g, unknown or other
  misc_feature (472)..(487): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacaggctgattacttctgttgctcttgggcaactactgttcgtttgggtgttcggcggaggaccaagttgaccgtctaggtcagccaaggctcgccccctggtcactctcgttcccgcctcctctaccgtgagctctgagcgggctggcaaggcncatagnnnnnnnnnnnnnnnn

SEQ ID NO: 283398 - DNA, 540 bp, Homo sapiens
  misc_feature: GYAE6OF01C553J.47.85.H08.1.454.CMB.1.raw
  modified_base (193)..(193): a, c, t, g, unknown or other
  misc_feature (193)..(193): n is a, c, g, or t
  modified_base (243)..(243): a, c, t, g, unknown or other
  misc_feature (243)..(243): n is a, c, g, or t
  modified_base (321)..(321): a, c, t, g, unknown or other
  misc_feature (321)..(321): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcccgganagtcgatcaccatctcctgcactggaaccagtagtgacgttggcagttcngattctatctcctggtaccaacaacacccaggcaaagcccccaaactcataatttatgacgtcaattgttcgcccctnagggtttctcatcgcttctctggctccaaatctggcaacacgcctcctgaccatctctggctcgagtctgaggacgaggtctgtatttacttctgttcgcttcttgggactaacgtacttgttcgtttgggtgttcggcggtagggacctaggttcgaccgtcgtacggtcagcccgaagcctcgccccctcggtccacttcctcgttcccctaccccg

SEQ ID NO: 283399 - DNA, 529 bp, Homo sapiens
  misc_feature: GYAE6OF01BAEOG.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaagcccccaaactcataatttatgacgtcaatgttcgcccctcagggtttctcatcgcttctctgctcaaatctggcaacacgcctccctgaccatctctggctcgagtctgagacgaggctgtattacttctgttgctcgttgggctaacttacgtgttcggtttgggtgttcgggcggtagggacctaaggttcgaccgttccgtaggtcacggcccaaggctcgcccctggtccacttcgtcgttccccg

SEQ ID NO: 283400 - DNA, 517 bp, Homo sapiens
  misc_feature: GYAE6OF01ERK1Q.47.85.H08.1.454.CMB.1.raw
  modified_base (501)..(517): a, c, t, g, unknown or other
  misc_feature (501)..(517): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgacgtcaatgttcgcccctcagggtttctcatcgcttctctggctccaaatctggcaacacggcctcctgaccatctctgggctcgagtctgaggacgaggctgatttacttctgttgctcgttggctaactactgttcgtttgggtcgttcggcgggacggaccaaacgtcgaccgtcgtaggtcacgacccgaaggctcgccccctcggtcactctcgttcccgcccttcctcctcgtcgactctctggacggcgggtcgtggacgtaacggcgacagtagcnnnnnnnnnnnnnnnnn

SEQ ID NO: 283401 - DNA, 526 bp, Homo sapiens
  misc_feature: GYAE6OF01D7XSV.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactccataatttatgacgtcaatgttcgcccctcaggggttttctcatcgcttctctggctcaaatctggcaacacggcctccctgaccatctctggctcgagtctgaggacgaggctgtattacttctgttgctcgttgggctaacttactggttcgtttgggtgttcgggcggaggaccagttcgaccgtctaggtcaggcccaaggctcgcccctggtccactcgtcgtcccccg

SEQ ID NO: 283402 - DNA, 583 bp, Homo sapiens
  misc_feature: GYAE6OF01BTYM8.47.85.H08.1.454.CMB.1.raw
  modified_base (296)..(296): a, c, t, g, unknown or other
  misc_feature (296)..(296): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctctggtaccaacaacaccaggccaaagccccaaatcataattangactcaatcgttcgccctcgtagggttctcatcgcttctctggctacaaatctggacaacaccggtcctccctagacctatctcgtgggctcgacgtctgacggacgaggctgtattacttcgtgttcgcttcgttgggacctaacgttacgtcggttcggtttagggttcgttcgggtacgggtacggtaactaagggtttcgaaccgttccgttaacggttccacggtccccgaaggtccctcggtcccccgttcgggtaccctacgtccgttccgttccccccg

SEQ ID NO: 283403 - DNA, 534 bp, Homo sapiens
  misc_feature: GYAE6OF01BKKS8.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctgtaccaacaacacccaggcaaagcccccaaactcataatttatgacgtcaatgttcgcccctcagggtttctcatcgcttctctggctccaaatctggcaacacggcctccctgaccatctctgggctcgagtctgaggacgaggctgattacttctgttgcttcttgggctaacttactgttcgtttgggtgttcgggcggagggacctaaggttcgaccgttcgttaggtcaggcccgaaggctcgccccctggtccacttcgtcgtttcccccc

SEQ ID NO: 283404 - DNA, 495 bp, Homo sapiens
  misc_feature: GYAE6OF01BTHI5.47.85.H08.1.454.CMB.1.raw
  modified_base (480)..(495): a, c, t, g, unknown or other
  misc_feature (480)..(495): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgtttgggtgttcggcggagggaccaagttgaccgtctaggtcagcccaaggctcgccccctggtcactctcgttcccgccctcctctacgtgacgcctctgacgcgggctggcaacgggcgcatacgnnnnnnnnnnnnnnnn

SEQ ID NO: 283405 - DNA, 562 bp, Homo sapiens
  misc_feature: GYAE6OF01AZTK4.47.85.H08.1.454.CMB.1.raw
  modified_base (230)..(230): a, c, t, g, unknown or other
  misc_feature (230)..(230): n is a, c, g, or t
  modified_base (315)..(315): a, c, t, g, unknown or other
  misc_feature (315)..(315): n is a, c, g, or t
  modified_base (479)..(479): a, c, t, g, unknown or other
  misc_feature (479)..(479): n is a, c, g, or t
tcagagctcacgtacacgaccggtgctcgatttagtatcactcagtcgcggggggggtcgtcgaggaggcagcgctctcgaggacatctccaccatggcctgggctctgcctgctcctcaccctcctcactcaggcacagggtccctgggcccagtctgccccgactcagcctcgcctccgtgtctgggtcctcctggacagtcgatcaccatctcctgcactggaaccngtagtgacgttggacagttctgattctatctcctggtaccaacaacacccaggcaaacgcccccaaatcataatttatagacgtnaatcgttcgcccctgacgggtttctcatcgcttctctggcctcaaatctggcaacacggcctccctcgaccatcctcgtgggccttcgacgtcgtggaaggacgaggctggtatttacttctgttgcctcttgggctaacgtctgttcggtttgggtgttcggnggtagggtacctaggttcgaccgtccgtaggtccacggcccctaagggctccgccccctcggtacacctcgtccgttcccccg

SEQ ID NO: 283406 - DNA, 611 bp, Homo sapiens
  misc_feature: GYAE6OF01BBAXX.47.85.H08.1.454.CMB.1.raw
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagagctcacgtacacgaccggtgctcgatttagtatcactcaggtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctctggtaccaacaacaccaggcaaacgccccaaactcactaattatgacgtcaatgttccgcccctgtaggggtttctcatcgcttctctgctcattcnggaacncggccacctgaccatcagcgcgtcgaacgccggagatgacgccgactattacgtgtacgtaggtgtgggaactagtaagtaggtcgaacgtcccggaaggtcgtaaggggtttttccgggacgggttacggggtaaacctaagggtaccgttacgggtaacccggttacccgttaaacggtccgtaaccggccccgtaaacgggtcccttacccggtacccccccgttacggttcccgtaccggtttaccccg

SEQ ID NO: 283407 - DNA, 566 bp, Homo sapiens
  misc_feature: GYAE6OF01BZB6D.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcaggacacagggtcctgggcccagtctgccccgactcagcctgcctccgtgtctgggtctcctggacagtcgatcaccatctcctgcactggaaccagtagtgacgttggcagttctgattctatctcctgtaccaacaacaccaggcaaacgcccccaaactcataatttatgacgtcaatgttccgccctcgtagggtttctcatcgcttctctggctacaatctagcaacacgcctccctgaccatctcgtggctcgagtctagaggacgaggctgtattacttctgttgcttcgttggctaacgttactggttcggtttgggtcgttcgggcggtagggtaccgtaggttcgacccgttccgtagggtaccacggtccccgaaggtccgtaccggccccccttacggtcccaccttccgtccggtttaccccccc

SEQ ID NO: 283408 - DNA, 536 bp, Homo sapiens
  misc_feature: GYAE6OF01A5H0X.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaagcccccaaatcataatttatgacgtcaatgttccgcccctcaggggtttctcatcgctttctctggctcaaatctggcaacacgcctcctgaccatctctgggctcgagtctgaggacgaggctgattacttctgttgcttcgttgggctaacttacgttgttcgttttgggtgttcggcgggagggacctaagttcgaccgttcgtaggtcacgcccgaaggcctcggccccctcggtaccactccgtcgtcccccg

SEQ ID NO: 283409 - DNA, 520 bp, Homo sapiens
  misc_feature: GYAE6OF01DHA3W.47.85.H08.1.454.CMB.1.raw
  modified_base (326)..(326): a, c, t, g, unknown or other
  misc_feature (326)..(326): n is a, c, g, or t
  modified_base (456)..(456): a, c, t, g, unknown or other
  misc_feature (456)..(456): n is a, c, g, or t
  modified_base (507)..(507): a, c, t, g, unknown or other
  misc_feature (507)..(507): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctccgtgtctgggtctcctggacagtcgatcaccatctcctgcactggaaccagtagtgacgttggctagttctgattctatctctgtaccaacaacaccagcaaagccccaaactcataattatgacgtcaatgttcgccctcaggggtttcnctatcgcttctctgctaccaaatctggacacacggcctccctgacctatctcgtggctcgacgtctgaggacgaggctgatttacttctgttgcttcgtggtcaactcgttgttcgtttggtgttcgggnggacggtacgtagttcgacgtccgtaggtcagccgacgctcgcccctggcnctctcgttccccc

SEQ ID NO: 283410 - DNA, 669 bp, Homo sapiens
  misc_feature: GYAE6OF01DR0K9.47.85.H08.1.454.CMB.1.raw
  modified_base (366)..(366): a, c, t, g, unknown or other
  misc_feature (366)..(366): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgtcccgactcagcctgcctccgtgtctgggtctcctggacagtcgatcaccatctcctgcactggaaccagtagtgacgttggctagttctgattctatctcctggtaccaacaacaccagacaaacgccccaaactcattaattatagacgtacaatgttccgtccctcgtacgggttctctactcgcttctctgctacaatctgacaacncggcctccctgaccctatcctcgtcgggtcctcggtagtccgtaggacgggtaccgtaggtccttagtacttttaccgttacgttggtttcgtcgttacgttgggtacctaaacgttccgttggtttccgggttttggggttcggttaccgggtacgggtaacgggtaaccgttaacgggttccggtaacccggttacccggttacgggtaccgtaacccggtcccgtaacgggtcccgttaccccggtccccccgttacgggttaccctaacccggttccgttccccggtttacccccccgg

SEQ ID NO: 283411 - DNA, 579 bp, Homo sapiens
  misc_feature: GYAE6OF01BBJJC.47.85.H08.1.454.CMB.1.raw
tcagagctcacgtacacgaccggtgctcgatttagtatcactcagtcgcggggtctgggagaggagcccagcactggaagtcgctggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtccctgacgactctcctgtgcagcctctggcttcaccttacaataattatgctatgcaggtgggtccgccaggcctccgaggcgaaggggctaggaggtgggtgggcggtacagttagtccgtccaggtggactatccttacagttattacgcacgacctcccgtagggacgggaccgtattccaccgtactccctaccgagaacgaactaacttacccgagtaaccacggtcctatctgctaccgtgacccagtcctagaacgtacctagaccgaccaccgtcctacctactaccttacgtacggtcgacgaaggacgtaggttacgaggtacgtcgtagttcgg

SEQ ID NO: 283412 - DNA, 568 bp, Homo sapiens
  misc_feature: GYAE6OF01CYF83.47.85.H08.1.454.CMB.1.raw
  modified_base (224)..(224): a, c, t, g, unknown or other
  misc_feature (224)..(224): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctcgtgtctgggtctcctggacagtcgatcaccatctcctgcactggaaccngtagtgacgttggctagttctgattctatctcctgtaccaacacaccaggcaaacgccccaaactcataatttatgacgtcaatcttcgcccctcgacgggttctcatcgcttctctgctacaaatctggacacaccgcctcctgaccatctcgtggctcgtagtctgaggacgagctgatttactnttgttncttcgtggactaacttacgttggttcggtttgggtgttcgggcggtacgggacctacggtccgtacgtaccggttcgttacgggtactaccggtaccccgaacggtccgttcccggtacccccgtaccggtcctaccgttccgttaccccg

SEQ ID NO: 283413 - DNA, 538 bp, Homo sapiens
  misc_feature: GYAE6OF01A5QDN.47.85.H08.1.454.CMB.1.raw
  modified_base (295)..(295): a, c, t, g, unknown or other
  misc_feature (295)..(295): n is a, c, g, or t
  modified_base (300)..(300): a, c, t, g, unknown or other
  misc_feature (300)..(300): n is a, c, g, or t
  modified_base (387)..(387): a, c, t, g, unknown or other
  misc_feature (387)..(387): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacacaccagcaagcccccaaatcataattangactnaatgtcgccctgtagggttctcatcgcttctctgctcaatctgacacacgcctccctgaccatctcgtggctcgagtctgaggacgngctgtacttacttctgttgcttcgttggctaactcgtggttcggtttgggtgttcgggcggtacggaccgtaagttcggaccgttccgtaggtccacggtccccgaaggtcctccggtcccccgtcgtccaccttccgtcggttccccccg

SEQ ID NO: 283414 - DNA, 538 bp, Homo sapiens
  misc_feature: GYAE6OF01CWMTV.47.85.H08.1.454.CMB.1.raw
  modified_base (403)..(403): a, c, t, g, unknown or other
  misc_feature (403)..(403): n is a, c, g, or t
tcagagctcacgtacacgaccggtgctcgatttagtatcactcagtcgcggggggggtctcaggaggcagcgctctcaggacatctccaccatggcctgggctctgctgctcctcaccctctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgccccaaaactccaataatttatgacgtcaaatgttacgcccctcaggggtttcctcatcgcttctctggctcaaatctggcaacacggcctcctgaccatctctggctcgagtctgagacgngctgattacttctgtttgcttcttgggactaacttacttgttcgtttgggttgtttcgggcggagggactaagttcgaccgtcctaggtcaggcccgaaggcctcgtccccctcggtccactcgtcgttcccccg

SEQ ID NO: 283415 - DNA, 535 bp, Homo sapiens
  misc_feature: GYAE6OF01DI59S.47.85.H08.1.454.CMB.1.raw
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
tcagagctcacgtacacgaccggtgctcgatttagtatcactcagtcgcgggggagctctgggagaggagcccagcactggaagtcgccggtgttccattcggtgatcagcactgaacacagaggactcaccatggagtttgggctgagctgggttttcctcgttgctcttttaagaggtgtccagtgtcaggtgcgcctggtggaggtcggggggaggcgtggtccaggccgtgggaccgtccctgagactctcctgtcgcagcctctggcttcacctttcaataattangctatgcagtgggtccnccaggcctccgaggcgaaggggctaggagtggggtggcgtcatatcgtccagtggacatcttcagttattacgnacgacctcccgtggacggggccgattccacctatctccagcgaacacttcccaagaacacggtctactctcgaccacctcgaccacgccctgaacgactcgaccgacaccgtcctctctactacgtgtacgcgagagagttagacgagtctag

SEQ ID NO: 283416 - DNA, 542 bp, Homo sapiens
  misc_feature: GYAE6OF01A5LHB.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctctagggtttctcatcgcttctctgctccaatctggcaacacggcctccctgaccatctctcggctcgagtctgaggacgaggctgattacttctgtttgcttcgttgggctaactacttgttcgtttgggttgttcgggcggtagggtaccgtaaggttcgtacccggtctacggtcgacgcccgaacggtccgtcgcccccgtcggtcctcgttcccg

SEQ ID NO: 283417 - DNA, 547 bp, Homo sapiens
  misc_feature: GYAE6OF01ADEYX.47.85.H08.1.454.CMB.1.raw
  modified_base (224)..(224): a, c, t, g, unknown or other
  misc_feature (224)..(224): n is a, c, g, or t
  modified_base (409)..(409): a, c, t, g, unknown or other
  misc_feature (409)..(409): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggcagttctgattctatctcctggtaccaacaacacccaggcaaagcccccaaactcataatttatgacgtcaatgttcgcccctcagggtttctcatcgcttctctgctcaatctggcacacggcctcctgaccatctctgggctcgatctgaggacgaggctgtattacttntgttgctcttgggcaactactgtcgtttgggtgttcgggcggagggtacctaaggttcggacccgtccgttaggttccgacgtcccgaacggtcctcggtcccccctcggtaccacccgtccgttcgtttaccccccg

SEQ ID NO: 283418 - DNA, 522 bp, Homo sapiens
  misc_feature: GYAE6OF01EEHQZ.47.85.H08.1.454.CMB.1.raw
  modified_base (303)..(303): a, c, t, g, unknown or other
  misc_feature (303)..(303): n is a, c, g, or t
  modified_base (317)..(317): a, c, t, g, unknown or other
  misc_feature (317)..(317): n is a, c, g, or t
  modified_base (326)..(326): a, c, t, g, unknown or other
  misc_feature (326)..(326): n is a, c, g, or t
  modified_base (484)..(484): a, c, t, g, unknown or other
  misc_feature (484)..(484): n is a, c, g, or t
  modified_base (507)..(507): a, c, t, g, unknown or other
  misc_feature (507)..(507): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacaccaggcaaagcccccaaatcaataatttatgactnaatgttcgcccctnagggtttcncatcgcttctctggctccaaatctggacaacacggcctccctgaccatctcgtcggctcgagtctggaggacgagctagattacgttctgttcgctcttggtctaactactgttcggtttggtgttcggcggaggaccgaagttcgaccgtctaggtnacgccaggctacgcccctcggtnacctcgtcgtccccg

SEQ ID NO: 283419 - DNA, 546 bp, Homo sapiens
  misc_feature: GYAE6OF01BOXX9.47.85.H08.1.454.CMB.1.raw
  modified_base (315)..(315): a, c, t, g, unknown or other
  misc_feature (315)..(315): n is a, c, g, or t
tcagagctcacgtacacgaccggtgctcgatttagtatcactcagtcggcgggggggtctcaggaggcagcgctctcaggacatctccaccatggcctgggctctgctgctcctcaccctcctcactcaggcacagggtcctgggcccagtctcgccccgatcagcctgcctccgtgtctgggtctccgtggacagtcgatcaccatctcctgcactggaaccagtagtgacgttggctagttctgattctatctctgtaccaacaacaccagcaaacgccccaaactcaataatttatgacgtcaatcgttccnccctcgtagggtttctcatcgcttctctgctacaaatctgacaacacgcctcctgaccatctcgtggctcgagtcgtggacggacgaggtctagtacttacgttctgttcgcttcgttggctaacttcgtgttcgttgggtcgttcggacggacggtactaagtcgaccgtcgtaggtcacgcccgaaggcctaccgtccccctcggtaccacgttcgtccgttacccccg

SEQ ID NO: 283420 - DNA, 500 bp, Homo sapiens
  misc_feature: GYAE6OF01ESBAF.47.85.H08.1.454.CMB.1.raw
  modified_base (483)..(500): a, c, t, g, unknown or other
  misc_feature (483)..(500): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcgttggcaactctgtcgtttgggtgttcggcggaggacctaggttcgaccgtcgtaggtcacgcccaaggctcgccccctcggtcactctcgttccccaccctcctctcgtgacgctctgagccgggctggcgaaggcgacagtagnnnnnnnnnnnnnnnnnn

SEQ ID NO: 283421 - DNA, 567 bp, Homo sapiens
  misc_feature: GYAE6OF01AVQ3F.47.85.H08.1.454.CMB.1.raw
  modified_base (457)..(457): a, c, t, g, unknown or other
  misc_feature (457)..(457): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaacgcccccaaactcataatttatgacgtcaatgttcgcccctcagggtttctcatcgcttctctgctcaatctggcaacacggcctccctgaccatctctgggctcgagtctgaggacgaggctgtattacttctgttgcttcgttggctaattacgtgttcggtttgggtgttcgggnggtacgggacctaaggttcgacccggttccgtagggttccacggtccccaagggtcctccggtaccccccgttcgggttaccctaccgttccgttccggtttaccccccg

SEQ ID NO: 283422 - DNA, 508 bp, Homo sapiens
  misc_feature: GYAE6OF01BCGQ4.47.85.H08.1.454.CMB.1.raw
  modified_base (502)..(502): a, c, t, g, unknown or other
  misc_feature (502)..(502): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtcaagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctaggagtgggtggcggtcatatcgtccagtggacatcttcagtattacgcagactcccgtgacggggccgattcgccatctccagacgacaacttcccagaacacggtctatctgccacctcgaccacgcctgacgaactgacgacacgtctctctactctgtgcgagagagttgacgagtcngttgtg

SEQ ID NO: 283423 - DNA, 517 bp, Homo sapiens
  misc_feature: GYAE6OF01DXE9C.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccaggcaaagccccaaactcataatttatgacgtcaatgttcgcccctcagggtttctcatcgcttctctgctcaaatctggcaacacgcctccctgaccatctctggctcgagtctgaggacgaggctgattacttctgttgcttcttgggctaactactgttcgtttgggttgttcggcggagggacctaagttcgaccgtcgtaggtcacgcccaaggctcgcccctcggtcactctcgttcccc

SEQ ID NO: 283424 - DNA, 551 bp, Homo sapiens
  misc_feature: GYAE6OF01CLQCS.47.85.H08.1.454.CMB.1.raw
  modified_base (399)..(399): a, c, t, g, unknown or other
  misc_feature (399)..(399): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaagcccccaaactcataatttatgacgtcaatgttcgcccctcaggggtttctcatcgcttctctgctccaaatctggcaacacggcctccctgaccatctctggctcgagtctgaggacgnggctgattacttctgttcgcttcgttgggcctaactacgttgttcggttttgggtgtttcgggcggacgggtaccgtaagttcggaccgtccgtaggtcacggcccgaaggccttacggtccccctcggtccaccgtcgttccgttaccccc

SEQ ID NO: 283425 - DNA, 502 bp, Homo sapiens
  misc_feature: GYAE6OF01ECOQ4.47.85.H08.1.454.CMB.1.raw
  modified_base (485)..(502): a, c, t, g, unknown or other
  misc_feature (485)..(502): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaaactcataatttatgacgtcaatgttcgcccctcaggggtttctcatcgcttctctggctccaaatctggcaacacggcctccctgaccatctctgggctcgagtctgaggacgaggctgatttacttctgttgctcttggcaactactgtcgtttgggtgttcggcggagggacctaaggttcgaccgtctaggtcagcccaaggctcgccccctcggtcactctcgttccccgccctcctctacgtgacgctcgtgacgcgggctgggcaaggcgcatagnnnnnnnnnnnnnnnnnn

SEQ ID NO: 283426 - DNA, 568 bp, Homo sapiens
  misc_feature: GYAE6OF01CMYPN.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctgtaccaacaacaccaggcaaagcccccaaactcaataatttatgacgtcaatcgttaccgcccctcgtaggggtttctcatcgcttctctggctcaaatctggacacacggcctcctgaccatctcgtcgggctcgagtctgaggacgaggctgtacttacttcttgtttgtcttcgtttgggactaacgttacgtgttcggttttgggtcgttcgggtcggacgggtacctaaggttcgtaccgtccgtaggtcacgtcccgaaggtcccgtccgtcccccttcggtccaccttccgtccgttcccccg

SEQ ID NO: 283427 - DNA, 507 bp, Homo sapiens
  misc_feature: GYAE6OF01CEQYL.47.85.H08.1.454.CMB.1.raw
  modified_base (498)..(498): a, c, t, g, unknown or other
  misc_feature (498)..(498): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggactccctgagactctcctgtgcagcctctggcttcacctttcaataattatgctatgcagtgggtcctccaggctccaggcaaggggctagagtgggtggcggtcatatcgtccagtggacatcttcagtattacgcagacctccctggacggggccgattccaccatctccagacgacaattcccagaacacggtctatctcgcacctcgaccagcctgacgactgacgacacgtctctctactacgtgtgcgagagagttagacgtagtnattgtgtag

SEQ ID NO: 283428 - DNA, 537 bp, Homo sapiens
  misc_feature: GYAE6OF01BSV2Q.47.85.H08.1.454.CMB.1.raw
  modified_base (227)..(227): a, c, t, g, unknown or other
  misc_feature (227)..(227): n is a, c, g, or t
  modified_base (333)..(333): a, c, t, g, unknown or other
  misc_feature (333)..(333): n is a, c, g, or t
  modified_base (530)..(530): a, c, t, g, unknown or other
  misc_feature (530)..(530): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggcagttctgattctatctcctggtaccaacaacacccagcaaacgccccaaactcataatttatgacgtcaatgttcgcccctcgagggtttcncatcgcttctctgctccaatctggctaacgacggcctcctgaccatctcgtgggctcgacgtctggacggacgaggtctagtactttacttcgtgttgcttcgttgggactaactcgttgttcgtttggtcgttcggcggtaggacctaggttcgaccgttcgaggtcacgacccgaggtcctcgcccctcggtccncgttccg

SEQ ID NO: 283429 - DNA, 539 bp, Homo sapiens
  misc_feature: GYAE6OF01EQKHO.47.85.H08.1.454.CMB.1.raw
  modified_base (304)..(304): a, c, t, g, unknown or other
  misc_feature (304)..(304): n is a, c, g, or t
  modified_base (418)..(418): a, c, t, g, unknown or other
  misc_feature (418)..(418): n is a, c, g, or t
  modified_base (423)..(423): a, c, t, g, unknown or other
  misc_feature (423)..(423): n is a, c, g, or t
  modified_base (533)..(533): a, c, t, g, unknown or other
  misc_feature (533)..(533): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtagatcaccatcctcctgcactggaaccagtagtgacgttggcagttctgattctatctcctgtaccaacaacaccaggacaaagccccaaactcaataatttangacgtcaatcgttcgcccctcgtagggtttctctatcgcttctctggctaccaatctggcaacacggcctcctgaccatctcgtggctcgagtctgaggacgagctgattcttntgttnctcgttgggctaacttacgttggttcgtttgggtcgtttcgggcgggtaaggacctaaggttcgaccgttgtacggtcacgcccgaaggtcctacggtccccctcggtcncgtccg

SEQ ID NO: 283430 - DNA, 566 bp, Homo sapiens
  misc_feature: GYAE6OF01EKLC1.47.85.H08.1.454.CMB.1.raw
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgcccccgatcagcctgcctccgtgtctgggtctcctggacagtcgatcaccatcctcctgcactggaaccagtagtgacgttggcagttctgattctatctcctggtaccaacaacaccagcaaacgccccaaactcataatttatgacgtcaatcgttccgccccttcgtagggtttcctcactcgtcttctcgtgctccaatctggcaacncgcctccngaccatctctggctcgagtctgaggacgaggctgattacttcttgttgtctcgttgggacctaacgttaccgttggtttcggtttggggttcggttcgggcgggtacgggtaccgtaaggttcggacccgttcgtacgggtccacgcccgaaggtccctccggacccccttcggttccaccgttcccg

SEQ ID NO: 283431 - DNA, 579 bp, Homo sapiens
  misc_feature: GYAE6OF01C1RUY.47.85.H08.1.454.CMB.1.raw
  modified_base (500)..(500): a, c, t, g, unknown or other
  misc_feature (500)..(500): n is a, c, g, or t
  modified_base (525)..(525): a, c, t, g, unknown or other
  misc_feature (525)..(525): n is a, c, g, or t
  modified_base (557)..(557): a, c, t, g, unknown or other
  misc_feature (557)..(557): n is a, c, g, or t
  modified_base (564)..(564): a, c, t, g, unknown or other
  misc_feature (564)..(564): n is a, c, g, or t
  modified_base (566)..(572): a, c, t, g, unknown or other
  misc_feature (566)..(572): n is a, c, g, or t
  modified_base (574)..(579): a, c, t, g, unknown or other
  misc_feature (574)..(579): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaaacgcccccaaaactcataatttatgacgtcaattgttcgccctcgaggggtttctctatcgcttctctggctaccaaatctggacaacaccggcctccctgaccattcctcgtgggcctcgtacgtctgggaggtacgaggtcttagtacttttacttcgttggttcgtcgttacgttagggaaacttacgtggtttcggtttgggttcgttcgggacgggtacgggacctaaggttcgtaccgtcgttaacgggcaccgaccgaacggtctcccggccccttcggtcctactcgttccgttcccncccttccgtgtacgtgacgcttcgngacggcggtcctggaccgagggcagaactggntcgacgncnnnnnnncnnnnnn

SEQ ID NO: 283432 - DNA, 648 bp, Homo sapiens
  misc_feature: GYAE6OF01C1YDH.47.85.H08.1.454.CMB.1.raw
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (304)..(304): a, c, t, g, unknown or other
  misc_feature (304)..(304): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtcctcgccccgactcagcctgcctccgtgtctgggtctctggacagtcgatcaccntctcctgcactggaaccngtagtgacgttggctagttctgtattctatctcctgtaccaacaacaccagacaaacgccccaaactcaattaatttanacgtacgtactaatcgttccgcccctgtacgggttctctatccgtcttctcgtcgcctacctaatcgtacgaccaacgtaccggcccttcccgtacgacctacgttcctccggtagggtcctacggtacgttcgtacggaacggacggaggtcttagttactttaccgttcgtttgttcgtcttcggttcggtactaacgttcgttggtttcggtttgggttcggttcgggacgggtacggtaaccgttacggttccgtaccgtaccggtacggtacgaccggtacccgacggtcccgtcccggtcccccgttcgtacctacccgttccgttcccgttcccccg

SEQ ID NO: 283433 - DNA, 674 bp, Homo sapiens
  misc_feature: GYAE6OF01BNZP0.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcacatctcctgcactggaaccagtagtgacgttggctagttctgattctatctctgtaccaacaacaccaggacaaacgaccccaaactcaataatttactagacgtacaatcgttccgccctcgtacgggtttctctactcgtcttctcgtcggtctacctaaactcgtaggaccaaccgaccggtacccttcccgtacgtaccctacttccgtcgtcgggtcgtcgtacgttcgtaggacggacggaggtcgtgtaactttacttcgttgttcgtcttcgttcgggtacctaacgttacgttcggttgggttttcgggttcggttcggggacgggtaacgggtaaccgttaacgggttccggtaacccggttaccggtacgggttacccgaacggtaccccggaacgggtcccgttaccccggtcccccggttccggttacccgtacccttcccgttcccggttccccccgg

SEQ ID NO: 283434 - DNA, 764 bp, Homo sapiens
  misc_feature: GYAE6OF01EPIQ7.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaaaaggtgtccagtgtggaggtgcgaggtaggtggacgggtccgggggaggtcgtttagttcgacgtccggtggggacgtcccgtaggacgtaccttcctccgtgtggttacgtcctcgtaggtaactcgtacgtttctacgttaccttcgtggtatcgactacggtcgggtcccacctaacctccggaagggtacgggcgtggtggtcggtctacgtacgtactactaactccgtagtagtcggacgtagttagttaaattaaattagtacggtaccggtaccgttcggtacgggacggggtaccgtacttacgacgactacgtccctaaccgaaggtaccgaaaccggtaacggaacaaaggtagttaacttacgtagttactacggtaagtaaatcaaactagtcgtaggaagtaccgtacgtaaacgacggttaccggtcttacggttacttacgtacgtttaaggttttggttttaccgtttacgactttcccgggttcccggtttacccgggggcccgggttaacggtttcccgtttaccggggggacccgggtacccgggtaaaacccggggttccccggtttaggg

SEQ ID NO: 283435 - DNA, 521 bp, Homo sapiens
  misc_feature: GYAE6OF01AZP04.47.85.H08.1.454.CMB.1.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
  modified_base (395)..(395): a, c, t, g, unknown or other
  misc_feature (395)..(395): n is a, c, g, or t
  modified_base (450)..(450): a, c, t, g, unknown or other
  misc_feature (450)..(450): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccntctcctgcactggaaccngtagtgacgttggcagttctgattctatctcctggtaccaacaacacccaggcaaagcccccaaactcataatttatgacgtcaatgttcgcccctctaggggtttctcatcgcttctctgctcaatctgcacacgcctcctgaccatctctggctcgagtctgaggacgnggctgattacttctgttgctcttgggctaactactggttcgtttgggtgttcggnggacggtacagttcgaccgtcgtacggtcacgccgaagtctcgtccccgtcggtcactcgtcgtacccccg

SEQ ID NO: 283436 - DNA, 571 bp, Homo sapiens
  misc_feature: GYAE6OF01DBAUT.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgacccccaaactcaataatttatgacgtcaattcgttccgcccctcgagggtttctcatcgtcttctctcggctaccaaatctgacaacacgcctcctgaccatctctgggctcgagtcgtgacggacgaggtctgatttacttctgttgtctcgttgggacctaactacgttgttcggtttgggttcgttcgggcgggtagggaccgtaaggttcgaaccggttccgtaacgggtccacggtacccgaaggtccgtaccggtccccctccggtcctcccgttcccg

SEQ ID NO: 283437 - DNA, 571 bp, Homo sapiens
  misc_feature: GYAE6OF01AO262.47.85.H08.1.454.CMB.1.raw
  modified_base (335)..(335): a, c, t, g, unknown or other
  misc_feature (335)..(335): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctggtaccaacaacaccaggcaaaacgcccccaaatccaataatttatgacgtcaatgttccgcccctctagggtttctnatcgcttctctggctcaaatctgcaacacgcctccctgacccatctctgggctcgagtctgaggacgaggctgtactttacgttctgtttcgcttcgttgggactaacgttacttggttcggttttgggttcgttcgggacgggtacgggtaccgtaaggttcgaccgttccgtaggtcgacggcccgaaggtcctaccgtcccccgtacggtaccaccgttcgtccgttcccccg

SEQ ID NO: 283438 - DNA, 610 bp, Homo sapiens
  misc_feature: GYAE6OF01E0O3U.47.85.H08.1.454.CMB.1.raw
  modified_base (322)..(322): a, c, t, g, unknown or other
  misc_feature (322)..(322): n is a, c, g, or t
  modified_base (428)..(428): a, c, t, g, unknown or other
  misc_feature (428)..(428): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctccgtgtctgggtctccgtggacagtcgatccaccatctcgtgcactggaaccagtagtgacgttggctagttctgattctatctcctggtaccaacaacacccaggcaaacgcccccaaactcaataatttatgacgtcaatgttccncccctcgtagggtttctctatcgcttctctggcctccaaatctcggacaaccaccggccctccctcgacctactctcgtcggcctcgtagtcgtgaggacgaggtntaggtactttacttcgttgtttcgtccttcgttgggactaaccgttacgttcggttcggttttgggttacggttcgggacgggtacggtaccgtaggttcgacccggttccgtacggtcacggtccccgaagggtccctccggtcccccgtcggtacctaccgttccgtcccgttacccccc

SEQ ID NO: 283439 - DNA, 586 bp, Homo sapiens
  misc_feature: GYAE6OF01DP5C0.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctcaccctcctcactcagggcacaggttcctgggcccagtctgccccgactcagcctgcctccgtgtctgggtctcctggacagtcgatcaccatctcctgcactggaaccagtagtgacgttggcagttctgattctatctctgtaccaacaacaccagcaaacgccccaaatcataatttatgacgtcaatgttccgcccctcgagggtttctcatcgcttctctgctccaatctggcaacacggccctccctgaccactctcgtgggtctcgagtcgtaggacggacgaggcttgtactttacttcttgttcgtcgttcgttgggacctaacgttacgttgtttcggttttgggttcggtttcgggccgggtaagggtaccgtaacggtttcggacccggttacgtacgggtccgaacgacccgaacgggtccctacccgtccccccgttcggtccctaccgttcccg

SEQ ID NO: 283440 - DNA, 517 bp, Homo sapiens
  misc_feature: GYAE6OF01AHNB0.47.85.H08.1.454.CMB.1.raw
  modified_base (319)..(319): a, c, t, g, unknown or other
  misc_feature (319)..(319): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctnaggggtttctcatcgcttctctggctcaaatctggcaacacggcctccctgaccatctctgggctcgagtctgaggacgaggctgattacttctgttgctcgttgggctaacttactgttcgtttgggtgttcggcggaggccaagttcgaccgtcgtaggtcagcccaaggctcgcccctggcactctgttcccccg

SEQ ID NO: 283441 - DNA, 514 bp, Homo sapiens
  misc_feature: GYAE6OF01BRQJQ.47.85.H08.1.454.CMB.1.raw
  modified_base (496)..(498): a, c, t, g, unknown or other
  misc_feature (496)..(498): n is a, c, g, or t
  modified_base (501)..(514): a, c, t, g, unknown or other
  misc_feature (501)..(514): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctggaggacgaggctgattacttctgttgcttcgtggctaactacgtgttcgtttgggtgttcggcggaggacctagtcgaccgtcgtaggtcacgccaaggctcgccccgtcggtcactctcgttcccaccctccgtctacgtcgacgtctcgtcgagcgggcgtcggacgaacggtcgacgagtagtnnncgnnnnnnnnnnnnnn

SEQ ID NO: 283442 - DNA, 530 bp, Homo sapiens
  misc_feature: GYAE6OF01BGROT.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctgtaccaacaacaccaggcaaagcccccaaactcataatttatgacgtcaatgttcgcccctcagggtttctcatcgcttctctggctccaatctggcaacaccgcctccctgaccatctctcgggctcgagtctgacggacgaggctgattacgttctgttcgctcgttgggctaactcgtgtcgtttgggtgttcgggcggaggaccgtagttcgaccgttcgtaggtccaggcccaaggtcctcgtccccctcggtccactcgtcgtccccg

SEQ ID NO: 283443 - DNA, 538 bp, Homo sapiens
  misc_feature: GYAE6OF01BWJ1A.47.85.H08.1.454.CMB.1.raw
  modified_base (398)..(398): a, c, t, g, unknown or other
  misc_feature (398)..(398): n is a, c, g, or t
  modified_base (427)..(427): a, c, t, g, unknown or other
  misc_feature (427)..(427): n is a, c, g, or t
  modified_base (462)..(462): a, c, t, g, unknown or other
  misc_feature (462)..(462): n is a, c, g, or t
  modified_base (520)..(520): a, c, t, g, unknown or other
  misc_feature (520)..(520): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaacccagtagtgacgttggctagttctgattctatctcctggtaccaacaaccacccaggccaaacgcccccaaactcaattaatttatgacgtcaatgttccgcccctcgtagggtttctcatcgcttctctggctccaaatctgcaacacgcctccctgaccatctcgtcggctcgngtctgaggacgaggctgattcttctgttnctgtcggctaactctgttcgtttgggtgttcgggnggacgacgtagtcgaccgttcgtacggtcacgcccgagtcctccgtccccgtcgtccnccttgtccgttacccccg

SEQ ID NO: 283444 - DNA, 618 bp, Homo sapiens
  misc_feature: GYAE6OF01BS1UX.47.85.H08.1.454.CMB.1.raw
  modified_base (601)..(601): a, c, t, g, unknown or other
  misc_feature (601)..(601): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctccgtgtctgggtctcctggacagtcgatcaccatctcctgcactggaaccagtagtgacgttggctagttctgattctatctcctgtaccaacaacaccagcaacgccccaactcataatttatgtacgtcaatcgttccgcccctcgtacggggtttctctatccgtcttctcgtcggctaccaaattccgtaggaccaaaccgacccggtcccctacccctcgaaccctacttccttacgtcgggtcctcggtagtcgtaggacgggacgacggtcttagtactttactttcgttggttcgtccttcgttgggacctaaccttacgtggtttcggtttgggttcggttcgggtacgggacgggtacctaaggttcgaccggttcgtacggtcacggcccgaggtcctccgtccccgttcgtaccnccttcgtccgttccccc

SEQ ID NO: 283445 - DNA, 611 bp, Homo sapiens
  misc_feature: GYAE6OF01DS8RV.47.85.H08.1.454.CMB.1.raw
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctgtaccaacaacaccaggcaaagcccccaaatcataattangacgtnaatgttcgcccctgtacgggtttctcactcgcttctcgtcgctaccaatcgtcgcaacgacgtcctccacgacctatcctcgtggcctcgagttcgtggacggacgaggtctgttaactttacttcgttgttcgtcgtttcgttcgggtactaacgttcgttcggtttcggtttggggtcgttccgggacgggtacgggtaccgtaggtttccggaacccgttcggtacggttaccacggtcccgtaacggtcccgtacccgggtcccccttcggtaccctacgttcccgttcggtttacccccccg

SEQ ID NO: 283446 - DNA, 538 bp, Homo sapiens
  misc_feature: GYAE6OF01BM1Y8.47.85.H08.1.454.CMB.1.raw
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgacgtcaatgttccgcccctctagggtttctcatcgcttctctgctcaatctgcacncgcctcctgaccatctcgtggctcgagtcngaggacgagctgtattacttctgttgtctcgttgggctaacgttctgttcggtttgggtggttcgggcggtacgggtacgtaaggttcggaccgtcgtacggtcacggcccgagcgtccgtccccgtcggtcacctcgtcgttcccccg

SEQ ID NO: 283447 - DNA, 634 bp, Homo sapiens
  misc_feature: GYAE6OF01BELHF.47.85.H08.1.454.CMB.1.raw
  modified_base (310)..(310): a, c, t, g, unknown or other
  misc_feature (310)..(310): n is a, c, g, or t
  modified_base (367)..(367): a, c, t, g, unknown or other
  misc_feature (367)..(367): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgatcagcctgcctccgtgtctgggtctctggacagtcgatcaccatctcctgcactggaaccagtagtgacgttggctagttctgattctatctctgtacaacacaccaggcaacgccccaaactcataattatgacgtacaatcgtcncccttcgacgggttctctatcgtcttctctcgctacaatctagcaacacggcctccncgaccactcgtcgtcggtctcgtagtcgtagacggacgaggtctacggtattaccgttgtgttcgtcttcggttgggaccttaacgttaccgttcgggtttcgttttggggttcggtttccggggacgggtaacgggtaccgttaacgggttaccggtaacccggttcccggtaacgggttaccgtaccggaccccgtaacgggtacccgtccccggtccccccgttacggttccctaaccgttcccggttcccggttcccccccgg

SEQ ID NO: 283448 - DNA, 675 bp, Homo sapiens
  misc_feature: GYAE6OF01DNH8U.47.85.H08.1.454.CMB.1.raw
  modified_base (313)..(313): a, c, t, g, unknown or other
  misc_feature (313)..(313): n is a, c, g, or t
  modified_base (350)..(350): a, c, t, g, unknown or other
  misc_feature (350)..(350): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcacatctcctgcacgtcggaaccagtagtgtacgttggctagttctagtattctactctcctacgtaaccaacaaccaccaggacaaccgaccccaaactcaattaatttangacgtactaattcgttccgccctagtacgggttcctntactcgtcttctcgtcgctacaatcgtggaccacgaccgtccctcctacgacctactcgtcgtcgggtcctacggtacgttcgtaggaacggaacggacggtcttaggttaacttttaccgtttcgtttcggtttcgccgtttcggttcgggaaccttaaacgttcgtttcgggtttcgggttttgggttcgggttccggggacgggtaacgggtaacccgttaagggttccgtacccggttaccgttaacgggtaccaccggacccgaacggtcctccccggtcccccgttcggtaccctacctccgtttcccgttaccccccg

SEQ ID NO: 283449 - DNA, 760 bp, Homo sapiens
  misc_feature: GYAE6OF01BNGIR.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtcctcgccccgactcagcctgcctccgtgtcgtgggtctccgtggacagtcgatcaccatcctcctgcactcggaaccagtagtgacgttggctagttctgattctatctcctggtaaccaacaacaccaggacaaacgaccccaaactcaattaattatcgactacaattcgtaccgcccttgtacgggtttccacgtacttcgtcttctcgtcggtacctaccaacttcgtacggacctaaccgtaccggtccccttaccgtacgaccctacgtccttcggtcgggtcctacggtacgttcgtacggtacgggtaaccggtaggttaccttaggttaacgttttaccgtttcggtttcgtttcgtccgtttaccggttacgggtaaccttaaccgtttaccggtttcggtttcggggttttacggggttcgggtttacccggggacggggtaaccgggtaaccggttaacgggtttccggtaaccccggtttccggtacccgggttaaccgacccggggttaaccccgtaaccgggtccgttacccccgggtcccccgttaccggttacccgttaccccgttcccgtttaccccggttaccccccc

SEQ ID NO: 283450 - DNA, 731 bp, Homo sapiens
  misc_feature: GYAE6OF01D043X.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgactcagcctgcctcgtgtcgtggtctcgtggacagtcgatcaccatcctcctgcacgtaggaacctagtagtgtacgttggctagttctgtattctatctctacggtaaccaactaaccaccgacggaccaaaaccgacccccaaaatctaattaaatttacgtcgtacgtactaagttccgttcccgtccccttacggttacggggtttcctacgtacgttccgtctttcgttcgtcggtacctacctaaacttcgtacggtaaccaaccgtacccgggtccctacccgtacgaacctacttccgtcgtcgggtacctacggtacgttcgtagggaacggtaccggtacggtacgttacgtacttttaccgtcgtttaggtttcgtcgttccggttacggtaccctaaacgttccggtttcgggtttcgggttttcgggttacgggttccgggtacggggtaccggttaaccgtacggttaccggacccggttacgtacggtcgaaccgtacccggtacggtccctcccggtccccgtcggtaccttccgttcccgtccgttaccccc

SEQ ID NO: 283451 - DNA, 710 bp, Homo sapiens
  misc_feature: GYAE6OF01CA2X2.47.85.H08.1.454.CMB.1.raw
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctcgggcccagtctcgccccgactcacgcctgcctccgtgtcgtcgggtctccgtggacagtcgatcaccatcctcctgccacgtcggaacctaggtagtcggtacgttggctagttctagtacttctactctccgtacggtaaccaaccaaccgaccgacggaaccaaaccgacccctaaactactaattaacttactacgtactactaactcgtccgtacctcggttacggttactcgtactccgtcttcgtcgtcgacctactaacgtcgtacgacgacgtaccggtccctccgtacgactacttcgtcgtcggctcgngtacgnggacggacgtcgtctacgttacttacgttctcgttcgtcgttcggttacggacttaaccgttacggtttcggtttacgggtttcgggttcggttaccggggacgggtaacgggtaaccgttacgggttaccggtacccggttacggttacggacgtaccggtcccggtaacgggtcccgttaccccggtcccggttaccggttacccttacccgtttcccggttccccgtttaacccccg

SEQ ID NO: 283452 - DNA, 595 bp, Homo sapiens
  misc_feature: GYAE6OF01C387S.47.85.H08.1.454.CMB.1.raw
  modified_base (305)..(305): a, c, t, g, unknown or other
  misc_feature (305)..(305): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctgggtggaggtcggggggaggcgtggtccaggcctgggaccgtccctgagactctcctgtgcagcctctggcttcaccttcaattaattatgctatgcagtcgggtccncgaggctccgaggcgaagggctagaggtgggtggcggtcatatcgtaccagtggacatcttcagttacttacgcagactccccgtgggacggggtccattccaacctactcctaccaagacgaactaacttacccgaagtaaacctaccggtacttactcgtcgcctacctacgacctacgaccgtagaacgtaaccgtcgaccgaccgtaccgttacctccgttaccgtaaccttacgtaggtcgacggaaggtaagttacgtcggtaacgtacgtactgttggtacgg

SEQ ID NO: 283453 - DNA, 716 bp, Homo sapiens
  misc_feature: GYAE6OF01C62LD.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctcgtgtctgggtctcctggacagtcgatcaccatctcctgcactggaaccagtagtgacgttggctagttctgattctatctcctggtaccaacaacaccaggcaaacgccccaaactcataattatgacgtcaatcgttaccgtcccctcgtacggggttacctcagttcgtctttctcttaggccttaccaaaacttcgtcggaccaaaccgtaccgggcccctcccgtcgaccctaatccttccgtcgggtctcggtaacgtctggaggacggaggtcgtgtactttacttcgtgtttcgtcttcgttgggacctaacgttacgttcggtttcgggttttcggggttacggtttccggggtcggggtaacggggtaacccgttaaacgggtttaccggtaacccggtttaccccggttaacgggttacccggaacgggtaccccccggtaaaacggggtcccgttaccccgggttaccccccccgttccggggttccccttaaacccggttcccgtttaccccggttttcccccccccggg

SEQ ID NO: 283454 - DNA, 565 bp, Homo sapiens
  misc_feature: GYAE6OF01A41ZF.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttccgcccctcaggggtttctcatcgcttctctggctcaaatctggcaacacggcctccctgaccatcctcgtgggctcgagtctgacggacgaggctgtacttacttctgttcgcttcgttgggctaacgtactggttcggtttgggtgttcgggcggtaggtaccgaagttcgacccggttcgtaggttcacggtccccgaaggtccctacggtcccccctcgggtaccaccgttccgttcgttcccccccg

SEQ ID NO: 283455 - DNA, 645 bp, Homo sapiens
  misc_feature: GYAE6OF01EB4RY.47.85.H08.1.454.CMB.1.raw
  modified_base (291)..(291): a, c, t, g, unknown or other
  misc_feature (291)..(291): n is a, c, g, or t
  modified_base (349)..(349): a, c, t, g, unknown or other
  misc_feature (349)..(349): n is a, c, g, or t
tcagagctcacgtacacgaccggtgctcgatttagtatcactcagtcggggggaggcgtggtccagcctgggacgtccctgagactctcctgtgcagcctctggcttcaccttcaataattatgctatgcaggtgggtccgccaggctccaggcaaggggctagagtgggtggcggtcatatcgtccagtggacatcttcagtattacgcagacctcccgtggacggggcctattccaccatcctaccagacgactaacttcccagaacacggtctatctgcacctgaccncgcctgagaactcgacgaccacgtcctctctactactgtcgcgagagtagtgaacgtnttcagttgagagtcgttgaccttccggtcggggaccgaacggggtaacccttgggtacctacgttccgtacctcctcgtacgcccctaccgaacccggaaccgggcccctacgttcccggttcccttccccccgtcggcccgtccccgtcgtcccgtccgacgggaccgcccgacccgtaccgacggaccgccgaccgaccgggcccggcccggtcgggtaccgtccgggtccgttacgggtaccgtaacggtaccttaccgttacccgtacgttacgacgtcgtcgtggaccggg

SEQ ID NO: 283456 - DNA, 551 bp, Homo sapiens
  misc_feature: GYAE6OF01BW2GE.47.85.H08.1.454.CMB.1.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccagcaaagcccccaaactcaataattatgacgtacaatcgttcgcccctcgtacgggtttctcactcgtcttctctggctcaaatctgcaacncgcctcctgaccatcncgtggctcgtagtctgaggacgaggctgtattacttctgttcgtcttcgtgggactaacttcgttcggttcggtttgggttcggttcgggcggtacgggtacctaggttcggtaccgtcgtacggtcacggcccaaggctccgcccctcggtccactccgtcgttcccccg

SEQ ID NO: 283457 - DNA, 559 bp, Homo sapiens
  misc_feature: GYAE6OF01C86CC.47.85.H08.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
tcagagctcacgtacacgaccggtgctcgatttagtatcactcagtcgcgggggaggaactgctcagttaggacccagacggaaccatggaagccccagcgcagcttctcttcctcctgctactctggctcccagagaccactggagaaatagtgatgacgcagtctccagcccaccctgtctttgtctccgaggggaaangccaccctcncctgcagggccagtcagaatattcactcctacttagcctggtaccaacagaaaccctggtacaggcctcccgaggcctcctcatctatgatgcatcccaagcggccacgtcggcactcccgaagactaggttcaggtcggctaggtggtctgggacngtactcactctcaccntcagtcacgtaccgtagacgtcctagaacgtacgtttaggtacttttattacgtgtcgtagtctaggtcgtagtacgttcgtcggtcctccgcttaccgtacgtttcgggacggtacgggaccgagggtcgagtacgtacgaaacgacgtggtgctcgacacctatcgtgttacc

SEQ ID NO: 283458 - DNA, 552 bp, Homo sapiens
  misc_feature: GYAE6OF01CHH3U.47.85.H08.1.454.CMB.1.raw
  modified_base (310)..(310): a, c, t, g, unknown or other
  misc_feature (310)..(310): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcttgggttttcctcgttgcttcttttaagaggtgtccagtgtcaggtgcgcctggtggaggtcggggggagcgtggtccagccgtgggacgtccctgagactctcctgtgcagcctctggcttcaccttcaaattaattatgctatgcgaggtcgggtccnccaggcctccgaggcgaaggggctaggaggtgggtggcggtacatagtcgtaccagtgactatcttacagttactacgcagacctcccgtggacgggcattcaacctatcctaccaagagaactaacttcccaagaacctacggtctaactctgacctacctcgacccagccctagaagaactcgaccgactaccgtctctactactacgtgtcgacgaagtacgaagttgaacgtgtctag

SEQ ID NO: 283459 - DNA, 771 bp, Homo sapiens
  misc_feature: GYAE6OF01CF1JX.47.85.H08.1.454.CMB.1.raw
tcagagctcacgtacacgaccggtgctcgatttagtatcactcagtcgcggggggggtctcaggaggcagcgctctcaggacatctccaacatggcctgggctctgctgctcctcaccctcctcactcagggcacagggtcctgggcccagtctgccccgatcagcctgcctccgtgtctgggtctccgtggacagtcgatcaccatctcctgcactggaaccagtagtgacgttggctagttctgattctatctcctggtaccaacaacaccaggcaaacgccccaactcaataatttatgacgtcaattcgttccgtcccctcgtagggtttctctatccgtcctttctctcggaccttaccgtaaacttcgtacggaccaaaccgacccgggtaccccttcccctacggtaacccctaacttcccgttccgttccggggtccttaccgggtacgttcccgttacgggaacggggtaaccggacgggtaccgttacgttaacgttttaacccgtttccgtttgggtttccgttccgtttaccggtttacggggtacctaaccgttaccggttcgggttttccgggttttgggggtttaccggtttaccggggtaccgggtaacggggttaaccggtaacgggtttcggtaaccccggtttaccggttacggtaccgtaaccggtaccccggtaaacggtcccggttccccgtccccccggttccggttacccgtacccgttcccggtttaccccggtttccccccccgg

SEQ ID NO: 283460 - DNA, 530 bp, Homo sapiens
  misc_feature: GYAE6OF01ERCYV.47.85.H08.1.454.CMB.1.raw
  modified_base (465)..(465): a, c, t, g, unknown or other
  misc_feature (465)..(465): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctcgtgtctgggtctcctggacagtcgatcaccatctctgcactggaaccagtagtgacgttggctagttctgattctatctcctggtaccaacaacaccagcaaacgccccaaactcataatttatgacgtacaatgttcgccctctagggtttctctatcgtcttctcgtcgctcaaatctggacaacacggcctccctcgaccatctcgtggctcgagtctgacggagacggctgtattacgttctgttcgtcttcgtgggactactacttgtcggtttgggtgttcgggnggtacggacgtaagttcgacgtcgtacggtcaggcccagctacgccctcgtctctctcgttcccc

SEQ ID NO: 283461 - DNA, 538 bp, Homo sapiens
  misc_feature: GYAE6OF01ETAET.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccagcaaacgcccccaaactcataatttatgacgtcaatcgttcgccctcgtagggtttctcactcgcttctctgctcaatctgcaacacgcctcctgaccactctcgtggctcgagtctgaggacgaggctgattactctgttgtctcgttgggctaacgtacgtgttcggtttgggttcgttcgggcggaggaccgtaggttcgaccgttcgtacggtcacgcccgaaggcctcggtccccctcggtccaccttcgtcgtcccccg

SEQ ID NO: 283462 - DNA, 659 bp, Homo sapiens
  misc_feature: GYAE6OF01AWCM2.47.85.H08.1.454.CMB.1.raw
  modified_base (345)..(345): a, c, t, g, unknown or other
  misc_feature (345)..(345): n is a, c, g, or t
  modified_base (633)..(633): a, c, t, g, unknown or other
  misc_feature (633)..(633): n is a, c, g, or t
  modified_base (638)..(639): a, c, t, g, unknown or other
  misc_feature (638)..(639): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (652)..(653): a, c, t, g, unknown or other
  misc_feature (652)..(653): n is a, c, g, or t
  modified_base (657)..(657): a, c, t, g, unknown or other
  misc_feature (657)..(657): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtacaacaacaccaggcaaacgccccaaactcataattatgacgtcaatgttccgcccctcgtagggtttctcatcgcttctctcggctaccaatctggcaacgacggtcctcctgaccatctcgtgggcctcgagtccgtggacggacgaggtctgtactttacttctgttnccgttcgttacggactaacgtacgttgttacggtttgggttcggttcgggcgggtacgggtacctaaggttcgacccggttacgtacgggtaccacggacccgtaaggtccgtcccgtcccccgttccggtaccttaccgttcccgttcccggtttaccccccgtcctttccccgttaccgttaccggttacggtaccgtccgtttaccggtcgggtaccgggtccgggggtccgttacggggacccggtaaacgggtcccgtaaccgtaacggttagcgtcgtacgngtcgnngcgcncgcgcncnnctgncg

SEQ ID NO: 283463 - DNA, 542 bp, Homo sapiens
  misc_feature: GYAE6OF01EO8TN.47.85.H08.1.454.CMB.1.raw
tcagagctcacgtacacgaccggtgctcgatttagtatcactcagtcgcggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgacccatctctgggctcgagtctgaggacgagctgattacttctgttgctcgttggctaactctgttcgtttgggtgttcgggcggagggaccaagtttcggaccgttccgtaggtcaggccccgaaggtcctacggtcccccttcgggtcctacgttcctcggttcccccg

SEQ ID NO: 283464 - DNA, 940 bp, Homo sapiens
  misc_feature: GYAE6OF01BMEMW.47.85.H08.1.454.CMB.1.raw
  modified_base (197)..(197): a, c, t, g, unknown or other
  misc_feature (197)..(197): n is a, c, g, or t
tcagagctcacgtacacgaccggtgctcgatttagtatcactcagtcggcggggggggtctcaggaggcagcgctctcaggacatctccaccatggcctgggctctgctactcctcaccctcctcactcagggcacgagggtcctgggcccagtctcgccccgactcagcctgcctcgtgtctggtctccgtggacngtcgatcaccatctctgcacgtggaaccagtagtgtacgttggactagttctagtatttctacttctccgtacggtaaccaaacaaaccacccgaacggaaccaaaccgaccccctaaactaccaattaatttactacgtaccgtactaattcgttacccgtccccgttacggttacgggttttacctaccgtacgttccggtcctttccgtccgttacggtacccttaaccgtaaaacgttccgttacggaaccctaaacccgtacccggtacccctttacccgtaccgtaaccctacgttccgttaccggtccgggtaccttaccggtacggtaccgttagggaaaccgggtacggtaacggtccgttaacgttaaccgttttaaccgttttcgtttaaccgttttaccggtttaccggttttacggggtaaacccttaaccggtttaaccgggtttcgggtttttaccggggttttacgggggtttaccgggtttacccgggggtaccggggttaaaccggggttaacccgtttaaccgggtttaccggtaaccccggtttaccgggttaacgggttaacccggtaaccgggttaacccccggtaaacgggttccccccggttaccccgggtttacccccccccgggttaccggggtttaacccccttaacccccgggttttcccccggtttttaccccccggttcccccccccgggtttccccccgttttaacccccgg

SEQ ID NO: 283465 - DNA, 533 bp, Homo sapiens
  misc_feature: GYAE6OF01AZVBK.47.85.H08.1.454.CMB.1.raw
  modified_base (276)..(276): a, c, t, g, unknown or other
  misc_feature (276)..(276): n is a, c, g, or t
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
  modified_base (442)..(442): a, c, t, g, unknown or other
  misc_feature (442)..(442): n is a, c, g, or t
  modified_base (503)..(503): a, c, t, g, unknown or other
  misc_feature (503)..(503): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctgggtggaggtcggggggaggcgtggtccagccgtgggacgtccctgagactctcctgtgcagcctctggcttcaccttnaaataattatgactatgcaggtcgggtccnccaggcctccgaggcgaaggggctagnggtgggnggcgnatncgtcagtgacngtctcagtataccgnagacctccgtaggacgggcacttcacctactctaccagaacgacaacttcccaagaactacggtactntcgtcgaccactcgaccacgctagacgtaactcgacacgtacgtctcctactacctcgtgngcgagagacgtcgacgatcgtagtggtacg

SEQ ID NO: 283466 - DNA, 767 bp, Homo sapiens
  misc_feature: GYAE6OF01A6Y98.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggcccagtctcgccccgactcagcctgcctcgtgtctgggtctccgtggacagtcgatccaccattcctcctgcacgtcggaacctaggtagtgtacggttggctagttctgtattctatctccgtcgtaaccaacaaccaccaggaccaaaccgacccccaaaactcctaattaactttagtacgtacgtactaacgttcgtttcccgtaccccgttcggttaacggggttttcctacgtaacttccggttcctttccgtcgttacggtccctaaccgtaaacttcgttacggaaccaaaccgtacccggtaccccttacccgtacgtaccctacttcccgtacggttcgggccttacggtacgtcgtacggacggtacggtacgtcgttagttactttaccgttcgttcgttcgtccgttcgttacgggtaccttaaaccgttcggtttaggtttcgggttttcggggttacggtttccggggacgggtaaccgggtaacggtaacgggtttccggacccggtttaccgtacgggtaccgtaccggtaaccccgtaacggtccctaccccggtccccgttcggtacccgtacccgttccgttccccggttacccccccg

SEQ ID NO: 283467 - DNA, 746 bp, Homo sapiens
  misc_feature: GYAE6OF01B6V6Z.47.85.H08.1.454.CMB.1.raw
  modified_base (319)..(319): a, c, t, g, unknown or other
  misc_feature (319)..(319): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgactcagcctgcctccgtgtctgggtctcctggacagtcgatcaccatctctgcacgtgaaccagtagtgacgttggctagttctgtattctatcctccgtacggtaaccaaacaaccacccgaggaccaaaccgaccccaaaactcaattaatttancgtactacaatcgttccgccccgtgtacgggttctcgtactccgtcttcgtcgtcggtacctacctaactcgtacggacctaaaccgtacccgtccccttccccgtacgtaaccctacgttccgtaccggttccgggtaccgttaccggtacggttaccgtaaggggtaacggggtaaccgggtacggtccgttaaccgggttttaaccgttttccggtttaccggtttcggtttccgttcccggtttacggtacggttaacccttaacgtttcgggttttaccggggtttcggggtttcgggtttcggggtccggggacgggtaacccgtacggttacgttaccggtacccgtacggtacggtaccgaccggtaccgacgtcccgtcccgtcccgtcgtaccctccgttccgtccccgttaccccg

SEQ ID NO: 283468 - DNA, 581 bp, Homo sapiens
  misc_feature: GYAE6OF01BXG8O.47.85.H08.1.454.CMB.1.raw
  modified_base (206)..(206): a, c, t, g, unknown or other
  misc_feature (206)..(206): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgatcagcctgcctccgtgtctgggtctcctggacagtcgatcaccntctcctgcacgtggaaccagtagtgacgttggctagttctgtattctatctctgtaccaacaacaccagcaacgccccaaatcataattatgtacgtacaatcgtccgccctacgtagggttctctatcgtcttctctgtctacaactctgacaacgaccgcctacctcgacctactcctacgtcgggtctcgagttcgtggaggacgaggtctagtacttacttcgtgttcgcttcgtggactacttacgtgttcggtttgggttcgttcgggcggtacggtaccgtagttcggtacccgttcgtacggtccgacggtcccgaaggtccttcccggtccccgttcggttacctccgttcgtcccggttcccccg

SEQ ID NO: 283469 - DNA, 672 bp, Homo sapiens
  misc_feature: GYAE6OF01DLKD0.47.85.H08.1.454.CMB.1.raw
  modified_base (224)..(224): a, c, t, g, unknown or other
  misc_feature (224)..(224): n is a, c, g, or t
  modified_base (317)..(317): a, c, t, g, unknown or other
  misc_feature (317)..(317): n is a, c, g, or t
tcagagctcacgtacacgaccggtgctcgatttagtatcactcagtcgcggggggggtctcaggaggcagcgctctcaggacatctccaccatggcctgggctctgctgctcctcaccctctcactcagggcacagggtcctgggcccagtctgccccgactcagcctgcctccgtgtctgggtctcctggacagtcgatcaccatcctcctgcactggaaccngtagtgacgttggctagttctgattctatctcctggtaccaacaacacccagacaacgccccaaactcaataattatgacgtcaatcgttccnccctcgtagggttctctatcgtcttctctcggctccaaatctggtacaacgaccggcctccgtcgacctatccgtcgtgggtcctcgtacgtctggaacggacgacggtctaggtaactttaccgttcgttgtttcgtccgtttcgtttcgggaacctaacgtttacgttcgggtttcggtttggggtttcgttcggggtcgggtaacggggtaaccgtaagggtttaccggacccggttaccggtaacgggttaccgaaccggtccccggtaaaaccgggtcccgttacccgggttcccccccgttaccggttacccttaacccgttcccgtttccccggtttacccccccggg

SEQ ID NO: 283470 - DNA, 617 bp, Homo sapiens
  misc_feature: GYAE6OF01BGNCO.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctgtaccaacaacaccaggcaaacgccccaaactcattaatttatgacgtcaatcgttccgcccctcgtagggtttctcatcgtcttctctggcctaccaaatctggcaaccgaccggcctccctcgaccactctcgtggcctcgagtcgtggacggacgaggtctgtactttacttctgttcgtcgttcgttcgggacctaaccgttacgttggttcggttttggggttcggtttccggggacgggtaacgggtaccgtaaggttccggtaccggttccggtacgggtcgaccggtcccgaacgggtcccgtcccggtacccccgttcggtaccctaccgttcccgttccgttccccccg

SEQ ID NO: 283471 - DNA, 546 bp, Homo sapiens
  misc_feature: GYAE6OF01A30QE.47.85.H08.1.454.CMB.1.raw
  modified_base (360)..(360): a, c, t, g, unknown or other
  misc_feature (360)..(360): n is a, c, g, or t
  modified_base (528)..(528): a, c, t, g, unknown or other
  misc_feature (528)..(528): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccaggcaaacgcccccaaactcaataatttatgacgtcaatgttccgcccctcagggtttctcatcgcttctctgctccaatctggcaacncgcctcctgaccatctctcggctcgagtctaggtacggacgagctgtacttacttcgtgttgctcgttggctaactacttgttcgtttgggtcgttcggcgggtaggaccaggttcgaccgttccgtaggtccacggcccaaggtcctaccgtcccccgtggtacccnctccgttcgttccccccg

SEQ ID NO: 283472 - DNA, 670 bp, Homo sapiens
  misc_feature: GYAE6OF01D5T4Z.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaggtctcggccccgactcagcctgcctccgtgtctgggtctccgtggacagtcgatcaccatctctgcactggaaccagtagtgacgttggctagttctgattctatctcctggtaaccaacaacacccaggaccaaacgaccccaaatccataatttatgtacgtacaatcgttccgcccctgtacggggtttctctactcgtcttcctcgtcgctacaaatctggacaacacggtcctccctcgacctactctcgtcgggcttcggatcgtggacggtacgaggtctaggtactttacgttcttgtttcgactttcgttacgggtactaaaccgttcgttcggttacggttttcgggggttgtttaccgggcggggtaacggtaaccgttaaggttcgtacccgggtttaccgtacgggtacccgaaccggtaccccggtaaacgggtcccgttcccccgggtacccccttaccgggttacccgttacccgttcccggtttccgtttcccccccccggg

SEQ ID NO: 283473 - DNA, 711 bp, Homo sapiens
  misc_feature: GYAE6OF01DBR8Y.47.85.H08.1.454.CMB.1.raw
  modified_base (258)..(258): a, c, t, g, unknown or other
  misc_feature (258)..(258): n is a, c, g, or t
  modified_base (275)..(275): a, c, t, g, unknown or other
  misc_feature (275)..(275): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgcttcttttaagaggtgtccagtgtcaggtgcgctggtggaggtcgggggagcgtggtccagccgtgggaccgtcctgacgactctcctgtgcagtcctntcggtcttccaccttanaaattaatttatgtctaattggactagggttcgggtcccgaccgacgggtcctccggagggaccggaaaggggtctagggagggttcggggtgggtcggtactatacgtccgtccgtaggtcggaacctagtttccgttacgtaggttacttaccggactacgtacctcccggtagggacggggtaccctattcccacgtactccgtacgaaggactaactaaccgttcccaacgtaaccgtacggtaccttaacgtccgttacgacccgtaacccgtacgaacccgttacgaccgttaacgaccggtaaaccgttacgaaccgtaccggttacccttacctcgtttaaccccgttagtaaccggttcggtacggaaccggtaacgggtacgtagttaacggtaccggtagttaccttacggtttggtcgtaaccg

SEQ ID NO: 283474 - DNA, 656 bp, Homo sapiens
  misc_feature: GYAE6OF01C6R3L.47.85.H08.1.454.CMB.1.raw
  modified_base (136)..(136): a, c, t, g, unknown or other
  misc_feature (136)..(136): n is a, c, g, or t
  modified_base (392)..(392): a, c, t, g, unknown or other
  misc_feature (392)..(392): n is a, c, g, or t
tcagagctcacgtacacgaccggtgctcgatttagtatcactcagtcgcggggggggtctcaggaggcagcgctctcaggacatctccaccatggcctgggctctgctgctcctcaccctctcactcagggcacgngggtcctcgggcccagtctcgccccgactcagcctgcctcgtgtcgtgggtctccgtggacaggtcatcacctagtctcctgacacgtcggaaccagtagtgacgttggctagttctgattctactctcctagtaccaacaacaccagacaaacgacccaaactctaactaacttatacggactactaacgtcgttccgaccctcgtacgggttctacgctcgtcttctcgtcgctacgaatctacggactaaccnccggtacctccgacgtacctactcgtcgtcggtccgtacgacgtcgtacggacggtaaccgtaggtactacggtaactttaccgttcgttcgttacgcgttcggttacggtcctaaacgtttcgtttacggttcggtttcgggtggttaccgggtacgggaaccggttacgtaaacgttccgggtaccgtaccggttacggtccgaaacggtcccgaacggtccgtacccggtcccgtcgtcgacttccggtcccgttaccccg

SEQ ID NO: 283475 - DNA, 730 bp, Homo sapiens
  misc_feature: GYAE6OF01BGA1R.47.85.H08.1.454.CMB.1.raw
tcagagctcacgtacacgaccggtgctcgatttagtatcactcagtcggcggggtctgggagaggagcccagcactggaagtcgccggtggttccattcggtgatcacgcactgaacacagaggactcaccagtcggagtttgggctgagctgggttttcctcgttgcttcttttaagaggtgtccagtgtcaggtcgcgcctggtggaggtcggggggagcgtggtccagccgtgggactccctgacgactctcctggtgcacgcctcgtcggtcctttcctaaccctttacaaattaaatttagtgtaccttagttcggaccgtacgggttcggggtccccgcccgaacggggtccctacccggacgggaaccggtaaagggggtccttaagggtaaggggttgggggttcggggtaccgggttactaacgttacgttccggtaccgtaagggtacggaactacgttccttacgtagttattaccgacgtaacgtacccgtcccgtagggacggggtccctaacgttccaaccgtactcccgtacgaagaaccgtaactaaaccttcccgaaacgaaccgtaccggttactacgttcctagtaccctaccgacgtaacccacggtaccctaggaacgtaaccgcgtaaccgtaccgtaccgttcctaccgtaccttactccgtagtacgacggtagtacgttaggtacgacgtagtcgtagttgtacg

SEQ ID NO: 283476 - DNA, 709 bp, Homo sapiens
  misc_feature: GYAE6OF01EE1CM.47.85.H08.1.454.CMB.1.raw
  modified_base (700)..(700): a, c, t, g, unknown or other
  misc_feature (700)..(700): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagcgttgggttttcctcgttgcttcttttaagaggtgtccagtgtcgaggtgcgccgtgggtggaggtcggggggagcgtggtccagtccgtgggaccgtccgtgacgtactcctcgtgtgcacgcctcgtgtccttaccaccttacaaattattatcgtactagtcgcgtaggttcgggtcccgcgacggtccgtaccgaggacggaagggtctaggaggtggggtcggtcggtatagtacgtccggtacgaggtcggaactacgttcgttacgtagttaacgttaccgcgtaacgtacccgttcccggaggggtacgggtaccgtacttaccgaacctactcccgtaccgaagtaaccgtaactaaccgttacccgaaacgtaaccgtaccggttactactacgtccgtacctaccgtacgaacccgacgtaccgtagaacccgtaacgtacggaaccgtaccgtacccgtccttaccgtacccttaacgttaccgtcggtaccggtacggtacggtacggttaggttaacggtaacgtacgttaccgtagtttcggnggttaacgg

SEQ ID NO: 283477 - DNA, 689 bp, Homo sapiens
  misc_feature: GYAE6OF01BDS9O.47.85.H08.1.454.CMB.1.raw
tcagagctcacgtacacgaccggtgctcgatttagtatcactcagtcggcggggggggtctcaggaggcagcgctctcaggacatcctccaccatggcctgggctctgctgctcctcaccctcctcactcagggcacgagggtcctgggccctagtctcgccccgatcagcctgcctccgtgtcgtgggtctcgtggacagtcgatcacatctcctgcacgtcggaacctagtagtgacggttgctagttctgacttctatcgtctggtaaccaacaaccacgacggacaaacgaccccaaatctaattaattactcgaacgtcgtaaattcgttccgacccgttcgtacgggtttctcgtaacgttcgcctttacgtctcggtacctaacctaaagtccgtcggtaaccaaacgtcccggtaccttacccgtacgaacctaacttccgtcgttcggtactacggtaagttcgtaacggacggtacgtaggacttaggtaacttttacgtctggttactcgttacggtaggacccttagttaccggttggttcgggttttgggacggttaccggggacggtaacgggtaaccgtaagttccggtaaccggttacgtaggtacgtaacggtacccgtaacggccttacccggccccgttacgtaccctccgtacccgttcgttacccccg

SEQ ID NO: 283478 - DNA, 671 bp, Homo sapiens
  misc_feature: GYAE6OF01CLSO4.47.85.H08.1.454.CMB.1.raw
  modified_base (313)..(313): a, c, t, g, unknown or other
  misc_feature (313)..(313): n is a, c, g, or t
  modified_base (333)..(333): a, c, t, g, unknown or other
  misc_feature (333)..(333): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagtcgttgggttttcctcgttgtcttcttttaaagaggtgtccagtgtcaggtgcgctggtggaggtcgggggagcgtggtccagccgtgggacgtccctgacgtactcgtccgtgcgacagcccttcgtggtccttacctaccttacaaattaacttatcgactntggtcgtaggtcgggtcccncggacgccgtacgacgggacgaagggtcgtaggtaggtcgggtgggcggtcaagtacgtccgtaccgaggtacgggtaactaaggttccttacgtaagtaacgttaccgacgtaaccgtacccgtccgagggtaccgggacgtaccttaccgtacctactccgtaccgaaggacgaaccgtaacttaacccgaagtaacccgtaacgtcgtacttaccgtcgtaacccgaccgtacacccgttagaaccccgttagaacgtaacgcgtaaccgactacccgtactaccgttactaccgtactcggtcgaccgtaagacgtagttagacgtagtactag

SEQ ID NO: 283479 - DNA, 555 bp, Homo sapiens
  misc_feature: GYAE6OF01AISMV.47.85.H08.1.454.CMB.1.raw
  modified_base (223)..(223): a, c, t, g, unknown or other
  misc_feature (223)..(223): n is a, c, g, or t
  modified_base (426)..(426): a, c, t, g, unknown or other
  misc_feature (426)..(426): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccngtagtgacgttggcagttctgattctatctcctggtacccaacaaccacccaggcaaagcccccaaaactcaataatttatgacgtcaatgttccgcccctcgagggtttctcatcgcttctctggctcaatctggcaacacggcctccctgaccatcctcgtgggcctcgacgtctgaggacgaggctgtattactctgttntcgtcgttggcaacttctgttcggtttgggtgttcggcggtaggtccgtagttcgaccgtccgtacggtcacgtcccgaaggtccttccggcccccgtcggttacccaccgttccgtcgttaccccccg

SEQ ID NO: 283480 - DNA, 641 bp, Homo sapiens
  misc_feature: GYAE6OF01BIN7A.47.85.H08.1.454.CMB.1.raw
  modified_base (340)..(340): a, c, t, g, unknown or other
  misc_feature (340)..(340): n is a, c, g, or t
tcagagctcacgtacacgaccggtgctcgatttagtatcactcagtcgcggggtctgggagaggagcccagcactggaagtcgccggtgtttccattcggtgatcagcactgaacacaggggactcaccaactggtaggtttgggtcgtcgtaggcttgggtttttccgtttccgttggtctctttttaaggttaggtgttccacgtgtcgtaggtgtcggccgtggtgggaggtcgggggggtagggcggtggtccgacgccgtcggggtaccggtcccgtgtagacttcctcctggtgcacgcctctcggcttccaccttacaattaattatgcttangtcgacggttcgggtcccggccaggccgtccgagggacgaacgggggctaggtaggtggggtggcggtcaatatccgtcaggtgactatcttacaggtattacgcagacctcccgttgggagggtccgactactaccactctaccagagactaacttacccacgaacgtaccgtactactctcgaccacctcgaccacgccgtacgtacgaactacgaacgacccgtactaccttcccttactacttaaccgtggttacgacggtacgaggtacgtagtacgacgttagtattggtgtacg

SEQ ID NO: 283481 - DNA, 607 bp, Homo sapiens
  misc_feature: GYAE6OF01DLSZN.47.85.H08.1.454.CMB.1.raw
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (387)..(387): a, c, t, g, unknown or other
  misc_feature (387)..(387): n is a, c, g, or t
  modified_base (425)..(425): a, c, t, g, unknown or other
  misc_feature (425)..(425): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggcccagtctcgccccgactcagcctgcctccgtgtctgggtctccgtggacngtcgatccaccatcctcctgcactggaaccngtagtgacgttgctagttctgattctatctctggtaccaacacacccaggacaaacgccccaaactcaataatttatagacgtacaatcgttccgcccctcgtacgggttctcactcgtcttctcgtcggctcaaatcgcgacacaccgcctccctnaccagtccttcgcggtctcggagttctaggacgtacgngtcgtgtacttacgtttctggtttcgcttcgttcgggactaacttacgttggttcggttagggttcgttcgggcggggtaacgtaccggttaaggttccggtaccgtaccgttaggtaccgtagtcccggaacggtccgtacccgtccccgtacggtcctaccgttcgtccgttccccccgg

SEQ ID NO: 283482 - DNA, 551 bp, Homo sapiens
  misc_feature: GYAE6OF01CYGT8.47.85.H08.1.454.CMB.1.raw
  modified_base (408)..(408): a, c, t, g, unknown or other
  misc_feature (408)..(408): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccagtagtgacgttggctagttctgattctatctcctggtaccaacaacaccaggcaaacgccccaaactcataatttatgacgtcaatgttaccgcccctctaggggtttctcatccgcttctctgctccaaatctggcacacgcctccctgaccatcctcgtcggtctcgagtctggaggacgnggctgtattacttctgttgcttgttcggactaactacgttggttcggtttgggttcgttcgggcggtagggtaccaggttcgaccgtcgtacggtcacggtcccaggtcctcgccccgtcgtcctactcgttccgttaccccg

SEQ ID NO: 283483 - DNA, 670 bp, Homo sapiens
  misc_feature: GYAE6OF01CYLFN.47.85.H08.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (224)..(224): a, c, t, g, unknown or other
  misc_feature (224)..(224): n is a, c, g, or t
  modified_base (323)..(323): a, c, t, g, unknown or other
  misc_feature (323)..(323): n is a, c, g, or t
tcagagctcacgtacacgaccggtgctcgatttagtatcactcagtcggcggggggggtctcaggaggcagcgctctcaggacatctccaccatggcctgggctctgctgcctcctcaccctcctcactcagggcacgagggtcctgggcccagtctcgccccgatcagcctgcctccgtgtctgggtctccgtggacagtcgatcacntcnctncatggaacngtatgacgttggctagttctgtatctatctctgtaccaacaacaccaggacaaacgaccccaaactacaacttaattatacgacgtactaatcgttccncccgttcgtacgggtttcctactacttccggtctttctccgtcggtacctaccgtaaaatcgtcggacaaaccgaccggtccctccctacgacctactctcgtacggcctcgacgtcgtcggaggacggacgtcgtacgtacttactttcgtgttcgttctacggtcggacgtaaactttcggtgttcggttttgggtcggttcgggaccgggtaacgggtaaccgtagggttccgtaacccggttccggttaacggtccgtaaccgtcccggtaaccggtcccgttacccccgtcccccggttacggttaccccgttaccttcccgttacccggtttcccccccgg

SEQ ID NO: 283484 - DNA, 589 bp, Homo sapiens
  misc_feature: GYAE6OF01DI7NH.47.85.H08.1.454.CMB.1.raw
  modified_base (174)..(174): a, c, t, g, unknown or other
  misc_feature (174)..(174): n is a, c, g, or t
  modified_base (338)..(338): a, c, t, g, unknown or other
  misc_feature (338)..(338): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagnggtgtccagtgtcaggtgcgcctggtggaggtcgggggaggcgtggtccagccgtgggaccgtccctgagactctcctgtgcagcctcgtggtccttccaccttacaaattaattatgactatgctagtcgggtccgcgaggctccgaggcgaaggggctaggnggtgggnggcgtnatagtcgtacaggtgactattcttacgagttaactacgacacgacctcccgtagggacggggtacctacttccgaacctagtcctaccgaaggaacaacctaacttaccccgaaggtaaaccgtacggtactaacgtctcgacctaccgtacgaaccacgtccgtagaacgtactacgacacgtaccgtctctactactacgtgacgacgagagtaggtcgacggtatctgttgtacg

SEQ ID NO: 283485 - DNA, 667 bp, Homo sapiens
  misc_feature: GYAE6OF01CQDGH.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggcccagtctcgccccgatcagcctgcctcgtgtctgggtctccgtggacagtcgatcaccatctcctgcactggaaccagtagtgacgttggctagttctgattctatctcctggtaccaacacaccaggcaaacgccccaaactcaatattatgacgtacaatcgttcgcccctgtacgggttcacgatcgtcttctcgtggctacaaatcgtcgtacaacctacggccctacccgtcgaacctatccttcgtcgggccgtcgagtcgtaggacggacgaggtctacggtactttacgttcgttgttcgtcttcggttgggaacctaacgttacgttcggtttcggttttcggggttcggtttaccggggacgggtaaccgggtaaccgttaagggttaccggtacccggttaccggttaagggtccctaaccgggtaccccgtaaacgggcccttacccggtacccccccggtttacgggtaccctaacccgttcccgttcccggtttaacccccccc

SEQ ID NO: 283486 - DNA, 529 bp, Homo sapiens
  misc_feature: GYAE6OF01D1ZEQ.47.85.H08.1.454.CMB.1.raw
  modified_base (395)..(395): a, c, t, g, unknown or other
  misc_feature (395)..(395): n is a, c, g, or t
  modified_base (453)..(453): a, c, t, g, unknown or other
  misc_feature (453)..(453): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccagcaacgccccaaactcataatttatgacgtacaatgttcgcccctcgagggtttctcatcgcttctctgctacaatctgcaacacggcctcctgaccatctctggctcgagtctgagacgngctgtattacttcgtgttgctgttcgggctaactacgtgttcgtttgggtcgttcggnggacggtacgtaagttcgaccgtccgtggtacagtcccgaaggtctcgccccgtcgtccacttcgtcgttcccccg

SEQ ID NO: 283487 - DNA, 548 bp, Homo sapiens
  misc_feature: GYAE6OF01E2X1S.47.85.H08.1.454.CMB.1.raw
  modified_base (300)..(300): a, c, t, g, unknown or other
  misc_feature (300)..(300): n is a, c, g, or t
  modified_base (376)..(376): a, c, t, g, unknown or other
  misc_feature (376)..(376): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccaggcaaagcccccaaactcataatttangacgtcaatgttcgcccctcagggtttctcatcgcttctctggctccaaatctggcaacacgctccctgaccatcnctggctcgagtctgaggacgaggctgtattacttctgttcgctcgttgggcaactctgttcgttttgggtgttcggcggtagggaccaagttcgacccgttcgtaggtcacggccccgaaaggtccctaccggtccccccgttacggtcccacttccgtccggttacccccc

SEQ ID NO: 283488 - DNA, 611 bp, Homo sapiens
  misc_feature: GYAE6OF01CDJ93.47.85.H08.1.454.CMB.1.raw
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (356)..(356): a, c, t, g, unknown or other
  misc_feature (356)..(356): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccagtagtgacgttggctagttctgtattctatctcctgtaccaacacaccagcaaacgccccaaancataattangactnaatgtcgccctcgtagggttctcatcgcttctctggctcaagtctagggaacnccgccacctgaccgtcacgcgagggtcgacggtcgggatggaggtcgttattagtttttgcgtagggttggtagggtagtaacgttaagttttggtctaagttagttggtttgggttcgggtacgggtacgggtaaccgaagcgttacggacccgttcccgtacgggttccgaacggtccccgtaaggcccgttacccggccccccgttcgggtccctaccgtccgtttcccggttcccccgtccccttccccgg

SEQ ID NO: 283489 - DNA, 616 bp, Homo sapiens
  misc_feature: GYAE6OF01ESA83.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctgtaccaacaacacccaggcaaacgcccccaaactcataatttatgacgtacaatgttccgccctcgtagggtttcctctactcgcttctctgactcaaatctgcaaccgcgcctcctcgaccatctctcggctcgagtctagacggacgaggctagtatttacgtttcgtgtttcgtcgttcgttacgggtacctaaccgttacgttgggttcggttttggggttcggttacgggacgggtacgggtaccgtaagggtttccgacccggtttaccgtacggtacgtacggccccgtaaacggtccgtccccggtcccccgttacggtaccctaccgttccctccggtttacccccccg

SEQ ID NO: 283490 - DNA, 704 bp, Homo sapiens
  misc_feature: GYAE6OF01CZXRW.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcactcgagggcacgagggtcctcgggcccagtcctcgccccgactcacgcctgcctcgtgtctcgggtcctccgtggacagtcgactccacctatccttcctgaccacgtcggaaacctaggtaggtcggacggttggctagttctagtattctactcttcctacggtaaccaaaccaaccacccgacggaccaaaacgaccccctaaactctaattaatttatacgtaacgtactaattccgttccgtcccgtacgttacgggtttcctactacgtcgtctttccgtcgtcggacttaccgtaaactcttacggaccaccgtaccgccccttccgtacgtacctacttccgtcgtcgggtacctcggtacgtcggttaggaaccgggtaggacggtaccgttagttaactttccgtttcgttacggtttcgtcgttacggtttcgggtaacccttaacgttcgtttcgggttcggtttacggggtcgttcggggacgtacgggtactaacggtcgtaccgtcgtacggtcacggtaccgacgtcctcccgtcccgtcggtactccgtcgtcccgtcccg

SEQ ID NO: 283491 - DNA, 710 bp, Homo sapiens
  misc_feature: GYAE6OF01CWZGQ.47.85.H08.1.454.CMB.1.raw
  modified_base (327)..(327): a, c, t, g, unknown or other
  misc_feature (327)..(327): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagagctcacgtacacgaccggtgctcgatttagtatcactcagtcggcggggggggtctcaggaggcagcgctctcaggacatctccaccatggcctggctctgctgctcctcaccctcctcactcagggcactgggtcctgggcccagtctcgccccgactcacgcctcgcctccgtgtcgtgggtcctccgtggtacacggtcgaactccacctatcctcctgccacgtcggaaaccagtagtcgacggttggctagttctgtacttctatctcctggtaaccaactaacacctaggcaaacgccccaaactcaataacttancgaactctaatcgttaccgccccttcgtacggggttctcgtatccgtctttctcgtcgtacctactaactcgacgtaccacgtaccggtaccctcctcgtaaccacgtccttacggtcggtactcgcgttacgtcggtaaggtacggacgtcgtaacggttactttaccgtnttacggtttcnccgtttcggttacgggtacctaaacgtttcggttacgggtttccgggttttggggttcggttaaccggggtcggtaacgggaaccttacgggttacggtacccggttaccggttacggttcggaacccggtaccgaccgggtacccttaccccggtacccgttacggtacccctcgttcccggttcccgttacccccccg

SEQ ID NO: 283492 - DNA, 693 bp, Homo sapiens
  misc_feature: GYAE6OF01CMII2.47.85.H08.1.454.CMB.1.raw
  modified_base (139)..(139): a, c, t, g, unknown or other
  misc_feature (139)..(139): n is a, c, g, or t
  modified_base (201)..(201): a, c, t, g, unknown or other
  misc_feature (201)..(201): n is a, c, g, or t
tcagagctcacgtacacgaccggtgctcgatttagtatcactcagtcggcgggggggggtctcaggaggcagcgctctcaggacatctccaccatggcctgggctctgctgctcctcaccctcctcactcagggcacgngggtcctgggcccagtctcgccccgactcagcctgcctccgtgtctgggtcctccgtggacngtcatcacatcctctgcacgtggaaccaggtagtgacgttggctagttctgtattctatctccgtacggtaaccaacacacccaggaccaacgacccccaaactactaattaactttagtcgtaaccgtactaacgttccgttcccgccccgttacggttacgggtttacctactacgtccgttccgttcctccgttcggtaccttaccaaacttcgtacggaccaaaccgtccggtaccctccctacgacctacttcgtacgtcggtcctgtacgtcgtagggaacgtacggagtcgtagtaactttcgttcgttggtttctccgttacggttcggtaacctaacgttcggtttagggtttccgggttggggtttccggtcggggtacgggtaacggtaaccgttaggtaccggttaccggtcgtaacggtccgacgacccggtagtccgtacccggtcccgtacgtacctccgttcgtcccgttcccccg

SEQ ID NO: 283493 - DNA, 613 bp, Homo sapiens
  misc_feature: GYAE6OF01EF9ZV.47.85.H08.1.454.CMB.1.raw
  modified_base (435)..(435): a, c, t, g, unknown or other
  misc_feature (435)..(435): n is a, c, g, or t
  modified_base (464)..(464): a, c, t, g, unknown or other
  misc_feature (464)..(464): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggccccagtcctcgcccccgatcagcctgcctccgtgtctgggtctccgtggacagtcgatccaccatcctcctgcacgtggaaccagtagtgacggttggctagttctgtattctatcctcctggtaaccaacaacaccaggacaaacgacccccaaactcaattaatttatgacgtacaatcgttccgcccctcgtacgggtttctctatcgtcttctcgtgctacctaatctacgacaaccgaccggtccctaccctcgacctactcctcgtcggtctcgagttcnggacggacgagcgtagtactttaccgttnttgttcgtcgttcgttacggtactaaccgttacgttggtttcggtttgggtcggttcgggcgggacggtaccgtaggtcgtaccgtccgtaggtcacggaccgacggtcctcccggtccccgttcgacctctccgttccgttccccccg

SEQ ID NO: 283494 - DNA, 739 bp, Homo sapiens
  misc_feature: GYAE6OF01EEFNG.47.85.H08.1.454.CMB.1.raw
  modified_base (320)..(320): a, c, t, g, unknown or other
  misc_feature (320)..(320): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgtattctatctcctggtaccaacaacacccagacaaacgcccccaaactcataatttatgacgtcaatcgttccnccccttcgtacggggttttctctactccgtccttctcgtggccttaccaaactcgtcggactaaaccgacccgggtcccctaccccgtacgaccctacttccgtccgttcggggtcctcggtacggttccgttacggaacgggtaccggtaacgggtccttaggtaacttttaccgtttcgttgtttcgttccgtttccgttcggggaccttaaaccgttaccgtttcgggtttaccgggtttttgggggttcggtttcgggggtaccgggtaacggggtaacccgttaaacgggtttccggtaaccccggttcccgttaacgggttccgaaccggtaccccggtaacgggtcccgttcccggtcccccccggttacgggtacccctaaccgttccccgttccggtttaccccccccgg

SEQ ID NO: 283495 - DNA, 653 bp, Homo sapiens
  misc_feature: GYAE6OF01AVJX2.47.85.H08.1.454.CMB.1.raw
  modified_base (260)..(260): a, c, t, g, unknown or other
  misc_feature (260)..(260): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagcttgggttttcctcgttgcttcttttaagaggtgtccagtgtcaggtgcgccgtggtggaggtcggggggagcgtggtccagccgtgggacctccctgagactctcctgtgcagcctntggcttcaccttanaattaattngtctatgctaggtcgggtccnccgaggcctccgaggcgaaggggtctaggaggtgggtggcggtcagtactcggaccagtggactatccttagagttactacgacacgtacctcccgtggacgggcctatccactatccgacaagacgaactaacttacccgaagtaaccgtacggttacctacgtccgtcgacctaccgtacgaacccacgtacccgtaggaacgtaacctaccgggaaccgtaaccgtaccggttaccttaccgttaccgttaaccgttaccgttacgggttacggaaccggtaaggtaacggttaacggttaacgaacgggttacgttaacgttaaggtttggtaacgggttaccgg

SEQ ID NO: 283496 - DNA, 768 bp, Homo sapiens
  misc_feature: GYAE6OF01A2EHF.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtctccgtggacagtcgatcaccatcctcctgccacgtaggaaccagtagtgacgttggctagttctgtattctactctcctaggtaaccaacaaccaccgacgaccaaaccgaccccctaaactactaattaactttatacgtacgtactaagttcgttcccgccccgtacgttacgggtttcctctactcgtcttctcgtcggccttacaaactcgtacggacaaccgccggtacccgtacccgtacgtaacctacttccgtcgtcgggtcctaccggtagttcgtacggtacggaacggtacgtcgttacgttactttacgtttcgttacggttcgtccgtttcggttacgggtaccttaaaccgttacggtttcgggtttccgggttttggggtttccggttaccggggtaccgggtaacgggtaaccgttaacgggttccggttaaaccccggttccggtaaccggttacccggaacccggttaccccggtaaaccggggttccccttaccccgggttacccccgggttacccggttacccgtaccccgtttcccggtttcccccggttacccccccgg

SEQ ID NO: 283497 - DNA, 548 bp, Homo sapiens
  misc_feature: GYAE6OF01DIQ3Q.47.85.H08.1.454.CMB.1.raw
  modified_base (291)..(292): a, c, t, g, unknown or other
  misc_feature (291)..(292): n is a, c, g, or t
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (383)..(383): a, c, t, g, unknown or other
  misc_feature (383)..(383): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcacatctcctgcactggaaccagtatgacgttggctagttctgattctatctctgtaccaacacaccagcaacgcccaaactcatattannacgtnaatgtcnccctagtaggttcncatcgcttctctgctcaatctgcacacgcctcctgacctntctcncggtctcgagtctgagacgngctgtacttacttcttgttcgcttcgttcgggtactaacgttacgttgttcggtttgggtcggttcggcgggtacggtaccgtaagtcggtaccgttaccggtagtctacggacccgaacggtcgtcccgtccccgtacggtcctacccgttcgtcgttcccccg

SEQ ID NO: 283498 - DNA, 595 bp, Homo sapiens
  misc_feature: GYAE6OF01CF3UK.47.85.H08.1.454.CMB.1.raw
  modified_base (574)..(574): a, c, t, g, unknown or other
  misc_feature (574)..(574): n is a, c, g, or t
  modified_base (577)..(579): a, c, t, g, unknown or other
  misc_feature (577)..(579): n is a, c, g, or t
  modified_base (582)..(595): a, c, t, g, unknown or other
  misc_feature (582)..(595): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgacgtcaatgttccgcccctcgtaggggtttcctcatcgtcttctctggcctaccaaatcgtggacaacgaccggccctcctcgacctatccgtcgtgggtcctcggtacgttcgtaggacggacggacggtcttgttaactttctttcgttgttcgtcgttcggttcgacttaacgttcgttggtttcggtttgggtcggttcgggacgggtacggtacgtaggttccgaccgttcggtacgtcgacgacccggacgtcgtcccgcccgtcggtctaccgttccttcccgtccctacccttccgtacgtcgtcgacgtctacgtcggcgggtcggcgtcggacgcggacgcgtaagngcnnncgnnnnnnnnnnnnnn

SEQ ID NO: 283499 - DNA, 562 bp, Homo sapiens
  misc_feature: GYAE6OF01A93F4.47.85.H08.1.454.CMB.1.raw
  modified_base (206)..(206): a, c, t, g, unknown or other
  misc_feature (206)..(206): n is a, c, g, or t
  modified_base (410)..(410): a, c, t, g, unknown or other
  misc_feature (410)..(410): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccntctcctgcactggaaccaggtagtgacgttggctagttctgattctatctcctgtaccaacaacaccaggcaaacgccccaaactcataatttatgacgtacaatcgttccgcccctcgtacgggtttctcactcgtcttctcgtgtcctacaaatctacgacaaccacggccctcccgtacgaccactccgtcgtcggctcgngtcgtggaggacggaggctagtacttcttacgtgttgtctcgttcggctaacttcgttaggttcggtttgggttcggttcggcgggtaggacgtagtcgtaccgtcgtcgtacacgccgacgtctccgtccctcgacctcgtctccgtcccc

SEQ ID NO: 283500 - DNA, 690 bp, Homo sapiens
  misc_feature: GYAE6OF01DBZ4O.47.85.H08.1.454.CMB.1.raw
  modified_base (663)..(663): a, c, t, g, unknown or other
  misc_feature (663)..(663): n is a, c, g, or t
  modified_base (678)..(678): a, c, t, g, unknown or other
  misc_feature (678)..(678): n is a, c, g, or t
  modified_base (681)..(681): a, c, t, g, unknown or other
  misc_feature (681)..(681): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
tcagagctcacgtacacgaccggtgctcgatttagtatcactcagtcggcagggtcctgggccagtctgcccgactcagcctgcctccgtgtctgggtctcctggactagtccgatcaccatctcctgcactggaaccaggtacgtgacgttggcagttctgattcgtatcgtccctggtaccaacgaacaccgacggaccaaaacgccccaaactctaactaatttatgacgtctaatcgttcgcccctcgagggtttcctctactcgtcttcgtcgtcggcctaccaaaacgtcgtaggtccaacgacggtcctcctgaccatctcgtggctcgatctagacggacgagctagacttactcgtgttcgcgttcgttcgggacctaaacgtacgttgtttacggtttggggtcgtttacggggcgggttacgggaaccgttaaggtttcggaacccggttccgtaagggttcccaacggtacccccggtaaagggtcccgttacccgtcccccgtttagggtaccaccgtttcgtaaccgttaccccctaccccttcccttaccgttacgttacggaccgttccggttccgtacgggtaacggtccggggtcgtacgggaccgtaacgggtccgtacctaacgttcggactcgtacgcgtcncgtcgctcccgcgcncgngcngngtcg

SEQ ID NO: 283501 - DNA, 576 bp, Homo sapiens
  misc_feature: GYAE6OF01CJN27.47.85.H08.1.454.CMB.1.raw
  modified_base (310)..(310): a, c, t, g, unknown or other
  misc_feature (310)..(310): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctgggtggaggtcggggggagcgtggtccagcctgggactccctggagactctcctgtgcacgcctctggcttcacctttcaaattaattatgctatgcgtaggtggtcccnccgaggcctccgagggcgaaggggctaggaggtgggtcggcggtcatacgtcgtaccaggtggacatcttcagtacttacgcacgtactcccgtggacggggccattccacctatcctacaagagaactaactccaagaacacggtctaatcctcgccaccgtacgaccctacgaccctagaaccgaacgtcgaacccacgtaaccgttcctacttcctactacgtcggtagacgaaggtacgtagttagaacgtagttccgtagg

SEQ ID NO: 283502 - DNA, 700 bp, Homo sapiens
  misc_feature: GYAE6OF01BWZJ2.47.85.H08.1.454.CMB.1.raw
  modified_base (319)..(319): a, c, t, g, unknown or other
  misc_feature (319)..(319): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagtaggtgtccagtgtcaggtgcgccgtggtggaggtcggggggaggcgtggtccagccgtgggaccgtccctgacgacctctccgtgtcgcagcctctcggccttcaccttacaataattatgctagtgcgacggtgggtccgccgnggccgtccgaggacggaaggggctaggtaggttggggtcggtcggtcgaagttacgtccggtaccgaggtcggactacgttccttacgaacgttacgttaccggacgtaacggtacctcccgttacgggaacggggtcccgtaactttacccgaaccgtacttaccctacccgaaagtaaccggtaaaccctaaccgtttacccctaacgaaccgtaccggttactaagtccgtacgccgtaaccgtccgaaccgacggtaccgtaacggactaaccggtacgaacccgaccgtaccgttacctccgttaaccgttaccgtacgtaggttcgaccggtagtacggtaggttaccgacggtagtcttaggttcgggtaacgg

SEQ ID NO: 283503 - DNA, 681 bp, Homo sapiens
  misc_feature: GYAE6OF01A6I4H.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgtcttcttttaagaggtgtccagtgtcaggtgcgcctggtggaggtcgggggagcgtggtccagccgtgggacgtccctgacgctctcctgtgcacgtcctcgtggtaccttccaccctttacaaataatttatgtctagtgacgtaggttcgggtcccgccgaggcctaccgagggacgaaggggtctagggaggtgggtacggtcggtactaagtacgtccggtcgagtcggtaactacgttctacgtaagttacttaccggcgtaacgacccgttcccgttagggaccggggtcccttaacttcccgaaccgtacttacccgtaccaacggtaaccggtaacctaaacccgtttacccgaaaccgtaaaccgtaccggttaaccgttactacccgtacgaccctaaccgtcgaccgtacgcctacgaacgtaaccgtacgaaccgacgttaccgtccgtacctaccgttacctacgttcgcgtacgagtagtacggttagacgtagtcgtagg

SEQ ID NO: 283504 - DNA, 611 bp, Homo sapiens
  misc_feature: GYAE6OF01BYBWM.47.85.H08.1.454.CMB.1.raw
  modified_base (589)..(589): a, c, t, g, unknown or other
  misc_feature (589)..(589): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgacgtcaatgttccgcccctcgtacggggtttctcatcgtcttctctggctaccaaatctggcaaccaccgccccctgaccatcctcgtcggctcgagtcgtggacggacgacggctgtactttacttcgttgttcgtcgttcgttcgggactaacgttacgttggtttcggtttgggttcggtcgggcgggtacgggaccgtaaggttcgtacccgtcgtacggtcaacgcccgtaaggtcctaccggcccccgtcggtccctacgttccgttccgtccccctacccttcccgtacgtacggtcgtacgtcctcgtcggacggtccgggtcgtacggaccgaacggtcgacgtagtacggcagcctgtacgncgatcgcgctcncnncngngng

SEQ ID NO: 283505 - DNA, 688 bp, Homo sapiens
  misc_feature: GYAE6OF01DRBZ3.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctcgccccgactcagcctgcctccgtgtctgggtctcctggacagtcgatcacatctcctgcactggaacctagtagtgacgttggctagttctgtacttctactcctccgtacggtaaccaaacaaccacccgaggaccaaaaccgacccccaaaactctaattaatttatacgtacgtactaagttcgttccgtccctcggtacgggtttctactactcgtcttcgtcgtcggtcctacctaaacgtcgtacgaccaaccgtaccgtccctaccctacgacctactccgtcgtcggtctacgtacgtacgtacggaacggacgtacggtacgtacgttactttacgtttcgttagttcgtcgtttcggttacggtacctaaccgtttacgttcggtttcgggttttcgggttcgggttccggggacgggtacgggtaaccgtaacggttaccggtacccggttcgttacggtaccgaccggtacccggaacggtcccgtcccggtcccccgttacggtcctaccgttcccg

SEQ ID NO: 283506 - DNA, 633 bp, Homo sapiens
  misc_feature: GYAE6OF01EVI0X.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcaccgagggtcctgggcccagtctcgccccgactcagcctgcctccgtgtctgggtctccgtggacagtcgatcaccatctcctgcactggaaccagtagtgacgtggctagttctgtattctatctcctgtaaccaacaacaccaggacaaacgccccaaactacattaattatagacgtacaatcgtccgcccttcgtacgggtttctcgtactcgtcttctcgtcggcctactaatcgtacgacaaccgaccggtccctccctacgtacccacgttcctcgttcgggcctacggtattccggtaggaacgggtacgaggtccgtagttacttacttcgtgttcgtcttcggtggtactacgtacgttcgttcggtttgggtcgtcgggtacggacggtacgtacggtttcgacccggttacgaccggttacgacgtccccgtaacgggtcctacccggtccccgttacggtacctaccgttccgtcccgttacccccg

SEQ ID NO: 283507 - DNA, 607 bp, Homo sapiens
  misc_feature: GYAE6OF01APP1I.47.85.H08.1.454.CMB.1.raw
  modified_base (376)..(376): a, c, t, g, unknown or other
  misc_feature (376)..(376): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcttgggttttcctcgttgcttcttttaagaggtgtccagtgtcaggtgcgcctggtggaggtcggggggagcgtggtccagcctgggactcctgagactctcctgtgcagccctctggccttcaccttcaattaattatgctatgcaggtcggtccgcaggctccagggcaaggggctaggaggtggggtggcggtcatacgtcgtcccagtcggactagtccttanaaacttagttaccggctaaggcccttacccgtgggacggggccgtattccaccgtatccgtaccaaggtacgactaacgttcccgaagaaccgaccggtccttactccgtcgcccaaccctcgaaccctacggtccctaggaaccgaacgtcgaaccgtcctaccgtccttacctccttactaccgtggtacgaccggtaagtacggtacgttacgacggtgttccgtagg

SEQ ID NO: 283508 - DNA, 683 bp, Homo sapiens
  misc_feature: GYAE6OF01EECG3.47.85.H08.1.454.CMB.1.raw
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgtattctatctctggtaccaacaacnccagcaaacgccccaactcataatttatgacgtnaatgttccgccctcgtagggtttctcatcgtcttctctggcctacctaaatctcggacaacgtaccggtccctaccctacgaccctacttcgtccgtcgggtccttcggacgttcgtaggaacgggtacgggaggtacgtagttaactttacgtttacgttcgtttacgtccttcggttacgggtcttaaccgttacgtttcgggtttaccgggttttcgggttcgggtttccggggacgggtaacgggtaccgtaacgggttccggtaacccggttaccggtacgggttacgaccggtaccccggtaacggtcccgttaccccggtcccccggttaccggttacccgtaccctttcccgttcccgtttacccccccg

SEQ ID NO: 283509 - DNA, 717 bp, Homo sapiens
  misc_feature: GYAE6OF01C00KF.47.85.H08.1.454.CMB.1.raw
  modified_base (178)..(178): a, c, t, g, unknown or other
  misc_feature (178)..(178): n is a, c, g, or t
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgcttcttttaagnggtgtccagtgtcaggtgcgcctggtggaggtcgggggagcgtggtccagcctgggaccgtccctgagacctctccgtgtgcagccctntcggcttccacctttacaattaattatgctatgctaggtcgggtccncaggctccgaggcaaggggctaggnggtgggtggcggtcagttacgtccgtaccagtcggactatctttacaggtttaataccggctacgtaccctcccgtaggacggggcctaacgtttaccaccctacttccgtaccgaaaggtacgtaacctaaacgtttaccccgaaacgtaaacccgtaccgggtttaactacgttacccgtttacgacccgtaaccccgttaccggaaccccgtacgtaccccgttaggtaaacccggtaaccgttacggaaaccccggtaacccgtaacccgttccgttaacccgttccgtttaaacccttacggttacggttaaccggacggtaaacgggttacggttaaaccgggttggaaaccggttggttaaccgttaaggg

SEQ ID NO: 283510 - DNA, 752 bp, Homo sapiens
  misc_feature: GYAE6OF01C1DF6.47.85.H08.1.454.CMB.1.raw
  modified_base (207)..(207): a, c, t, g, unknown or other
  misc_feature (207)..(207): n is a, c, g, or t
  modified_base (419)..(419): a, c, t, g, unknown or other
  misc_feature (419)..(419): n is a, c, g, or t
tcagagctcacgtacacgaccggtgctcgatttagtatcactcaggtcggggggaggcgtggtccagcctgggacgtccctgagactctcctgtgcagcctctggcttccacctttacaattaattatgctatgcaggtcgggtcccgccgaggctccgaggacgaaggggtctaggaggtgggtggcggtcatatcgtcagtgacntcttcagtattacgcagacctccgtggacgggctattccactagtcctccgaagactaccaacttacccaagaaacgtacgtctactcgtagaccaccgtacgaaccacggtcccctaggaacgtaaccgtgaacccgtacaccgttcctcttactaacgttaccgtggtagcggaagtagtacggttcgaacgtagtacttaagtttcggnggtacgttcgttacggaacccgttccgggtacgggggaccccgtaacgggttaccccgtaggttccgtaacgttcccggttcccgttcccgtaccgtaccgtacccccgtacccgaaaccggtacccgggtcccctaccggttcccggtttcccccgttcccccggtccggtcccgtccccgtcgcccgttacccgaacggaccgtacccgtacccgaccgggtacgccgaaccgaccgacgggtaccccggcccggtacgggcgtcccggtaccgtcggtaaccgtacggtaccttaccgttcgtacggtacacggtcctgggtcggacggg

SEQ ID NO: 283511 - DNA, 649 bp, Homo sapiens
  misc_feature: GYAE6OF01AYRGL.47.85.H08.1.454.CMB.1.raw
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (342)..(342): a, c, t, g, unknown or other
  misc_feature (342)..(342): n is a, c, g, or t
tcagagctcacgtacacgaccggtgctcgatttagtatcactcagtcggcggggggggtctcaggaggcagcgctctcaggacatctccaccatggcctggctctgctgctcctcaccctctcactcagggcacagggtcctgggccccagtcctgccccgactcgagcctcgccctccgtgtcctgggtccaccgtggacagtcgatccaccntcctccgtgcactggaaccngtagtgacgttggctagttctgattctatcctctggtaccaacacaccaggcaaacgccccaaatcataattatgacgtcaatcgttccgcccctcgtagggtttccnctactcgtcttctcgtcgcctaccaaatcgtacggaccaaccgaccggtcccctccctacgaccctactccgtacgtcgggacctcggtacgtcgtacggacgggtacgacggcgttagtactttaccgttcgtgtttcgcgttcgttcgggaacctaacgttacgttcgggttcggtttcgggtgttaccggggaggtacgggaccgttaggtaccggtaccggttccgtacgggtccacggtaccccgaagggtccctacccgggtcccccctacggtacccaccttccgttcccgttacccccc

SEQ ID NO: 283512 - DNA, 544 bp, Homo sapiens
  misc_feature: GYAE6OF01BRQM7.47.85.H08.1.454.CMB.1.raw
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
  modified_base (476)..(476): a, c, t, g, unknown or other
  misc_feature (476)..(476): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggagcgtggtccagcctgggacgtccctgagactctcctgtgcaggcctctggccttcaccttcaataattatgctatgctaggtcgggtccgccaggcctcgaggacgaaggggctaggnggtgggtggcggtnatactcgcagtgactagtctnagtattacgctagacctcccgnggacggggcctattccacctactcctaccaagtacgaactaaccgtcccaagtaaccgacggtctatcctgcctaccgtgaccngcctgaacgacagaccgacacgtctctctactacgtgtacgacgagtagacgttagacgtagtctagg

SEQ ID NO: 283513 - DNA, 687 bp, Homo sapiens
  misc_feature: GYAE6OF01DU5Z3.47.85.H08.1.454.CMB.1.raw
  modified_base (374)..(374): a, c, t, g, unknown or other
  misc_feature (374)..(374): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcgagggcacgagggtcctcgggcccagtcctcgccccgactcacgcctgccctcgtgtcgtcgggtctcgtggactagtcgatccacctattcctcctcgaccaacgtacggaacctagttaacggtcggtacggttggacgttagttccgtaggtactttactctccttccgtaacggtaacccaaaaccaaccaaccccgaacggaaccaaaacccgtaccccaaactctaatttaaacgtttntacggtactactaagttcgtaccgtccccgtaggtacggttcactcgtcgtcttcgtcgtcgtactactaacgttcgacggtacaccgacccgtcctccgacactactctcggtacgtctcggtactcgaggtacggaggtactcgttatacttaccgttcgtgttcgtcgtacgtcgaacttacgtcgttggttcggtggttcgtacgggaccggaggtacgttcggttaccgaaccgttcgtacggtaccgacggtacccggagtcccgcccgtacccgtcggttactccgttcccgtcccgttacccccg

SEQ ID NO: 283514 - DNA, 721 bp, Homo sapiens
  misc_feature: GYAE6OF01E3E2H.47.85.H08.1.454.CMB.1.raw
tcagagctcacgtacacgaccggtgctcgatttagtatcactcagtcgcggggggggtctcaggaggcagcgctctcaggacatctccaccatggcctggctctgctgctcctcaccctcctcactcaggcacgagggtcctcgggcccagtctcgccccgactcagcctcgcctccgtgtcgtgggtctccgtggacaggtcgactcaccactcctcctgcacgtacggaaccaggtagtggacgttggctagttctgtatttctacttctcctacgtaaccaacctaaccaccgacgaccaaaaccgacccctaaactactaacttaaatttactcgaacgtactaacgtcgttcccgtacccgttcgtacgggtttcctcgtacgttccgtacgttctcgtcggtaccttactaaacgttccgtacgacgtaacccgtacccggtacccttcccgtacgtaacctacgtccgttcgtcgggccttacggtacgttacgtaggtacggacggtacggtcgttacgtacttttacgttcgttacgttcgtaccgtttccgttacggtaccttaacgttcgtacgggttttcggtttcggggttcggttaccgggtacgggtaacggtaaccggtaggttcccgggaaccgtcggttacgaccgtacggacccgtacggtccgtcccgtcccgtacgtctcccgttccgtccgttaccccg

SEQ ID NO: 283515 - DNA, 689 bp, Homo sapiens
  misc_feature: GYAE6OF01DPIFQ.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgactcagcctgcctcgtgtcgtgggtctccgtggacagtcgatccaccatcctcctgcacgtacggaacctaggtagtcgacggttggctagttctgattctatctcctggtaccaacaacaccaggacaacgaccccaaactcaattaatttatcgtacgtacaattcgttccgcccctacggtacgggtttctctactcgtcttctctacggtctaccaaattcgtacggacaaccgaccggtcctacccgtcgacctactcgtaccgtcgggaccttcgagtcgttagaacggacggaggcttgtactttacctttcgttacgttgtccttcgttacgggacttaacgttacgttcgggtttacgggtttggggttacggtttcggggacggtaacgggggtacccttaaagggtttcccgtaacccggttccggttaacgggtaccgaacgggtcccccgaagggttcccctcccggttacccccgtcggttacccgtaccttcccggttcccgttccccccgg

SEQ ID NO: 283516 - DNA, 687 bp, Homo sapiens
  misc_feature: GYAE6OF01A7EQZ.47.85.H08.1.454.CMB.1.raw
  modified_base (190)..(190): a, c, t, g, unknown or other
  misc_feature (190)..(190): n is a, c, g, or t
  modified_base (221)..(221): a, c, t, g, unknown or other
  misc_feature (221)..(221): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctcgggcccagtcctcgccccgatcagcctgcctcgtgtctggtctccnggacagtcatcacatctctgacagtcgaacngtacgtgacgtttgactagttctgattctactctccgtgtaccaacaaccaacccgaggaccaaaccgaccccctaaatacctaattaactttactacggtaccgtactaaacgtttcgttacccgtaccccttacggtacggggttttcctacgtacgttccgttcctttcctacgtcggtaccgttacctaaacgttcgttcgggacctaaccgtaccggtcccttacccgtacgtaccctacgttccgtccgtacgggtccgttacggtacgtcgtacggaacggtacgacggtaccttacggtacttactttcgtagttcgtcttacgttggacctaactacgttcgttcgtttgggtcgttacggaggacgtacgtagttccgaaccgttcgtaggtcgacggtaccgtacggaccgttcccgtacccccgttggtacccttactccgttacccgtccccc

SEQ ID NO: 283517 - DNA, 696 bp, Homo sapiens
  misc_feature: GYAE6OF01D03WP.47.85.H08.1.454.CMB.1.raw
tcagagctcacgtacacgaccggtgctcgatttagtatcactcagtcggcgggggggggtctcaggaggcagcgctctcaggacatctccaccatggcctgggctctgctgctcctcaccctcctcactcagggcacgaggggtcctcgggcccagtctcgccccgactcacgcctcgcctcgtgtcgtgggtctccgtggacagtcgactcaccatcctctcgccacgtacggaaccagttacgtcgtacgttggactgttctagtattctatcttccgtacggtaaccaaacaaccaaccgacgaccaaaccgaccccaaactacaattaattactacgacgtactatcgttccgccctcgtcggttctctagtcgtcttctcgtcgctacaatcgacgacaccgacgtcctcctacgacctacgtcctcggttcggccgtacgacgttcgcggaacgggtacggacggttctaggttactttaccgtttacgtttcggttcgttcgttacggttacgggtaaccttaacgttcgtttacgggttttcgggtttggggttacgggttcggggtacggggtaacggtaaccggttacggttaccggtaccgtaccggttacggtaccgaccggtacccggacggtccgtacccggtccccgttacggtccttacccgtccgttcccgttcccccg

SEQ ID NO: 283518 - DNA, 694 bp, Homo sapiens
  misc_feature: GYAE6OF01DT25M.47.85.H08.1.454.CMB.1.raw
tcagagctcacgtacacgaccggtgctcgatttagtatcactcagtcggcggggggggtctcgagggaggcagcgctctcaggacatctccaccatggcctgggctctgctcgcctcctcaccctctcactcagggcacacgggtcctgggcccagtctcgccccgactcacgcctcgcctccgtgtcgtggtctcctggacagtcgatccaccatcctcctgacctacgtacggaacctaggtacgtggtacggttggctagttctgtacttctactcctcctacgtaaccaacaaccaccgagaccaaccgacccctaactactaacttaattacgtcggtaacgtactaacgttccgttacccgtaccccgtacggttacgggtttacctcgtaccttccggttcctttccgtcggttcgtacccgttaaccgtaagttcccggtacggtaacccgaaccggtacccggtccccttacccggtactaacctactccgtacggtcggacgttcgacgttcgtacggacggagacgtctagtactttcgttgttcgttcacgttcgtacgtacctacgttgttacggttcggttgggtcgttcgggacggtacggtacgtaggtccggtacgtcggtacgtcacggtccacgggtcctccccggtccttcgtacctacgtccgtccgtccccg

SEQ ID NO: 283519 - DNA, 663 bp, Homo sapiens
  misc_feature: GYAE6OF01BG240.47.85.H08.1.454.CMB.1.raw
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctcgcccccgactcagcctgcctccgtgtctggtctcctggacagtcgatcaccatcctcctgcactggaaccagtagtgacgttgctagttctgtattctatctcctcgtacaacacaccagacaacgacccaactcataattananactcatcgtccgtccctcgtacggttctctatcgtcttctcgtcgctacaatcgacgtacaacgccggtccctcccgtacgacctactccttccgtcggtacctacgtacgttcgtacggaacggacggtacggtccgttagtactttacctttcgttcggttcgttaccgttcgggttacggtaccttaaccgttacgtttcgggttttacgggtttcgggttcgggttaccgggtaccggggtacggtaaccggttacggttccggtaacccggttacggttacggtaccgtaccggtacccggaacgggttacccgtccccggtcccccgttaccggtcccgttaccgtttccccgg

SEQ ID NO: 283520 - DNA, 703 bp, Homo sapiens
  misc_feature: GYAE6OF01AMYFN.47.85.H08.1.454.CMB.1.raw
  modified_base (233)..(233): a, c, t, g, unknown or other
  misc_feature (233)..(233): n is a, c, g, or t
  modified_base (331)..(331): a, c, t, g, unknown or other
  misc_feature (331)..(331): n is a, c, g, or t
tcagagctcacgtacacgaccggtgctcgatttagtatcactcagtcggcggggggggtctcaggaggcagcgctctcaggacatcctccaccatggcctgggctctgctgctcctcaccctctcactcaggcacgagggtcctgggcccagtctcgccccgatcagcctgcctcgtgtcgtgggtctccgtggacctaggtccatccaccgtatcctcctgcactggaaccngtagtgacgttggctagtttctgtattcgtatcctcctaggtaaccaactaaccacccgaggaccaaaaccgacccccaaagtctaattaagtttagngacgtacaagttcgttccgcccctaggtacgggtttcctctacgtccgtcctttcgtcttcggtacctaaccgtaaagttccgtacggtaccctaaaccgtacccggtcccttaccccgtacgtaaccccgttaacttccgttaccgtacggggtccttaccggtaacggttcgtacggacggtaccggtacggtccgttagttacgttacgttcgttggttcgtacgttcgtaggtaccctaacgttcgttcggttcggtttgggtcggttacgggcggtaacggtacctaggttccgaccgttcgtacggtcacggtccccgaggtccctccgggtccccttcggaccttcctccgtccgttaccccccg

SEQ ID NO: 283521 - DNA, 652 bp, Homo sapiens
  misc_feature: GYAE6OF01CWJP6.47.85.H08.1.454.CMB.1.raw
  modified_base (302)..(302): a, c, t, g, unknown or other
  misc_feature (302)..(302): n is a, c, g, or t
  modified_base (618)..(618): a, c, t, g, unknown or other
  misc_feature (618)..(618): n is a, c, g, or t
  modified_base (624)..(624): a, c, t, g, unknown or other
  misc_feature (624)..(624): n is a, c, g, or t
  modified_base (628)..(628): a, c, t, g, unknown or other
  misc_feature (628)..(628): n is a, c, g, or t
  modified_base (634)..(634): a, c, t, g, unknown or other
  misc_feature (634)..(634): n is a, c, g, or t
  modified_base (637)..(637): a, c, t, g, unknown or other
  misc_feature (637)..(637): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
  modified_base (649)..(649): a, c, t, g, unknown or other
  misc_feature (649)..(649): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgacgtcaatgttaccgcccctcgtacgggtttctcatcgtctctctgctaccaaatctggacaacgaccggcctcctgaccattcncgtggctcgagtctgaggacgagcgtagtactttacttctggttgtcttcgttcggactaaacttcgttcgttcggtttgggtttggtccgggacgggtacgggtaaaccgtaaacggtttcgtacccggttccgttacgggtacgtaccggacccgaacggttcccgtacccggtccccccgttcgtaccgtaacctttcccgttaccggttaccccctaccccgttcccgttacgtacccggttagacccgttccgtacgttacggcgggtccgggtcgtacgggacgtaaccgggccgagtaaccgtaggtcncgtcgngtcntgcgcncgntacncgngcngngcg

SEQ ID NO: 283522 - DNA, 757 bp, Homo sapiens
  misc_feature: GYAE6OF01DDUIX.47.85.H08.1.454.CMB.1.raw
  modified_base (239)..(239): a, c, t, g, unknown or other
  misc_feature (239)..(239): n is a, c, g, or t
  modified_base (428)..(428): a, c, t, g, unknown or other
  misc_feature (428)..(428): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctctcactcgagggcacgagggtcctcgggcccagtctcgccccgatcagcctgcctccgtgtcgtgggtcctccgtggacaggtcgatccaccactcctcctgccacgtacggaaaccnggttaggtacggtacggttggcttacgttcgtgtaattcttaacttccgttcccgttaaccggttaacccaaaccaaacccgaaccccgaacggaaccaaaaccgaccccctaaaactacctaaattaaacgtttactacgtaccgtactaagttcgttcccgtcccgtacgtacggggtttctacgtntaccgtctttcgtctcggtctactaactcgtacggtacaccgaccgtccctaccgtcgacctactcctacggtccggtcgtacgtcgtacgtaggacgggaacggcggtacctgttaacctttcgttcgttggttacgtcgttacggttcgaccgtaacctttaggttacggtttggtttacggggttcggttacggggtcggggtaacgggttaccgtaacgggttccgtaccggttaccggtacggtacgtaccggtacccgtaaccggtccgttacccccgtccccggtacggtacctacccgttccgttccccgtttaccccccg

SEQ ID NO: 283523 - DNA, 714 bp, Homo sapiens
  misc_feature: GYAE6OF01EFOA0.47.85.H08.1.454.CMB.1.raw
  modified_base (132)..(132): a, c, t, g, unknown or other
  misc_feature (132)..(132): n is a, c, g, or t
  modified_base (221)..(221): a, c, t, g, unknown or other
  misc_feature (221)..(221): n is a, c, g, or t
  modified_base (259)..(259): a, c, t, g, unknown or other
  misc_feature (259)..(259): n is a, c, g, or t
tcagagctcacgtacacgaccggtgctcgatttagtatcactcagtcggcggggggggtctcaggaggcagcgctctcaggacatcctccaccatggcctgggctctgcctgctcctcaccctcctcactcngggcacgagggtcctgggcccagtctcgccccgactcacgcctgcctccgtgtcgtggtctccgtggacagtcgatccaccatcctccngcacgtcgaaccagtagtgacggtttggctaggttctntacttctactcctccgtacgtaaccaaccaaccaccgaacgaccaacccgacccctaactctaattaacgttagtacgtacgtacgtacgttcgtcccgtcccgtacggtacggttcctacgtacgttccgtcttcctcgtacgtacctacctaacgtccgtacgtaccgtaacccgtcccgtacccctacccgtaccgtaccgttaccgtccggttccggtaccgggtaccgtacggtaccggttacgtacgggaacgggtacggtacggtacttacgttacgtttaccgttcgttcgttacgtcggttacggtacggtaactacgttcggttcgggtttcggggtttcgggttcggtacgggacgggtaacggtacgtacggtccgtaccggtacgtcggtaccgacggtccgaccgtcccgcccgtcccgtcgtcctccttccgtccctccc

SEQ ID NO: 283524 - DNA, 813 bp, Homo sapiens
  misc_feature: GYAE6OF01CEA4O.47.85.H08.1.454.CMB.1.raw
  modified_base (215)..(215): a, c, t, g, unknown or other
  misc_feature (215)..(215): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcgagggcacgagggtcctgggccctagtcctcgccccgactcagcctgccctcgtgtcgtgggtcctccgtggacagtcgatccacngtcctctgctacgacgaaccagtagtgacgttggctagttctgtacttctatctaccgtgtaccaacacaccaggaccaaaccgcccctaaactctaattaatttactagacgtactaacgttcgtttcccgtaccccgtggttaacgggtttctaccgtactccgttccttctaccgttgccttacgaaacttcgtacgaccaaccgtcccggtaccctaccgtaccgacctacgttccctacggttcgggtaccgtcggttacggtcggtacgggtaacgggtaacggcgggttacttaacggttacgtttaacccgttttggttaacggtttcgttaccggtttacgttcggttaacccgttaacggttaccgtttcgggggtttcgggtttacggggtttccggggttacgggggaccggggttaaacgggtaaaccggttttacgggttccgggtaaacccccggtttcggggtaaccgggttacccgtacccgggtaaaccgggtacccgtaccccgggtttcccccggttaaccccgggtccggtttaaccccttcgggtttcccccgtttccccggtttaaccccccccg

SEQ ID NO: 283525 - DNA, 773 bp, Homo sapiens
  misc_feature: GYAE6OF01DEF4X.47.85.H08.1.454.CMB.1.raw
  modified_base (259)..(259): a, c, t, g, unknown or other
  misc_feature (259)..(259): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctctgcactggaaccagtagtggacgttggctagttcctgattctatctccngtaaccaacaacaccagacaaacgccccaaactcaataactttatgacgtcaatgttaccgcccctcgtacgggttctctactcgtctttcctcgtacggaccttaccgtaaaatccgttaggacccaaccgtaccgggtaccccttccctaccggtaaccctacttacccttccggttcgggtacccgttacggtaacggtttcccgttcggggaaacggggtaaccgggtacggggtacctaggttaaacttttaaccgttttacgtttcggttttcgttcccgttttacggtttcggggtaaccgttaaaccgtttaacggtttcgggtttaccggtttttcgggggttcgggttttcccgggggaccggggtaacggggtaacccggttaaaggtttaccgtacccgggttacccgttaacgggtccgaacggtacccccgaaggggtccctacccggttccccccggttacggtacccgttacccgttcccgttccgttaccccccccg

SEQ ID NO: 283526 - DNA, 734 bp, Homo sapiens
  misc_feature: GYAE6OF01A2E0Y.47.85.H08.1.454.CMB.1.raw
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagcttgggttttcctcgttgcttcgttttaagaggtgtccagtgtcaggtgcgccgtggtggaggtcgggggagcggtggtccagccgtgggaccgtcctgagcctctcctgtcgcngtcctcgtcggtccttcctacctttacaaattaattntcgcttatcggcgtagggtccgggtcccgaccgtacggtcccgtaccggaagggaccgggtaaacgggggccgttaagggtacgggttcgggggtacgggtccggttactaagttacgtccggtaccgtaggtacgacttacttcgtttacaagttacttacggactacgtacccgttcccggtagggaccggggtccctaacgtttacccacctacgtcccgtaccgaagaaccgaaccttaaccgtaccccgaagtaaccgtaccggttacttacgtccgtacgaccctaccgtacaaccgtacgtccgtaacgaacgtaacctacggaaccctaccgtaccgttcccttacctaccttaccgtacgtcggtaccggaacggtacggaacgggttaacgttaacggacggttaacgtgttaggtttgggtactacggg

SEQ ID NO: 283527 - DNA, 749 bp, Homo sapiens
  misc_feature: GYAE6OF01A81SG.47.85.H08.1.454.CMB.1.raw
  modified_base (188)..(188): a, c, t, g, unknown or other
  misc_feature (188)..(188): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtcncctgggacagtcgatccaccatctcctgcactggaaccagtagtcggacgtttggcagttctgtacttctatcctcctacggtaccaacctaacacccaggaccaaacgacccccaaactcctaataactttacgtagtacgtactaagtcgttaccgtcccctcgtacgggttctacactcgcttctcgtcggctacccgtaaatccgtggtaccaacgaccggtcctaccctagaccctatcctcgtcgggtactcggtaacgtcgtacggaacgggccgggtaaggtccgtttacgggtaacctttaaccgtttaccgttgggtttacgtccgttcggttacggggtaaccctaacgtttaccggtttagggtttccggtttacggggttcgggtttaccgggtaccggggaacggggttaccccggtaaggtttacccgggaacccggtttaccggtaaccggggtacgtaccggtacccgtaaacgggtcccgtaccccggtcccccggttaccgggttacccacccggtttccggttacccgtttacccccccgg

SEQ ID NO: 283528 - DNA, 837 bp, Homo sapiens
  misc_feature: GYAE6OF01BF8FV.47.85.H08.1.454.CMB.1.raw
tcagagctcacgtacacgaccggtgctcgatttagtatcactcagtcgcggggagagaggagcccagcactggaagtcgccggtgtttccattcggtgatcagcactgaacacagaggactcaccatggtagtttgggctgagcgttgggttttcctcggttgcttacttttaaggaggtgtccagtgtcaggtgcgccgtgggtggaggtcgggggagtcggtggtccaggccgtgggaccgtcctgacgactcctccgtgtcgcacgccctcgtcggtcctttaccgtaccctttacgaaaattaacgtttactcggtacttaacgtcggaccgtagggttcccggggtacccgaccggtacgggtacctaccggaacgggtaccgggaaggggggtaccttaaggggtagggttcggggtcgggtacccgggtctaaacggttacgtcccgggtaccgaaggttacggtaactacgttaccggttacgaaggtttaaccgttaccgacgtaaccggtacccgttcccgggtacggggtaaccggggaccgttacgttacccgaacctacggttacccctaccggtaaggtaaccgtaaccgttaacccgttaacccgaacggtaaccggttaccgttaacgtacttacccggtacgtaacccgtaacccgtacgaacccgtaacgttcccgaaaggttaaccgtacgttaaccgggaaccgtacccttaccggttacccttacgttaccgtaccgtacggttcggaccggtaacggtaggtaggtaaccgttaggtaacccggttagttacgttaggttacggtcgtaacccgg

SEQ ID NO: 283529 - DNA, 699 bp, Homo sapiens
  misc_feature: GYAE6OF01ALXPW.47.85.H08.1.454.CMB.1.raw
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
tcagagctcacgtacacgaccggtgctcgatttagtatcactcagtcgcgggggggtctcaggaggcagcgctctcaggacatctccaccatggcctgggctctgctgctcctcaccctctcactcgagggcacgagggtcctgggcccagtctgccccgatcagcctgcctcgtgtctagggtcnccgtggacagtcgatcaccngtctccgtgactacgtaggaacctggttacgtcgacgtttggactagttctggattctatctcctaggtaccaactacaccaggcaaacgccccaaatcaatatttacgcgtacgtcaacttcgtaccgtccctcgtaacgggtttctctaacgtccgtctttcgtacgtcggtacctaccgtaaacttccgtaggtaccctaacgccgggttcctcccgtaggtaaccctaacgttccgtaaccgttcgggtccgttacggtacgttcgtacggtacgggtaaccgtacggtcgtaacggtaactttaccgtcgttaagttcgtcgttacgttacggaccttaaccgttacgttacggtttccggtttggtcggttcgggacggtaacgggtctaacgggtttcgaccggttacgtacggtcgtaccggtaccgtaacgggtccttaccggtccccttacgggttccaaccggttctaccggtttacccccg

SEQ ID NO: 283530 - DNA, 717 bp, Homo sapiens
  misc_feature: GYAE6OF01CKG2U.47.85.H08.1.454.CMB.1.raw
  modified_base (295)..(295): a, c, t, g, unknown or other
  misc_feature (295)..(295): n is a, c, g, or t
  modified_base (318)..(318): a, c, t, g, unknown or other
  misc_feature (318)..(318): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcacatggagtttgggctgagctgggttttcctcgttgctcttttaagaggtgtccagtgtcaggtgcgccgtgggtgggaggtcggggggagcggtggtccaggccgtggggacctccgtgacgctctcctgtcgcagcctcgtggtcttcaccttacaaattaattacngtactatggcgtaggtcggtccncgaggcctccgaggcgaagggtctaggaggtcgggtcggcggtacagtacgtcgtccgaggttcggactatcgttacagtaacttacgacgtacgtaccgtccgtagggaccgggtccgtaacttccgaacctactacccgttaccgaaggtaacgtaaccctaacgttaccccgaaaggtaaacccgtaccggtaccttaacgtcccgttacgaccccgtaaccgtcggaaccccgtacggtacccgttacgaaaccggtaacgtaccggtaaccgtaacccgtaccgttaccctaccgttaaccgtaaccgttaccgtgggtaaccggtacgggaaacggttaacgggtaacgtttaccgaaccgggtattaccgttaaggtttcgggtaaaccggg

SEQ ID NO: 283531 - DNA, 602 bp, Homo sapiens
  misc_feature: GYAE6OF01EVVER.47.85.H08.1.454.CMB.1.raw
  modified_base (219)..(219): a, c, t, g, unknown or other
  misc_feature (219)..(219): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (416)..(416): a, c, t, g, unknown or other
  misc_feature (416)..(416): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (595)..(595): a, c, t, g, unknown or other
  misc_feature (595)..(595): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaaactcaataaatttangacgtcaaattcgttccgccccttacgaggggttttccacagtccgctttcgtctggccttaccaaattcgtggaccaaacacggcctccctagacccatcctgtcgggcctacgagtctggaacggacgnggtctgtacttaccgttntgttacgcttcgtggactaacgtacttggtcgtttgggtggttccggnggtaacgggactaaggttcgaccgttaccgtacggtcgtacgcccgaagctccgcccccgtcgtactactcgtccgttcccacctccgtactacgtcgtacgctcgtcgtacggaccggtcgtcgtaccgaacggtccgacgactacggacgntangcgnacgtcagtnacgntcatcncgtgacg

SEQ ID NO: 283532 - DNA, 641 bp, Homo sapiens
  misc_feature: GYAE6OF01BE3FI.47.85.H08.1.454.CMB.1.raw
tcagagctcacgtacacgaccggtgctcgatttagtatcactcagtcgcgggggaaaaggccctgaggaaaacaaaccccagctgggaagcctgagaacacttagccttcatgagtgtccccaccatggcctggatgatgcttctcctcggacttccttggttttgggacaggagtggattctcagactgtggtgacccaggagccatcgttctcagtcgtccgtggagggacagtcacactcacgttgtggtcttgagtctctggctcagtcctccactacactacctcccccagctggtaccagccgacggaccccgggcacgacctccacgccacgctcactcaacaacacacgaccactcgtcttcgttcgtcgggtccctagtactcgtcttctcgttcggttcctacgttccgttacggaacaacgtcctacgaccctacaccgtacggtcccgggacccggggtacccgacggaccaggtactcggaacgttggtagttaggttacgttagtttaagtttacgttggtcgttcgtcgttacgtaaggttggtcggggtacgtagggttcgggttgggtttcggggtcggttccggggagggaccggtacgtaggtccgtacggtccggttacgg

SEQ ID NO: 283533 - DNA, 671 bp, Homo sapiens
  misc_feature: GYAE6OF01A7R7R.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgcccccgatcagcctgcctccgtgtctgggtctcctggacagtcgatcacatctctgcactggaaccagtagtgacgttggctagttctgtattctatctctggtaccaacaacaccagcaaacgccccaactcaattaattactgtacgtctaattcgttccgcccctacgttcggggtttcctctacgtcgtctttcctctcggccttacaaactctaggacaaccaccggccctccctcgaccctactccgttcgtcggtacgtcgtacgtcgtaggaacggtaccgaggtctaggtactttacctttacgttcgtttacgtccgttcggtttacgggacccttaacgttacgttcgggttcgggttttggggttcggttccggggtacgggacgggtaccggtaacgggttaccgtacccggttaccgtacgggtaccgtaccggtacccgtaacggtccgtcccggtcccccgtaccggttaccctaccgttcccgtccggtttccccccg

SEQ ID NO: 283534 - DNA, 657 bp, Homo sapiens
  misc_feature: GYAE6OF01C1X40.47.85.H08.1.454.CMB.1.raw
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (376)..(376): a, c, t, g, unknown or other
  misc_feature (376)..(376): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (472)..(472): a, c, t, g, unknown or other
  misc_feature (472)..(472): n is a, c, g, or t
  modified_base (504)..(504): a, c, t, g, unknown or other
  misc_feature (504)..(504): n is a, c, g, or t
tcagagctcacgtacacgaccggtgctcgatttagtatcactcagtcggcggggggggtctcaggaggcagcgctctcaggacatcctccaccatggcctgggctctgctgctcctcaccctctcactcagggcacgagggtcctgggcccagtcctcgcccccgtatcacgtccctgccctcggtgtcgtgggtctcgtggacagtcgatccactntctccngctacgtagacctagtagtcgtaggtggctagttctgtattctatcctcgtagtaaccaacaccgaccgagaccaaaccgacccctaaactcaattacgttactacggtacctaactaacgttcgtacccgtccccgttacgttacggttccncgtaacgttccgtccgttactcgtcgacctaccgtaaagttcgtcgaactaaccgcccgtccctacctcgaacctntcgtacgngtactgacgtgngtacgacgtgtctgtacttacgtcgtgttcgngttccgtacgtaactacgttaggttccgttaggtcggttgggtacggcggtacggacgttacggtccgtaccggttacgtcggtaaccacggtcctaaccggccgttaaccccgtcccgttcggttaacctccctccgttacccgtcccccgg

SEQ ID NO: 283535 - DNA, 705 bp, Homo sapiens
  misc_feature: GYAE6OF01CCFTY.47.85.H08.1.454.CMB.1.raw
  modified_base (282)..(282): a, c, t, g, unknown or other
  misc_feature (282)..(282): n is a, c, g, or t
tcagagctcacgtacacgaccggtgctcgatttagtatcactcagtcgcgggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcgggggaggcgtggccagccgtgggaccgtccctgagactctcctgtgcagcctgtggcttcaccttcaattaattntgactatgcaggtcgggtccaccgaggcctacgaggcgaagggctaggtaggtgggtgcggtacatacgtcgtaccgaggtcgactattccttacgaagttaacttacgccgtaaggaacccttcccggtagggaacgggggtccgttaacttaccgaacccgtacttccgtacccgaaacggaccgaactaacccttaccccgaagtaaaccgtaccggttaactaacgtccgtacggaccaccggttaccgaccgaacgtcccgtaggaaccgaaacctcgggaacctaacccgtaccgttaccttaccgtacccttaaccgtttaccgttacgggttacggacccgggtaaagggttaaccggtacgggttttaacgggaacccggtttaaacggtcgtttaacggtttgggtaacccgg

SEQ ID NO: 283536 - DNA, 559 bp, Homo sapiens
  misc_feature: GYAE6OF01BJQE5.47.85.H08.1.454.CMB.1.raw
  modified_base (369)..(369): a, c, t, g, unknown or other
  misc_feature (369)..(369): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaacgccccaaactcattaattatgacgtcaatcgttcgcccctcgtacgggttctctatcgcttctctggctcaatctgcaacgcgcctccngaccatctcgtcggctcgacgtcgtgaggacgaggctgtatttcgtctgttcgcttcgttggactaactcgttgttcggtttgggtcgttcggacggtacgggtacctaggttcgacccgttcgtcggtcacggtcccaagggtccctcgtcccccgttacggtaccctacgtccgttccgttccccccg

SEQ ID NO: 283537 - DNA, 520 bp, Homo sapiens
  misc_feature: GYAE6OF01BHI53.47.85.H08.1.454.CMB.1.raw
  modified_base (491)..(491): a, c, t, g, unknown or other
  misc_feature (491)..(491): n is a, c, g, or t
  modified_base (512)..(512): a, c, t, g, unknown or other
  misc_feature (512)..(512): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccgtggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcaggtcgggtccgccaggctccgaggcgaaggggctaggagtgggtggcggtcatatcgtccagtggacatctcagttattacgcacgacctccgtggacgggccgtattccaccatcctacagtagacaacttcccagacacgtctactctcgacactcgaccagcctgacactcgacgacacgtctctctactcgtcgtagngagagtagtacgacgatactntgtgtacg

SEQ ID NO: 283538 - DNA, 618 bp, Homo sapiens
  misc_feature: GYAE6OF01BIPA7.47.85.H08.1.454.CMB.1.raw
  modified_base (233)..(233): a, c, t, g, unknown or other
  misc_feature (233)..(233): n is a, c, g, or t
  modified_base (359)..(359): a, c, t, g, unknown or other
  misc_feature (359)..(359): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacgaggggtccctggggccccaggttcctcgcccccgatcagcctgccctccgtgtccgtgggtcctccgtaggacagttcgatccgacctatcctccngccacgtcggaaccagtagtgacgttggctagttctgagttctatcctcctggtaccaacaaccaccaggccaaacgccccaaactcattaattatgacgtacaatgtccgccctgtgggttctcnctcgcttacgtctggtctacctaaatcgtacgacaccgaccggtcctcccgtcgacctattccgtacgtcgggtcttcgacgttcgaggacggacgaggtcctagtacttcttcgtagttcgcgttccgtggactaaccttcgtcggttcggtttagggtcgtcgggacggtcgggaccacgtcgtacggtacccgttgttacggactcggaccgtagtcccgtacccgcccgttacgtcctacgttccgttacccccg

SEQ ID NO: 283539 - DNA, 781 bp, Homo sapiens
  misc_feature: GYAE6OF01DNN5I.47.85.H08.1.454.CMB.1.raw
tcagagctcacgtacacgaccggtgctcgatttagtatcactcagtcgcggggggggtctcaggaggcagcgctctcaggacatctccaccatggcctggctctgctgctcctcaccctcctcactcgagggcacagggtcctgggccccagtctcgccccgactcagcctgcctccgtgtctgggtctccgtggacagtcgatccacatcctcctgcactggaaccagtagtgacgttggctagttctgtattctactctccgtacggtacccaaaccaaccaccccgaggaccaaaccgacccccaaaactacaattaattttagtacgtacgttacaagttcgttccgtccccttacgtacgggtttctacatccgtctttcgtctcggtaccttaccaaactcgtacgaccaaccgtaccggtccctaccctacgaccctacttccgttaccgtcgggtccgttccggtaacgttccgttaggaacgggtaccggacggtaccgtttagttaaccttttaccgtttccgtttacggttttacggttcctttacgggtttacgggtaaccttaacccgttacggtttcggtttcgggttttacggggttcgggtttaccggggtcggggtaacgggtaacccgttaaggttaccggtacccgtttacccggttacgggttaccccgaccggtaccccggtaacggttaccccggttaccccgttccccccgttaccgggttaccctaacccgttcccgttccccggtttacccccccc

SEQ ID NO: 283540 - DNA, 706 bp, Homo sapiens
  misc_feature: GYAE6OF01CXJM4.47.85.H08.1.454.CMB.1.raw
  modified_base (424)..(424): a, c, t, g, unknown or other
  misc_feature (424)..(424): n is a, c, g, or t
tcagagctcacgtacacgaccggtgctcgatttagtatcactcagtcgcgggggctggggtctcaggaggcagcgctctcaggacatcctccaccatcggccgtgggctctgctgctcctccaccctcctcactcgaggcaacgtcgggtcctcgggcccagtcctaccgcccccgtactccacgtcctcgccctccggtgtcgtcgggtcctccgtggactaggtcaactccaacctacttcctccgtggacctaacgtacggaaaacctggttacggtcggtacggttggactagttctgtactcttactctacgtacgacaacaccacgacgaccaaaccgaccctaaactctaattattacgacgtacgtactaacgtctcccgtacgtacggttcggttactaccgtacgtcgtcttcncgtacgactacgaatcgacaccaacgccgtcctcggacactcgtcgtcgtacggactcggtactcggtacggaacggacggacggttctacgttacgttaaccgtttcgttggttccgtacgttacggtacggtaccgttaaacgttcgggttacggggttttggtcggggttacggtaccggggacgggtacgtaaaccggttgtacccggacgttccggtacgtacgacccggcgtaaccggttcccgcccgggtaccttaccggccgtccgttaccccg

SEQ ID NO: 283541 - DNA, 731 bp, Homo sapiens
  misc_feature: GYAE6OF01AWQA0.47.85.H08.1.454.CMB.1.raw
  modified_base (304)..(304): a, c, t, g, unknown or other
  misc_feature (304)..(304): n is a, c, g, or t
tcagagctcacgtacacgaccggtgctcgatttagtatcactcagtcgcgggggagctctgggagaggagcccagcactggaagtcgccggtgtttccattcggtgatcagcactgaacacagaggactcaccatggagtttgggctgagcgtgggttttcctgttgcttcttttaagaggtgtcagtgtcaggtgcgccgtggtgggaggtcggggggagcggtggtccagcctgggaccgtcctgacgactctcctgtgcacggtcctctcggcttcaccttcaataacttatgctatgacnggtcggtccgcacggctccgaggccgaagggggtctaggaggtcggggtggtacggtactagtacgttcgtccgtaggtggactgttctacgtaagttacttacgctacgtaccgtcccgtaggaacggggtcccgtattaccgactaacgtccgtaccaagggtactaacctaaccgtttaccccgaaacggtaaccgttaccggttaccttaacgtccgtacgtacccgtaacccgttaccggaccctaaaccggtcccttaaccgggaaacgtaacgttaacccggaacccgggttaacctaacccgggttacccttaccccgtttaaccgtttaaccgttacccgggttcgttacgggtaacccgttaagggtaaacgggttaaccgttagggtaaacccggttagtttacccgggttaaagg

SEQ ID NO: 283542 - DNA, 609 bp, Homo sapiens
  misc_feature: GYAE6OF01BCAO1.47.85.H08.1.454.CMB.1.raw
  modified_base (234)..(234): a, c, t, g, unknown or other
  misc_feature (234)..(234): n is a, c, g, or t
  modified_base (574)..(574): a, c, t, g, unknown or other
  misc_feature (574)..(574): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (600)..(601): a, c, t, g, unknown or other
  misc_feature (600)..(601): n is a, c, g, or t
  modified_base (603)..(603): a, c, t, g, unknown or other
  misc_feature (603)..(603): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaaatcataattatgacgtcaatgttcgcccctnagggtttctcatcgcttctctggctcaatctggcaacacggcctccctgaccatctctgggctcgagtctaggaggacgaggtctgattacttctgttcgcgttcgttgggactaacgttacgtggttcggttttgggtggtttcggacgggtagggtaccctaaggttcgacccggttcctagggtccacggtcccgaagggtccctcggtccccccgttcggtacctaccttccgtccgtttacccccgtccccttcctccgttaccggtcgtacgtaccttcgtcgacgggtccggggtccttgggaaccgtaacgggtaccgtacgtaagtaggtnacgtncgtntcagcgactgcgtctcnncncgtcgc

SEQ ID NO: 283543 - DNA, 796 bp, Homo sapiens
  misc_feature: GYAE6OF01CHE0Y.47.85.H08.1.454.CMB.1.raw
  modified_base (329)..(329): a, c, t, g, unknown or other
  misc_feature (329)..(329): n is a, c, g, or t
tcagagctcacgtacacgaccggtgctcgatttagtatcactcagtcgcggggagctctgggagaggagcccagcacgtggaagtcgccggtgtttccattcggtgatcagcactgaacacagaggactcaccagtggagtttggctgagtcgttgggttttcctcgttgtcttacgttttaagaggtgtccagttgtcgaggtcgccgtcgtgggtaggacgggtcgggggagtcgtcggtaccagtcccgtgggaccgttccctggactaccgtcgtccgtgtacgcgtacgtcccgttcgtcggtcctttaccgtaacccgtttanaaaacgtttaacgttttagtacgtaccgtttaagtcggaccgttaacgggttcggggtaccccaccgggtaacggtccctacccgggtaagggacccggtaaagggggttccgtaagggtacggggttcggggtcggtaccggtttactaaacgtttccgggtacccgtacgaacgggttcgtaccttacgttcctttacgaaggtttaccttaaccggaccgtacgtaccccggttaccggtacgggtaccgggtacctacgtttacccacgtacgttacccgacgaacggtacctaaccgtaaccgttaccgaaacgtaccgtaccgttctaacgtctacgtaccgtaccgtacgaccgtacgtcctaggtaaccgtaccgtagaccttaccgacgttcctaccgttaccgttaccgtacggtcgacggaccgtagtacgttacgtacgaacgttgtcgttacgg

SEQ ID NO: 283544 - DNA, 839 bp, Homo sapiens
  misc_feature: GYAE6OF01A0XB8.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcgagggcacgagggtcctgggcccagtcctcgccccgactcagcctcgcctccgtgtcgtgggtcctcgtggacagtcgatccaccatcctctgctacgtacggaacctaggtagtcgtacggttggctagttctgtattctatccgttcctacggtaacctaaaccaaccacccgacggaccaaaaccgacccccctaaactactaatttaactttagtacgtaccgtacaacgtttcgttcccgtccccgtacggttacggggtttacctctacgttccgtactttccgtcgtcgtaccctacctaaacgttcgtacggtaccaacccgtacccggtccctaccccgtaccgaccttacctccgttacggttcggaccgttaccggtacgttacgtacggaacgggtaccggtaggtaccgttagttacgtttaccgtttcgttcgttcggtcccgttacggttcgggtaacccttaaccggtttacggtttcgggtttacgggtttcggggtttaccggggttaccggggtaccgggttaccgggtaaaccgtttacgggttacccggtaacccgtttacccgggtaaccgggttaccggtaacccgtacccgggtaaccggttccccggttaccccccggttaccccggtttccccgggttaacccttaccccggtttcccgggttcccccgtttacccccccccggg

SEQ ID NO: 283545 - DNA, 835 bp, Homo sapiens
  misc_feature: GYAE6OF01CQW2I.47.85.H08.1.454.CMB.1.raw
tcagagctcacgtacacgaccggtgctcgatttagtatcactcagtcgggggggaggcgtggtccagcctgggacgtccctgagactctcctgtgcagcctctggcttcaccttcaataattatgctatgcaggtgggtccgccaggctccgaggcgaaggggctaggaggtgggtggcggtcatatcgtcagtggacatcttcagtatacgcagacctccgtggacggggcctattaccaccgattcctaccgaagacgaactaacttacccaaggaaacgtaccggttacttaacgtcctacgacctacctacggaccaccgccgtaggaaacggaacgtacggaaccgaccaccggttcctccgttaactacctacgtgtcggacgtaaggaagtggttacggaacggtagtactacggttgtacggtacgtccgttaggaacccggttccgggtacggggtacccgtaaacgggtaacccgtggttaccgtaacgttccggtcccttaccgtaccgtaacccgaccccgttaacccgaacccgggtaacccgggtaccccttaccgggttcccccgttcccccgtttacccccggccggtacccccggtccccgttccgtcccgttacccgaaccggtcccggaccccgtaacccggtaccgggaacgaccgtaccggaaccgtacccgggtcccgggtcccggttcgggtccgtacccgggttcccggtaaccggggttaaccggtaaacccggttccccgttttaacccggttacccgttccgggtaaccggtacgtttacccggcggggttacgggtaacccgggggg

SEQ ID NO: 283546 - DNA, 851 bp, Homo sapiens
  misc_feature: GYAE6OF01E1US7.47.85.H08.1.454.CMB.1.raw
  modified_base (249)..(249): a, c, t, g, unknown or other
  misc_feature (249)..(249): n is a, c, g, or t
tcagagctcacgtacacgaccggtgctcgatttagtatcactcagtcggggggaggcgtggtccagcctgggacgtccctgagactctcctgtgcagcctctggcttcaccttcaataattatgctatgcaggtgggtccgcaggctccaggcaaggggctagagtgggtggcggtcatatcgtccagtggactatcttcagttattacgcagacctccctggaggggccgattccaccatctccaganacaacttcccagacacgtctatctcgccacctcgaccacgcctggacgaacgtgaccgactacgtcctactctactagtcgtgacgagacgtagttcgagtcgtactagttgtacggtacgttcgtttacgaccgtttcccgggtaccggggtacccggaaccggggtaaaccccgttcgggttaacctacgtttccccgggttaccttaccccgtccgtaacccggtcccccttaaccccggaacccgggaacccgggtaccccctacggggttttcccccggttttacccccggtttcccccccggttccgggtccccggtccccccgtttaccggtaccccgttacccgggtaacccgggtacccgtaccccccggttaacccgttaccccgggaaccggaacccggtacccgaaccgggtaacccgggccccggggttaccccgggttcccgggtacccggttcccgggtccccgggttacgggttaaccccggttaaaacccggggttaccccttttaaccccggtttaaccccggtttaaccgggtttacgggtaacccgtttaccccggtttcgggtaaccggggtacccggggg

SEQ ID NO: 283547 - DNA, 590 bp, Homo sapiens
  misc_feature: GYAE6OF01BES6P.47.85.H08.1.454.CMB.1.raw
  modified_base (199)..(199): a, c, t, g, unknown or other
  misc_feature (199)..(199): n is a, c, g, or t
  modified_base (344)..(344): a, c, t, g, unknown or other
  misc_feature (344)..(344): n is a, c, g, or t
  modified_base (584)..(584): a, c, t, g, unknown or other
  misc_feature (584)..(584): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcttggggttttcctcgtttgcttcttttaagaggtgtccagtgtcaggtncgctggtggaggtcggggggaggcgtggtccagccgttgggaccgtcccgtgacgtacctctccgtgtgcagccctctggccttcacttcaataattatgctatgcaggtcgggtccgccaggcctccgaggcgaagggctaagnggtgggtggcggtcagtagtcgtccagtgactatcttcagtattacgctagacctccgtggacgggcctagttccacctactccgtaccaacgaacgaccgtaaactaccccgaagtaaccgtaccggtacgttactccgtacgacctacccgtacgtacccgaccgtccgtacgaacgtaacgtacgaccgacctcgtacctctacctactacgtgtccgagtagactaggtcgacgtntcgtag

SEQ ID NO: 283548 - DNA, 825 bp, Homo sapiens
  misc_feature: GYAE6OF01DK35C.47.85.H08.1.454.CMB.1.raw
  modified_base (196)..(196): a, c, t, g, unknown or other
  misc_feature (196)..(196): n is a, c, g, or t
  modified_base (228)..(228): a, c, t, g, unknown or other
  misc_feature (228)..(228): n is a, c, g, or t
tcagagctcacgtacacgaccggtgctcgatttagtatcactcagtcgcggggggggtctcaggaggcagcgctctcaggacatctccaccatggcctgggctctgctgcctcctcaccctcctcactcagggcacagggtcctgggcccagtctcgccccgactcagcctgcctcgtgtctgggtctcgtggacngtcgatcacctatcctcctgcacgtggaaccngtagtcgacgttcggactaggttctagtatttctactccttaccgtacggtaacccaaacaaccaccccgaaggaaccaaaaccgtacccccctaaaatcctaaattaactttacgacgtaaccgtactaaagttcggtttaccccgccccgttacggttacggggttttacctacgtacgttccgttcctttccgttccgttaccgggtaccctttaacccggaaaattccgtaccggaaccctaaaccggaacccggtccccttacccgtacgaacccttacgttcccgtacgtccgggaccgttcgtaacgtcccgttaggaaccgggtacgcggtacgttacggttaactttaccgttcgttaggtttccgcgtttacggttttacgggaacctttaacggttaccggttttggggtttaccggtttttgggggtacgtttaccgggggtacggtaacgggtacccgttaacgggttaccggttacccggttaccggtacgggttaccgaaacccggttccggaaccggttcccgaccccgttccccgttacggttacccttacccggtttccgttccccgtttaccccccgg

SEQ ID NO: 283549 - DNA, 638 bp, Homo sapiens
  misc_feature: GYAE6OF01DRME4.47.85.H08.1.454.CMB.1.raw
  modified_base (179)..(179): a, c, t, g, unknown or other
  misc_feature (179)..(179): n is a, c, g, or t
  modified_base (182)..(182): a, c, t, g, unknown or other
  misc_feature (182)..(182): n is a, c, g, or t
  modified_base (241)..(241): a, c, t, g, unknown or other
  misc_feature (241)..(241): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
tcagagctcacgtacacgaccggtgctcgatttagtatcactcagtcgcgggggtctgggagaggagcccagcactggaagtcgccggtgtttccattcggtgatcagcactgaacacagaggactcaccatgggagtttgggctgagcggtggtttcgcgtaggctctttaagaggtntcngtgcaggtgcgctggtggaggtcggggggagcgtggtccagcctgggacctcctggacnctctctgcgcncgtcctcgtgtcttcaccttanaattattagtgacttgtcgcgaggtcggccgcgaggtccncgaggacggagggctagtggtgggnggcgtnatagtctacgngtcggaactgttccttagagtttactaccgagtaaccgttaccgttcccgggtagggaccgggtaccgtaacttaccgaacctaacttccggaccagggtaactaaacctaccgttaacccgaaaggtaacccttaacggttcctaaggtttcccgacgaaccctcgaaccggtaccagtaccgtacgaacgtaaccgtgacctacgttaccctacttcccgtaatcgttacgtgtaccgaggaaggtacggttgtacgtacgtagttgtaagttgtaacgg

SEQ ID NO: 283550 - DNA, 833 bp, Homo sapiens
  misc_feature: GYAE6OF01EVZGA.47.85.H08.1.454.CMB.1.raw
tcagagctcacgtacacgaccggtgctcgatttagtatcactcagtcgcggggggggtctcaggaggcagcgctctcaggacatcctccaccatggcctgggctctgctgctcctcaccctcctcactcgagggcacgacgggtccgtcgggccccagtcctccgccccgactcacgcctcgtcccgtccgtgtcgttcgggtcctccgtggacagtcgactccaacctattcctccgtcgactaccgtaggaaccgtaggttacgtcggtacggtttcggacttacggtttcttaggtactttcctacttccgttaccgttaacggtaacccaaaaccaaccgaacccgacggaaccaaaaccccgtaccccctaaactacgtaattttaaactttacgtacgtaaccgttactaacgttccgttacccgtcccgttaaggttacggtttccaactcgtccttcgttcgtacgtacgtaccttaactaacgttccgtaccgtactaacccgtacccggtccctacccgtacgtacctacgtccgttcgtacccggtcgtacgtacggtacgagggacgttacggaccgttattacggtttactttacgttcgttcgttccgtccgtttacggtcgtaacctttaacggttccggttttcgggttttacgggtttcggggtttacgtacccggggtaacgggttacccggtaaacgttaccgggtttaccgtaccccgggttacgtacggttaccggacccgtaaccgggacgttcccccgttacccgtcccccgttggttacccttcccgttccggttaccccgttcccccg

SEQ ID NO: 283551 - DNA, 803 bp, Homo sapiens
  misc_feature: GYAE6OF01DE7JO.47.85.H08.1.454.CMB.1.raw
  modified_base (188)..(188): a, c, t, g, unknown or other
  misc_feature (188)..(188): n is a, c, g, or t
tcagagctcacgtacacgaccggtgctcgatttagtatcactcagtcgcggggagctcgtgggagaggacgcccagcactggaagtccggccggttgttccattcggtgatcagcactgaacacgagagactcacagtggtagttggctgagtcgttcgggtttcctcgttagcttacgttttaaagnggttcgtccaggtgtcgaggtcggccgtcgttagggggtgggtacggggtcggggggcgtcggtcggtcccgaggtcccggtagggacccgtcccgtggaacgtcctccgtacgtggcgactaccgtccgttcgtcggttacccttaccgtaacctttaactaaattaaacgtttactacgttaccgttaagtcggtaccgggttagggtcccggggtacccgccgtaacggccgtaccggaacggacggggtaaagggtacggtaaggggtacggtcgggggtacggttacggtacgttaacggtacgttccggtaaccggtaggttacggaacctttacggtcttaacgtagtttaccgtaaccgtacggtaacgtacccggttaccggagggtacccggtacggtaaccttaccgaaccgttaccgtaccgaaccgtaaacgaaccgtaaaccttaaccgttaacccggtaacgtaaccgtaccggttactaactccgtaaccgtaccaccgtacgaccgtaacgcgtaacgaagaccgtaacgacctacgtaccgttactaccgtacttacgatcggaacgagacggaagttacgacgtcggtatgtacgg

SEQ ID NO: 283552 - DNA, 719 bp, Homo sapiens
  misc_feature: GYAE6OF01EDWBJ.47.85.H08.1.454.CMB.1.raw
tcagagctcacgtacacgaccggtgctcgatttagtatcactcagtcgcgggggggggtctcaggaggcagcgctctcaggacatctccaccatggcctgggctctgctgctcctccaccctcctcactcgagggccacgacgggtccgtcgggcccagtcctcggccccgactcacgcctcgccttccgtgtcgtcgggtctccgtggacagtcgactccactactcctcctgcctacgtacggaacctagtacgtcggtacggttggctagttcgtgtacttctacttctaccgtacggtaaccaaacaaccacccgtaacggaccgaaaaccgaaccccctaaactctaaactttaaatttacgtacgtaacgtactaacgttcgttaccgtcccgtacggttacgggtttcctacgtacttccgtcttcgtcgtcgtacctactaactcgtcgacaaccgtaccgtccctccgtacgtacctacttccgtcggtcggtctacgtacgtcgtacggacggacgtacgtcgttagtactttacgttctgttcgttcttgtcggtactacgttcgttggttcggtttagggtcgtacgggtcggtaacgggtacgttacggttccgaccgttcggtaacggtaccgtaacggacccgtacggtcccgttacccggttcccccgtacggtaccctcgtttcccggtcccggttcccccg

SEQ ID NO: 283553 - DNA, 791 bp, Homo sapiens
  misc_feature: GYAE6OF01A1PLY.47.85.H08.1.454.CMB.1.raw
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaagaggtgtccagtgtcaggtgcaggtagtggaggtccgggggagtcttagttcagccgtggggactccctgagactctcctgtgtagtctcgtggaatctagtttcacgttaccttcgtggtatcgctacgtcggggtaccccgaccctaaaacgtccggtaaggggtaacggggtccgttggggttcggttacggggttcctaccgtaacggttacttacgtaacgttccgtaggtacgtcgggactaaggttacgtttaaattaaacgttagtcggtaccggtaccgttccgggtagggacggggtacccgtagttccgacgtcctacttccgtaccgaaggaacgaaccgaaacgggtactaaaggtaacgttaacttacgttacggtaactcggtaaggaaactacgaaactaagtcgttaaggaacggttaccgtacgggtaacgtaaggttaccggtacgttacgttaaccttaagttcgtttacgttttacgggttacggtttttaccgacggtttcccgggttccccggtttccgggggtacccgttaccggggtttacccgtttaccgggggtacgggggaaccccgttaacccggggggtaaccccgttcgggg

SEQ ID NO: 283554 - DNA, 657 bp, Homo sapiens
  misc_feature: GYAE6OF01DCR48.47.85.H08.1.454.CMB.1.raw
  modified_base (226)..(226): a, c, t, g, unknown or other
  misc_feature (226)..(226): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagagctcacgtacacgaccggtgctcgatttagtatcactcagtcggcggggggggtctcaggaggcagcgctctcaggacatctccaccatggcctgggctctgctgctcctcaccctctcactcagggcacagggtcctgggcccagtctgccccgatcagcctgcctcgtgtctgggtctccgtggacagtcgatccacatcctcctgacacgtggaaccngtagtgacgttggactaggttctgtattctatctcctgtaaccaacacaccagacaacncccaaactacataattatcgtacgtactaatcgttaccncccgttagtacgggttactctatccgtcttcgtcgtcggtacctaccgtaaactcgtacggaccaacgtaccggtcccctaccgttaccgacctacgtcctcgtacgggccttacggcgttacgcggtaacgggacgtacgtacgttaggtaactttacgttcgttacgtttcggtacgttcggttacggtaactaaccgttcgttagggttcggtttagggttacgttacgggcggtaacggtaccgtacgtaccgtaccgtacgtacggtcctaaccggtcgaaccggtccacccgtcccgtaccgtcctacctcgttcccgttacccccg

SEQ ID NO: 283555 - DNA, 552 bp, Homo sapiens
  misc_feature: GYAE6OF01CW8N4.47.85.H08.1.454.CMB.1.raw
  modified_base (416)..(416): a, c, t, g, unknown or other
  misc_feature (416)..(416): n is a, c, g, or t
tcagagctcacgtacacgaccggtgctcgatttagtatcactcagtcgcgggggctgggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccaggtagtgacgttggcagttctgattctatctcctggtaccaacaacaccaggcaaacgcccccaaactcataattatagacgtcaatgttccgccctcgtacgggttctctatcgtcttctctgctcaatctcgacaacacggcctcctcgaccatcctcgtcgggctcgtagtcgtaggacggacgnggctgtactttacttcttgttgtcttcggttggactaactcgtgttcggtttcgggtgttcgggacggagggtacctaaggttcgtaccgtcgtggtcagcccgaaggtcctaccgcccctcggtcctcgttcccg

SEQ ID NO: 283556 - DNA, 574 bp, Homo sapiens
  misc_feature: GYAE6OF01D3ZMF.47.85.H08.1.454.CMB.1.raw
  modified_base (175)..(175): a, c, t, g, unknown or other
  misc_feature (175)..(175): n is a, c, g, or t
  modified_base (257)..(257): a, c, t, g, unknown or other
  misc_feature (257)..(257): n is a, c, g, or t
  modified_base (281)..(281): a, c, t, g, unknown or other
  misc_feature (281)..(281): n is a, c, g, or t
  modified_base (339)..(339): a, c, t, g, unknown or other
  misc_feature (339)..(339): n is a, c, g, or t
  modified_base (362)..(362): a, c, t, g, unknown or other
  misc_feature (362)..(362): n is a, c, g, or t
  modified_base (398)..(398): a, c, t, g, unknown or other
  misc_feature (398)..(398): n is a, c, g, or t
  modified_base (407)..(407): a, c, t, g, unknown or other
  misc_feature (407)..(407): n is a, c, g, or t
  modified_base (448)..(448): a, c, t, g, unknown or other
  misc_feature (448)..(448): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagcttgggttttcctcgttgctcttttaagnggtgtccagtgtcaggtgcgctggtggaggtcgggggagcgtgtccagcctgggactcctgacgactctcctgtgcagcctntggccttcaccttcaattaattangctatgctaggtcggtccgcaggcctcgagggcaaggggctaggaggtgggtggcgtnatcgtcgtccaggtgacattctnagtactacgcacgactcccgtggacgggctatcacntctacaganactactcccaagaactacgtctatctgaccacgtacgaccncgaccgtagaacgtactacgaccgtaaccgtccgttaccttacctaccttaaccgtccgttaggtacgacggaaacggtagttacggttaacggaacggtacgttacgtaaggttcggtaaccggg

SEQ ID NO: 283557 - DNA, 639 bp, Homo sapiens
  misc_feature: GYAE6OF01D89IF.47.85.H08.1.454.CMB.1.raw
  modified_base (313)..(313): a, c, t, g, unknown or other
  misc_feature (313)..(313): n is a, c, g, or t
  modified_base (341)..(341): a, c, t, g, unknown or other
  misc_feature (341)..(341): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggcccagtctcgccccgactcagcctgcctcgtgtcgtgggtctcctggacagtcgatcaccatcctctgctacgtaggaccagtagtgacgttggctagttcgtgtattctatctccgttggtaaccaacaacaccaggaccaaacgccccaaatcaattaattangactcaatcgtccgccctggtaggttcncactcgtctctctgcctactaatcgtcgacacgaccgtcctccgtcgacctattccgtgtccggcctcgagttcgtggacggacgtagccgtagtactttacgttactcggttacgtcgttcggttacgggtactaaccgtttcggttcggtttcgggttttcggggttacgttcgggtaccggggtaacgggacccgttaaaggttcccggtaccgttacggtccggttaccgacgaccccggtaaggccccgtacccgtccccgttcgaacgttccttcgtcccggttaccccccg

SEQ ID NO: 283558 - DNA, 854 bp, Homo sapiens
  misc_feature: GYAE6OF01DAY5D.47.85.H08.1.454.CMB.1.raw
  modified_base (215)..(215): a, c, t, g, unknown or other
  misc_feature (215)..(215): n is a, c, g, or t
tcagagctcacgtacacgaccggtgctcgatttagtatcactcagtcggcggggggggtctcaggaggcagcgctctcaggacatctccaccatggcctgggctctgctgctcctccaccctcctcactcgagggccacgacgggtccgtcgggcccaggtcctccggcccccgacttccacgccctgcccgtccgtggtcgtcgggtcctccgnggacaggtccgatcacctactctccgtgccacgtacggaaccgtagtacggtggtacggttcggactacggtttctagtacttcctacgtccttacgtcgtaaccaacgaaccgtaccgaacggaaccaaaccgtaacccccctaaataccgtaactttaacgtttaaccgtacgtaaccggttactaaacgtttccggttcccgtacccccgtacgggttacggggttttacctaccgtacgtccggttacctttcgtcgttaccggtaccgttaaaccttaacggtccgtaacggacccttaaaccggacccgttacccctccgtaccgaacccttacgtccgttcggtacgggtccgtacggtacggttcggtaaccgggtaacgggtccggtaacgtcgttaaggtttaccgtttaccgtttacgtcgttcggttacgttccggtacgggttacctaacggttccggtttgggtttccgggtttagggccggttacggggaccggtaacggggtaaccgttaccggttacggttaacccggtccgttacgggacgtacccgggtcccacgggttcccgtaccccggtcccccgttacgggtaccttcccggtttccggtcccccggtttccccgg

SEQ ID NO: 283559 - DNA, 668 bp, Homo sapiens
  misc_feature: GYAE6OF01AP376.47.85.H08.1.454.CMB.1.raw
  modified_base (177)..(177): a, c, t, g, unknown or other
  misc_feature (177)..(177): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccatggagtttgggctgagcgttgggttttcctcgttgctacgttttaagnggtgtccagtgtcgaggtgcgccgtggtggaggtcggggggagcggtggtccagccgtgggacgtcctgagcctctcctgtcgcacgcctgtcggcttcaccttacaattaattagtctctagtcggacgtagggtcgggtcccgccgacggtcctccggaggcgaaggggtctagggtaggtcgggtggccggtatacgtacgtcgtacgaagtcggtacctattccgtacgtagtacttaccgactacgtacccgtacccggtaggaccggggtcctacttaccgacctacgtccgtaaccgaagaactaaccgtacctaacccgaacgaaacccgtcgtaaccgtacgtcgtacgtacctaccggtaccaccgacgtaccgtaacggtaacaacgtaccgaaccgtaccctaacgttctacccgttataacccgttcgtacggtacgacgagtaacggtagtacggacgtagttcctaggttgtacgg

SEQ ID NO: 283560 - DNA, 702 bp, Homo sapiens
  misc_feature: GYAE6OF01CMNJ8.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctccaccctcctcactcagggcacagggtcctgggcccagtctgcccccgatcagcctgcctccgtgtctgggtctcctggacagtcgatcacatctcctgcatggaacctagtacgtgacgttggctagttctgattctatctccgtggtaaccaacaaccacccaggaccaaacgacccccaaatctaattaaattatacgacgtacaattcgttccgcccctgtacgggtttctcagtcgcttctcgtcgcctacaatcgtcggaccaacgaccggcctccctgacctactctcgtgggctcggtacgtcgtaggaacggacgtacgggtcttaggtactttaaccgtttcgtcgtttcgttaccgttcggttcggggtaaccttaaccgttaccggttggttttccgggttttacggggttcgggttaccgggtaccggggtaacgggggtaaacccttaaggggtttccggtaaccccgtttacgggttaacgggtccaacccgggaaccccggttaacgggtccccgttacccccggtaccccccggtttcccggtaacccgttaccccgttttcccccgg

SEQ ID NO: 283561 - DNA, 836 bp, Homo sapiens
  misc_feature: GYAE6OF01C95PR.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctcacctcctcactcgagggcacgacgggtcctcgggcccagtctcgcccgatcgacgcctcgccttccggtgtcgtcgggtccttccgtaggacgacgtcgactcaccactctcctgctacgtagactaggttacgtcggtacgttcggctagtttcgtacgttacttcgttactcctaccgttacggtaaccaaacaaccaccgacggaaccgaaaccgaacccctaaactactaaactttaattacgtacgtaacgttacaacgtttccggtcccgtcccgttacggttaacgggtttctaccttacgttccgtaccgtttcttacggtcgttacccttaaacgtaacgttccgtacgggtaaaccaaccggtaccggttaccctccgttaacgaacccgttacgtccgtttacggtcgggttaccttaacggcgtttacggaacggcgggtacggtaccgtcgtttacgttaactttccggtttacttcggttacgtaccggttacgttaccggtaacgtttaccgtttcggtttaccgggtttcgggttttacgggtacgggttaccgggtacggggtaaacgggtaccggtttaaacgggtcccgggttaaaccggtttaccgggttaacgggttaccaaaccgggttcccggaaccggttccccggttccccgaaaccccggtttccggttaacccgtttacccgttccccggg

SEQ ID NO: 283562 - DNA, 670 bp, Homo sapiens
  misc_feature: GYAE6OF01BHF2A.47.85.H08.1.454.CMB.1.raw
  modified_base (307)..(307): a, c, t, g, unknown or other
  misc_feature (307)..(307): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgccctcgtgtctgggtcctcctggacagtcgatccacctatctcctgcactggaaccagtagtgacgtttggctagttctgtattctatctcctgtaccaacaacaccagccaaacgccccaactcacttaatttancgtacgtcaatcgttcgccctcgtacgggtttctctacgttcgtctttcctcgtcggtacctaccgtaaacttcgtacggaccgaaccgaccggtaccctacccgtcgaccctacgttcctccgttcgggtaccgtcggtaacgttcgtacggtaacgggaacggtacggtcttaggtaactttaccgtttcgttggtttcgtcgttacgtcgggtactaaccgttacgttcggttacggtttcggggttacgttcgggtacgggtacggtaccgtaggttccgtacggttacggtcgtacgaccgtcccgtaggtcccgttccgtccccgtccggtactaccgttccgttcccggttccccg

SEQ ID NO: 283563 - DNA, 748 bp, Homo sapiens
  misc_feature: GYAE6OF01AP01E.47.85.H08.1.454.CMB.1.raw
tcagagctcacgtacacgaccggtgctcgatttagtatcactcagtcggcgggggggggtctcaggaggcagcgctctcaggacatcctccaccatggcctgggctctgctgctcctcaccctcctcactcgaggcacgagggtcctgggccccagtctcgccccgatcagcctgccctcgtgtcgtgggtcctcgtggacagtcgatccacctatcctcctgcacgtacggaaccaggttagtggtacggttggactacgttctagtactttctacttcctaccgttacggtaaacccaaacaacccgaacccgaaggtaaccccgaaaacccgtaaccccctaaaacgtcctaaagtttaaactttacgtaacgtaaccgtactaacgtcgttaccgaccccgttcggtacggtttcctacaccgttcgttctttccgtacgtacggaccttaaccgaaattcgtacggtaaccaaccgtacccggtccctaccgtacgacctactcgttacgtcggtccgtacgtacggtacgtacggaacggtacggagtacgttagttactttaccgttagttcgtttggtaccttggttacggaactaacgtttcgttcggttacggtttgggtcggtacggtaccgggtaggtaaccgtacgttcgaccggttacgtacggtacacccggaccggaaccgtccgtacccgtcccccgttatacccgttcccgttcgttcccggttcccccg

SEQ ID NO: 283564 - DNA, 805 bp, Homo sapiens
  misc_feature: GYAE6OF01EXX5O.47.85.H08.1.454.CMB.1.raw
  modified_base (199)..(199): a, c, t, g, unknown or other
  misc_feature (199)..(199): n is a, c, g, or t
tcagagctcacgtacacgaccggtgctcgatttagtatcactcagtcgcgggggaggaactgctcagttaggacccagacggaaccatggaagccccagctcagcttctcttcctcctgctactctggctcccagataccatcggagaagttgtgttgacacagtctccagccaccctgtctttgtctccaggggaaancgccaccctctcctgcaggccagtccagaatatcactcctacttagcctgtaccaacagaaacctggtacacggcctacccgaggccttcccgtactaattcctaattcggtaatcggacctaacttccccgaaaacgacggggggtacccctaaggttaccgggaccaaccgtttacccccgaacggtaaaccgtaacggggttttacccgaaaggggtttacggggaaaacggggtttcggggggtttacccgttaggggggaaacctaacgggttaacccgtttaccctaacccgtttaccccgtaccctaaaccccgtaaatacccgtaaacgggccctaaaccggtacccttaaacgggaaccgttacccggttaagggtaaaccggtttaacgtttttacgggtaaacctttttaacgtttaccgttacggttaccgtaacgcgtacggtacggtttacggacgtttacggtcgtacccgtcccgtcttaccgtacggtttccgggcggtaacgggtccggtagggtacggtagtaacgtaacgtaaacggtacgtcggtggtacctggacctaaccgacttacgtcgttctcgtacccg

SEQ ID NO: 283565 - DNA, 587 bp, Homo sapiens
  misc_feature: GYAE6OF01C11RG.47.85.H08.1.454.CMB.1.raw
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(587): a, c, t, g, unknown or other
  misc_feature (574)..(587): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttccgcccctcgaggggtttctcagtcgcttctctggctcaaatctggacaacacggccctcctgaccatctctgggctcgagtctgaggacgaggctagtacttacttcgtgttgcttcgttggactaacgtagtcgttcggttttgggttgtcgggcggagggacctaaggttgacccgtcgtaggttcacggacccgaagggtcctccggaccccccgttcggtacctaccgttccgttccggttcccccggtccccttccgttaccgttaaccggttcgaacgtccgtccgttacggacgggcccggggtactcgggaccgagggtccgactagtacgcgnangnnnnnnnnnnnnnn

SEQ ID NO: 283566 - DNA, 867 bp, Homo sapiens
  misc_feature: GYAE6OF01BICJY.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcacctcctcactcgagggcacgacgggtcctgggccctagtcgtcgccccgactcacgcctgccgtccgtgtcgtcgggtctccgtggacagtcgatccacacttctacctgacctacgtacggaaccgtaggttacggttcggtaccggtttcgggtacctacggttttaccgtaggttaacttttaccgtaactttcccgttaccgttaccgggttaaaacccaaaccgtaaacccaaccccggaacgggtaaccccgtaaaaccccggtaaccccccgtaaaacttaccgttaaacgttttaaacgtttttaacgtacggttaaccgttaacgtaaacgttttccggtttaccccggttccccggtttaacgggttccggggttttacctaccgtacgttccgttccgtttccgttacgttcgggtacccttaacgttaacgttccgggtacgtacccgtaaaccggtcccggtacccttacccgtacggtaacccttacgttacccggttcggttaccggtccgtttacggtacgtacggtaagggacggtaccggacggttacttacgttaaccgtttccgtttcgttacggttcgttcggttcgtacgggtaccttaacgttcgttacgggttcggtttacgggtcggttacgggacgggtacgtacgtacggttcgaccggttgacggtctacggacgtacggtccttccggtccgtcggtacctacgttccgtcccgttaccccg

SEQ ID NO: 283567 - DNA, 732 bp, Homo sapiens
  misc_feature: GYAE6OF01BGB8P.47.85.H08.1.454.CMB.1.raw
  modified_base (307)..(307): a, c, t, g, unknown or other
  misc_feature (307)..(307): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctccgtgtctgggtctcctggacagtcgatcaccatctccgtgcactggaaccagtagtgtacggttgactagttctgtattctatctctaggtaccaacaacaccaggacaaacgccccaaactcattaattancgacgtacaatcgtcctccctacgtacgggttctcacttacgtcttacctctacggtcctacctaaaagttcctaggacctaaaccgaccggtacccctccctacggaaccctacgttccgtcgttcgggaccgtttcgaccggtttcgacggtaaggggaccggtaaacgggtacgttcggttaactttaacccgtttcgttacgggtttacgtcgtttaaccggtcggggtaaccccttaaacgttacccgttgggggtttttccgggttttcggggttacgggtttacgggcggggttaaacgggaaccgttaacgggttaccggtacccgttaccggttaaccggtacaccggcccgtaaacgggcccgtccccgggtacccccgttcggtaaccctccgttaccgtccgttaccccccgg

SEQ ID NO: 283568 - DNA, 690 bp, Homo sapiens
  misc_feature: GYAE6OF01AYGJS.47.85.H08.1.454.CMB.1.raw
  modified_base (213)..(213): a, c, t, g, unknown or other
  misc_feature (213)..(213): n is a, c, g, or t
  modified_base (229)..(229): a, c, t, g, unknown or other
  misc_feature (229)..(229): n is a, c, g, or t
  modified_base (678)..(687): a, c, t, g, unknown or other
  misc_feature (678)..(687): n is a, c, g, or t
  modified_base (689)..(690): a, c, t, g, unknown or other
  misc_feature (689)..(690): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaaacaacaccaggcaaacgccccaaatcataattangacgtacaatgttccnccctgtacgggtttctcatcgcttctctggcttaccaaattctcggaccaacgaccggtccctccctacgacctaacttccttccggtacgggccttacggtacggtccgttagggaacggtaccgggacggtacttagggtaacttttaacttttccgttggttttcgcgtttccggtttacgggaaccttaaacgttaaccgttggtttcggttttggggttacggttaccggggcgggtaacggggtaacctaacggttacggaccccggtttaccgtacgggtaccgtccggacccgtaagggtcccgtaccgtccccccgttacggtacctccgttaccttcccggttcccctaaccctccgttaccgtaccgtcggtacgtccgtcgtacggtaccggcccggtaggtggaaccgacggtccgtacagtagcagtgctgtacnnnnnnnnnngnn

SEQ ID NO: 283569 - DNA, 764 bp, Homo sapiens
  misc_feature: GYAE6OF01C39VW.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctctcactcagggcacagggtcctgggcccagtctcgccccgactcagcctgcctcgtgtctgggtctcctggacagtcatccacatctcctgccactcggaaaccaggttagtacggtacggtttggacttaggttcttgtacttcttaactcttacctacggtaaccaaacaacacccgaaggaccaaaccgacccccaaaactactaaattaactttaagtacgaaccgttctaacttccgtttacccgtacccccgtacgtacggggttttcctactacgtcgtcctttccttcgttacggaccttaccaaaacgttccgtacggtaaccgtaccgtaccggtccccttacccgtaccgtacctacttccgttaccggtcgggtaccttacggtacgttaccggtagggaacgggtaaccggtacggtcgtttaacggtaacttttaccgttcgtttacggtttcgaccgtttcggttacgggaccttaacgttcggttagggttttcgggtttacggggttcggttacgggggtacggtaacgggttaaccttacgggttacgtcccgttacggtacgtaccgaccgtaccgacggtccgtccccgtcccgtacgtcctaccgtcgttcccgttaccccg

SEQ ID NO: 283570 - DNA, 759 bp, Homo sapiens
  misc_feature: GYAE6OF01AJ47A.47.85.H08.1.454.CMB.1.raw
  modified_base (335)..(335): a, c, t, g, unknown or other
  misc_feature (335)..(335): n is a, c, g, or t
tcagagctcacgtacacgaccggtgctcgatttagtatcactcagtcgcggggagagaggacgcccagcactggaagtcgccggtgtttccagttcggtgatcagcactgaacacagagactcaccagtggagtttggctgagtcgttgggttttcctgttgcttcgtttaagcggtcgtctagtcgtcgaggtcgccgtcgtggtggagggtcgggggagtcgtcgtccgaggtccgtggggtacctccgtgacgacctccgtaccgtggtcgcgacgttccgtcgtcggttaccttcctaaccgttaacctaagttaacttagtcgtacgtanggtaccgtcgggtccgggtacccgccggttaaccggtccgtaccggaacggggtacggaaggggtaccgtagggtaacggggtcggggttcggtacccggttacgtaaggttccggtaccggtcggttaacgggtacgtacttaccgtttctaaccgttaagtaacgttccgacgtacgtcccgtaacgtcgggacgggtcacgttaccgactaccgtcgttaccgaacgtacgtaactacccgtacccgaacgtaaccggttactaccgttacggtacctccgtaactaccgtacggacgtacccgcgtaacgtaacgtaccggtacggtaccctacgtaccgttaccaccgttacgtccgtacggtacgtaggaccggaaacgtgtaaaccgtcgaacgttcaaccggtgttacgacgttcg

SEQ ID NO: 283571 - DNA, 734 bp, Homo sapiens
  misc_feature: GYAE6OF01AJ0FK.47.85.H08.1.454.CMB.1.raw
  modified_base (710)..(710): a, c, t, g, unknown or other
  misc_feature (710)..(710): n is a, c, g, or t
tcagagctcacgtacacgaccggtgctcgatttagtatcactcagtcgcggggtctggggagaggagcccagcactggaagtcgccggtgtttccattcggtgatcagcactgaacacagaggactcaccatggagtttgggctgagcttgggttttcctcgttgtcttcttttaagaggtgtccagtgtcaggtgcgccgtggtggagggtcggggggagcgtggtccaggccgtggggaccgtccctggacgaccttcgtccgtggtcgcacgtcccttgtcggtcctttaccaccctttacaaattaatttacgtggtacctaagtcggtcctaacgggttcgggtccccgaccgtaggccttaccggagggaccggaaggggacctagggcggttgggggtcggacggttactaacgtcgtaccggtacctaaggggtcgaacttagttaccgttacgtaaggttaccgttacgggactaacggtaccttaccccggtagggaaccgggggtaccttaaccgttcaaccgtactcccgtaccgaagtaaccgactaaccgttacccgaaggtaaaccgtacggttactacgttccgtacgaccctaaccgtcgaacccgtacggtcctaaggaaccgtactacggacctaccgtaccgtcttccgttactacgttcggtgtacggaacgacgtacgtacggtaacncggtaaggttctaaggttcgtacg

SEQ ID NO: 283572 - DNA, 825 bp, Homo sapiens
  misc_feature: GYAE6OF01BF4PE.47.85.H08.1.454.CMB.1.raw
  modified_base (202)..(202): a, c, t, g, unknown or other
  misc_feature (202)..(202): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcacgcctcgccctccggtgtctgggtcctccgtggacngtcatcacctatcctcctgactactacggaaacctaggttagtcggtacggtttcggactagttcctgtatttaccgtattcctaccgtacggtaaccaaacgaaccaacccgaggtaaccaaacccgaccccctaaactacgtaacttaatttacgtacgtaaccgttactaacgttcgttacccgtaccccgttagggttaccgggtttccttaccgtacgttccgtacctttcgtccgtacggtacctaacctaaacgttcgtaaccggaccgtaaacccgtaccggtcccctcccgtaccgtacctaacgttccgttaccggtcgggtaccgtacgggtacgttaccgtacgggtacggtaacggacggttaccgttagtacgtttaccgtttcgttacggttcgtccgtttacggttacgggtaccttaaacgttcggttccgggtttacgggtttcggggttacggttaccgggggtacgggttaccgggtaacgttaacgggttcccggtacccggttacgtacggttaccggaacccgggttccgacccgggttacccgccccgggttaccccgttacccggtccttacccgttcccggttcccttacccccccg

SEQ ID NO: 283573 - DNA, 812 bp, Homo sapiens
  misc_feature: GYAE6OF01AEV44.47.85.H08.1.454.CMB.1.raw
  modified_base (222)..(222): a, c, t, g, unknown or other
  misc_feature (222)..(222): n is a, c, g, or t
tcagagctcacgtacacgaccggtgctcgatttagtatcactcagtcgcgggggggggtctcaggaggcagcgctctcaggacatctccaccatggcctgggctctgctgctcctccaccctcctcactcgacgggcacgtacgggtccgtcgggccctagtctccgccccgactcacgcctcgcctcgtgtcgtggtctccgtggacagtcactccacctntcctcctcgcctacgtacggaacctaggtacggtggtacggttggactacgtttctagttacttccttacttccttaccgtaacggtaacccaaaccaacccgaacccgtaacggaacccaaaccccgacccccctaaaatccttaaatttaactttacgtacgtaccgttaacgtaacgtttccgttcccgtccccgttacgggttaccggttttcctacgtacgttccgttcctttacggtcgttcgtacccgttaaacctaacgttccgtacggtaacctaacccggtaccccgttccctacccgacgtaacctacgttccgtcggtcggtccgtacgtacgtacggtacggacgggtacgtacggtacttacgttactttaccgtttcgtacggtttcgtacgtttcggtacggtacctttacggttcggtttcggggttcggtttcggggttacgggtccgggacgggttaaccgggtctaacgggtttcccgtaaccggtcggtaacgtccgaaccggtccgtaccggtcccgtccccggttacccgttaccgtaccttcccgtcccgtttccccgggtccccc

SEQ ID NO: 283574 - DNA, 912 bp, Homo sapiens
  misc_feature: GYAE6OF01BTT64.47.85.H08.1.454.CMB.1.raw
tcagagctcacgtacacgaccggtgctcgatttagtatcactcagtcgcggggagctctgggagaggagcccagcacgtggaagtcgccggttgtttccattcggtgatcagcactgaacacagaggactcaccagtggagtttgggctgagcgttgggttttcctcgttgctttacgttttaaggaggttcgtccagtgtcaggtcgccgcgtgggtgggagggtcggggggaggcggttcggtccaggtcccgtggggtacccgtccctgacgtcctctccgtgtcgcacgtccctcgttcgtcctttaccaccttacaaagtttaattacgtgtaccttagtcgaccgtaggtccggggtccccaccgagggtccctaccggagggaccggaaacgggggtctaagggtacggggttcggggtacgggtcccggttaacgtacgtttaccgtcccggggttacccgtaagggtacggtaaaccttacgttttacccgtttcggtaaacggtttaaccgtttaaccggacccgtaaacgggttacccccgtttacccgggtaacggggtaaccgggggacccgtttaacgtttacccccgtaaaccctacccgttacccgtaacccggtaaacggtaaccgtaaacccgttaacccgtttaaccccaaaaccgggttaaaccccgttaacccgggtttacttaaccgttccgttacggtacccgttaacccccggttacggaaacccccgtacggttaacccgtaacggaaaccggtaacccgtaaccggaaccgtaacccgttacccgttacccttaccgtttaacccttaccggttacgttcgggttaccgggaaccggtaacggtaagggttaccgttaacgggtaacggtccgtttaggttacggg

SEQ ID NO: 283575 - DNA, 938 bp, Homo sapiens
  misc_feature: GYAE6OF01C7I8G.47.85.H08.1.454.CMB.1.raw
  modified_base (235)..(235): a, c, t, g, unknown or other
  misc_feature (235)..(235): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcgagggcacgagggtcctgggcccagtctcgccccgatcagcctgcctcgtgtctgggtcctcgtggactgtcgatccaccattctcctagcacgtacggaaccnggtagcgtggttcggactagttcgtgtacttcttacttccttaccgtacggtaacccaaacctaaccaaccccgacggaaccaaaccccgaccccctaaaactacttaacttaactttataccgtaacgttctaacgttccgttaccgtcccccgttacggttacggggttttaccttcgtacgttccgttccgtttaccctcgttaccggtactaacccgttaaaagttccggttaccgtaaccccgtaaaccggtaccccggtccccctttaaccccggttaccgtaacccttaacccggtttcccgtttccggggttaaccgggtttacccgtaacccgggttacgttaccggttaacggggtaaccggggaaccgggttaacgggttccctttaacggtttaacctttaaccgttttttccggttacggttttccggttaaccgttttccgggtttaaccgggtaaccgttaaacccgttttccggggttttacgggttttccggggttttttgggggttacccggggttttccggggggtaaacccggggttaccgggttaaaacccgggtacgggttttacccgggtacccggtttacccggttacggttaaacccggtcccggtaaacccggtaccgggttaccccgttccccggtccccggtttaaccgggtcctttccccggtttacccccggg

SEQ ID NO: 283576 - DNA, 919 bp, Homo sapiens
  misc_feature: GYAE6OF01BWPRL.47.85.H08.1.454.CMB.1.raw
  modified_base (198)..(198): a, c, t, g, unknown or other
  misc_feature (198)..(198): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcaggcacagggtcctgggcccagtctcgcccgactcagcctgcctccgtgtctgggtctccgtggacngtcgatccacatcctcctgacacgtcggaacctaggtagtcgtacgttggacctagttcgtgtattactacttctcctacggtaaccaaactaaccacccgtaggacaaaaccgacccccaaactcgtaactaatttatcgaacgtactaagtcggttaccgtcccgtacgtacgggtttacctcgtacgtccgtcgtttccgtacgtacgggtacctacccgtaaagtccgttacggacccgtaaaccgtacccgggtacccctccccgtacgtaaccccgtacgttacccgtttcccgggtaacggggttccgttacccgggtaacggtttacggtaccggggtaacgggggtaccgggtaacgggtccggttaaaccggtttacggttttaaccccgttttcggttacggtttttccggtaccggtttttaccggggttaccgggttaacccgttaaacccgtttacggttttaaccgggttttcgggggtttttaggggttcccgggttttaccggggggtacccgggggtaaaccgggttaaaccccgggttaaaccgggttacccggttaaaccccgggtttaccccggttaaaccgggggttccccggttaaacccgggaccccggtttaaaaacccggggtccccgtttacccccgtaccccccccgggggtttaaccggttccccgttaaaccccgttttcccccccggggg

SEQ ID NO: 283577 - DNA, 748 bp, Homo sapiens
  misc_feature: GYAE6OF01ALX9H.47.85.H08.1.454.CMB.1.raw
  modified_base (443)..(443): a, c, t, g, unknown or other
  misc_feature (443)..(443): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcacagtggtagtttgggctgagtcgttcgggttttcctcgttgcttcgttttaaggaggttgtccagttggtcgagggtcgccgtccgttggggtgggtacgggtcgggggggtagggtccggttcggtcccgagggtcccgtgggggacccgttccccgtaggaccgtacctccgttccgtggtcgaccgtacgtcccttcggttcggttacccttaccctaccctttaactaaaagttaactttagtcgtctagtcggcgtagggtccggtcccgccgtacggccgtccgaagggcggaaagggtcgtaaggngggttcggggcggcggtacgtaagtccgtcgtccgtaggtcgactacgttcttacgtagtactacgcacggtccctaccggtggaccggtactacgtaccacctactcgaacgtacgaactaccgtaacctaccaaccgtacgtacgttacctagtccgtcgaccctaccgtcgtaccgtaccgtaccgtagaaccgtaccgtacgacccgtaccgttacccgtccctttacccgttaccgtaccttaacccggtgtaccggtacgaaggtacgttaggtaacggaaccggttaagttcgtaacg

SEQ ID NO: 283578 - DNA, 679 bp, Homo sapiens
  misc_feature: GYAE6OF01BBYKB.47.85.H08.1.454.CMB.1.raw
  modified_base (138)..(138): a, c, t, g, unknown or other
  misc_feature (138)..(138): n is a, c, g, or t
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (659)..(659): a, c, t, g, unknown or other
  misc_feature (659)..(659): n is a, c, g, or t
  modified_base (663)..(664): a, c, t, g, unknown or other
  misc_feature (663)..(664): n is a, c, g, or t
  modified_base (666)..(679): a, c, t, g, unknown or other
  misc_feature (666)..(679): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccngtagtgacgttggcagttctgattctatctcctgtaaccaacacacccaggacaaacgccccctaaatcaataagtttactgacgtcaattcgttccgccctgtagggttttcncatcgtcttctctcgactacctaaagtcgtggacaacgaccgtcctcctcgacctntcctgcggtctcgngtcgtaggacggtaacgngtcttagtactttacctttcgtggttacgtcgttcgttacggaacttaaacgttcggtttcgggtttcgggttttcgggttacgggtttcggggaacggggtaacgggtaaccggtttaacggttacccggtacccggttacgttaacgggtacgaacccggtacccggtaacgggtcccgttaccccggtcccccgttaacgggtaccttacccggtttcccgttccccgggttttccccccaaccgtttcccgtttacccgtaggtcgtaccggtccttcggaggaccggttcggactcgggacgtagccgtagtcngtcnngnnnnnnnnnnnnnn

SEQ ID NO: 283579 - DNA, 800 bp, Homo sapiens
  misc_feature: GYAE6OF01A5U5U.47.85.H08.1.454.CMB.1.raw
  modified_base (243)..(243): a, c, t, g, unknown or other
  misc_feature (243)..(243): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgttgggttttccctcgttgcttcttttaagaggtgtccagtgtcaggtgcgctggtggaggtcgggggagcgtggtccagcctgggacgtccngacgactctcctgtgcagcctcgtcgccttctaccttacaaattaagttatgtactagtcgcgtaggtcgggtcccgaccgtaacggccgtacccgaagggacgtaaaggggggtccttaaggggtaggttgggggtacggtccggttactaagttacgtccggtacccgaaggttccgggaactagttccgttacgtaaacggttacttaaccggacctaaggtacccgttacccggttacgggaaccggggtaccccgttaaacgtttaccccaaacccgttaacgttacccgttaacccgtaagggtaaaccgtaaaccccgtaaaccgtttaacccccgaaacggtaaaccccgtaaccggttaaccctttaacctttccggtaccgtacccgtaaacccgtacgtaaaccccgtacggtacccgtaacggtaaccgtaacccggtaacggaacccgaaccgttacccgtacccttaccttacccgtaaccttaccggtgtaccgtacgggtaaagtacggttaagggttacgtacgtaacgttcgttaacgg

SEQ ID NO: 283580 - DNA, 852 bp, Homo sapiens
  misc_feature: GYAE6OF01C3ULX.47.85.H08.1.454.CMB.1.raw
  modified_base (179)..(179): a, c, t, g, unknown or other
  misc_feature (179)..(179): n is a, c, g, or t
  modified_base (200)..(200): a, c, t, g, unknown or other
  misc_feature (200)..(200): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggaattggggctgagcgtgggttttccttgttgcttattttagaggtntcagtgtgagtgcagttggtnacaatcggtgggggagtcgttcgggtccaggtcccggtcggggggtcccctcgacggtacctcctccgtggtcgcctacggcccttcgtggttaacctttccgttacccgtttttaacggtttcccttacgtttacgggtaattaggttaacggtttccgggggtccccgaccgtaaccggtaccgtcccggggaaaggggggtacggggtccggttggggtaacggggttcgggggttacgaacgtaaacgtaaagttaaaccgtccgaaggtacgtaggaaacgtaccgaaaagtaaaccttaggtggtacggtacttcgtacggtaggaaccgggtctacttacccgaacttaccttacctccgaacgtaacgaacccgtaaacccgtaacctaaacggtaccctttacttacgttccgtttacggaaaccgtacgtaaacggtacggtaaccgtaacgtacggtagggaacggtaaccggacgggtaaagtaccggaccgttagttggtttaacgttaccgtttaaggcgtttacggttcgttacccggttcggtaccggttccccggtacccgggttcccggtacccggttaccggtttcccgggttacgttacccggggtccgggtaacccgggttaaccccgggg

SEQ ID NO: 283581 - DNA, 633 bp, Homo sapiens
  misc_feature: GYAE6OF01BULR2.47.85.H08.1.454.CMB.1.raw
  modified_base (323)..(323): a, c, t, g, unknown or other
  misc_feature (323)..(323): n is a, c, g, or t
  modified_base (354)..(354): a, c, t, g, unknown or other
  misc_feature (354)..(354): n is a, c, g, or t
tcagagctcacgtacacgaccggtgctcgatttagtatcactcagtcacgggggctgggggtctcaggaggcagcgctctcaggacatctccaccatggcctgggctctgctgctcctcaccctcctcactcagggcacagggtcctgggcccagtctgccccgactcacgcctgcctccgtgtcgtgggtctccgtggacagtcgatcacctatcctcctgcacgtacggaacctagtagtgacggttggcgtagttctgtattctatctcctggtaaccaacaacacccaggacaaaccgaccccaaactcaattaattanagacgtacattgtcctccctcgtagggttcnactctctctcgtgtcctacaactcgtcgacaacgccgtcctccgtgaccatctcgtgggtctacgcgtctggacggacgcgtacgtcgtaatttctcgttgttgtcgttccgttcgggtacctaacgttaccgttggtttacggtttcggggttccggtacgggtcgggaaccgggtaaacttaacgggttacggtaccccgttaccggtacggtaccggacccgtaccgtacggttcccgtccccggtcccccgtacggtccccgtcgttacccccgg

SEQ ID NO: 283582 - DNA, 680 bp, Homo sapiens
  misc_feature: GYAE6OF01ALY66.47.85.H08.1.454.CMB.1.raw
  modified_base (223)..(223): a, c, t, g, unknown or other
  misc_feature (223)..(223): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacgagggtcctgggcccagtctcgccccgactcacgcctgccctcgtgtctgggtctccgtggacaggtcgatcaccatcctccgtnccactcggaaccagtagtcgtacgttggctagttctgacttctatctccgtgtacctaacaactaccaaggacaaccgaccccaacactactaatttatacgtacgtctaacgttcgttaccgtcccgtcgtacggggttcctctactcgtcttactcgtacgtcctacaacgtctcggtaccaacgaccggtccctaccctacgacctactccgtcgtcggtccttacggtcgttacgtacggtacgaacggtcggtacgttcgtaacttttacgttcgtttacgttcggtcttcggttacggaccttaacgttaccgtttcggttcgggttttacgggtacgggtcccgggtagggtacgggtacccgtaaaggttccggtaaccgttccggtaacggttcgaacgtacccgtaacgggtcctaaccgggtccccgtcgttccgtcgtttccccg

SEQ ID NO: 283583 - DNA, 751 bp, Homo sapiens
  misc_feature: GYAE6OF01DIATE.47.85.H08.1.454.CMB.1.raw
  modified_base (743)..(743): a, c, t, g, unknown or other
  misc_feature (743)..(743): n is a, c, g, or t
tcagagctcacgtacacgaccggtgctcgatttagtatcactcagtcgcggggagctctgggagaggagcccagcactggaagtcgccggtgttccattcggtgatcagcactgaacacagagactcacatggagtttggctgagtcttgggtttcctcgttgacttcttttaagaggtcgtccagtggtacaggtcgcgcgtgggtgggagggtccggggggagtcggtcggtcccgaggccgtcgggtaccgtccctggactccttctccgtgtacgctacgtccgtctcggtcctttacctaaccgtttaacaaatttaacttagtcgtaccttagtcgacggtaggtccgggtccaccgtcggccgtacgaggtaccggaaaggggtactaggggaggtcggggtcggacgtactaaggtaccgttcgtaaccggaggtacgtaactcgttaccgtttacaacggtttagtacccggtactaacggttacccctaccggtacgggtaccgggtacccggtacttacccgaacgtactccgtaaccgaagtaaccgaactaaccgttaacccgaaacggttaaccctacggtactaactccgtaacggtacccaccgtacgaaccgtactaccggtaacgtaacggaccgtaacggacccgtaccgtaccgttacctaccgttaccttacgaacgttcggacgtccggaaaggtacgtaacggtcggtaattaaccggtnttaacggg

SEQ ID NO: 283584 - DNA, 626 bp, Homo sapiens
  misc_feature: GYAE6OF01C9YLJ.47.85.H08.1.454.CMB.1.raw
  modified_base (234)..(234): a, c, t, g, unknown or other
  misc_feature (234)..(234): n is a, c, g, or t
  modified_base (458)..(458): a, c, t, g, unknown or other
  misc_feature (458)..(458): n is a, c, g, or t
  modified_base (494)..(494): a, c, t, g, unknown or other
  misc_feature (494)..(494): n is a, c, g, or t
  modified_base (563)..(563): a, c, t, g, unknown or other
  misc_feature (563)..(563): n is a, c, g, or t
  modified_base (586)..(586): a, c, t, g, unknown or other
  misc_feature (586)..(586): n is a, c, g, or t
tcagagctcacgtacacgaccggtgctcgatttagtatcactcagtcggcggggggggtctcaggaggcagcgctctcaggacatctccaccatggcctgggctctgctgcctcctcaccctctcactcagggcacacgggtcctgggcccagtctcgccccgatcgagcctgcctcgtgtctgggtctcctggacagtcgatccacatccgtacctgaccacgtcggaaaccngtacgtgaccgtttggctaggttctgtatttcctatcttcccgtaggttaacccaactaaccaccccgaaggaccaaaacggcccccaaaacttccaagtttaaactttagacgtacgtactaagttcgttaccgccccttacgacggggtttctacgtacttcgtctttctacgtcggccttaccaaattcgtcgactaccgacgtcccgtacctcgaacctntccgtctacggcgttcgagttccgtgaacggacggngcgtagtacgtttactcgttgttgcttcgtggtaaccacgttacgttgttcggttgggtgttcgcgggngtaccgtagtccgcgtactgtcncgcccgagtctccgccttacgggcaccgttctgtaccccg

SEQ ID NO: 283585 - DNA, 908 bp, Homo sapiens
  misc_feature: GYAE6OF01BJDN6.47.85.H08.1.454.CMB.1.raw
tcagagctcacgtacacgaccggtgctcgatttagtatcactcagtcggcgggggggggtctcaggaggcagcgctctcaggacatctccaccatggcctgggctctgctgcctcctcaccctcctcactcgagggcacgacgggtcctgggcccagtcctcggaccccgactcacgcctgcccttccggtgtcgtgggtctccgtggaccaggtcgataccaaccattcctccgtacgaccgtaacgtacgggaaaccctaggttaggtacggtaccggttacgggtacctaggtttcctaggtaactttaccgttaacttcccgttaaccgttaaccgggttaaaccctaaaaccaaaacccgtaaccccgaaacgggtaacccaaaacccgtaaccccccctaaaactttaaccgtaaactttaaaattttaacggtacggttaaccggtaaccttaaagttccggtttaccccgtaccccgttaacgggttaaccggggttttacctacctaaccgttccggtacctttacgtacgtacggtaaccttaacctaaacgttccgttaacggacccgaaaccgtacccggtacccgtaccccgtacggacccttacgttaccgtacggttaccgggacgttcgtaacggtccgtaaggaacgggacggtacgggtactaggttaactttacgttacgttaggttcgtaccgttacggtacggtaacctaacggttccgtttaggggttccggtttaggggttaccggttacgggacgggtaacgggtaacgttaacgggttccggtaaaccggttcggtaacggtaccgtaacggacccgtaacggtcccgttacccgtaccccgggttacgtactaacccggttccgttacccggttaacccccc

SEQ ID NO: 283586 - DNA, 808 bp, Homo sapiens
  misc_feature: GYAE6OF01DH6IS.47.85.H08.1.454.CMB.1.raw
  modified_base (160)..(160): a, c, t, g, unknown or other
  misc_feature (160)..(160): n is a, c, g, or t
  modified_base (200)..(200): a, c, t, g, unknown or other
  misc_feature (200)..(200): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
tcagagctcacgtacacgaccggtgctcgatttagtatcactcagtcggcgggggggggtctcaggaggcagcgctctcgaggacatctccaccagtggcctgggctctgctgctcctcaccctcctcactcgaggcacgaggtcctgggaccctagtcncgccccgatcacgtcctgcctcgtgtcgtggtacttccgnggacaggtcatacaccgtntccttcnggacacgttaggaacctaggtagtacggtacgtttcggactagtttcgtagtaacttcttaactccgttcgtaacggtaaccaacgaaccacccgacggaacctaaaccgacccctaaacgtacctaagttaactttacgtacgtaaccgtataaacggtccgtccgtacccgttacgggtaccggtttacgtaccgtaacgttccggtaacctttccgtcggttacggtaacccttaaccgtaaaagttcccgtaacggtaacgtaaacccgtaccggttacccctaccgttacggaccttacgtacgtccggtaggacgttaccgtgttcaagggttaacgacggtacggcgttacgttaacttaaccgttcgttacggttaccgttacggttcgttaacgggacctttaaccgtggtttaccccgggttaggtttcgggtcggtttaacgggacgggtaaccggtacgttaagggccccgttaacggtaccgttacggtaccaccgggttaccaaaccgggtcccgttaaccgtcccccggttaacggttacctccgtccggtttccccgttaaccccg

SEQ ID NO: 283587 - DNA, 641 bp, Homo sapiens
  misc_feature: GYAE6OF01BWHT2.47.85.H08.1.454.CMB.1.raw
tcagagctcacgtacacgaccggtgctcgatttagtatcactcagtcgcggggctgggagaggagcccagcactggaagtcgccggtgtttccattcggtgatcagcactgaacacagaggactcaccgtggagttggctgagctgggtttcctcgttgctctttaagaggtgtccagtgtcaggtgcgcgtgggtggaggtcggggggaggcggtggtccagccgtgggacgtccctgagactctccgtgtgcagcctctggcttcactcaataattatgctagtgctaggtcgggtcccgaccgacggcctaccgacggacgaaacgggggctaagggaggttggggtcgggtccggtactaacgttaagttccgtaccgaaggtcgggaacctacgttacttacgaagttaagttaaccggacgtaacgtacctcccgtagggacgggcctagttccaactactctaccgaaggtaacgacgtaacttacccgaagaacctacgggttacctaagtcctacgaccaaccgtcgaacccaggccgtacgaacgaacttcgaacaccgtaaccgtcctactacctacgtacgtggtacgacggtaagagtacgttaggacgtacgacttagtggtgtacg

SEQ ID NO: 283588 - DNA, 735 bp, Homo sapiens
  misc_feature: GYAE6OF01EVL7W.47.85.H08.1.454.CMB.1.raw
tcagagctcacgtacacgaccggtgctcgatttagtatcactcagtcgcgggggggggtctcaggaggcagcgctctcaggacatctccaccatggcctgggctctgctgcctcctcaccctcctcactcgacgggcacgacgggtccgtcgggcccagtcctcgccccgactcacgcctcgcctcgtgtcgtcgggtcctccgtaggacgacgtcgactaccacctacttccttcctcgaccgtaaccgttacggaaacctaggtacggtcggtacggttggactacggttcgtgttacttcttacttcttaccgtacgtaaccaacgaaccaccgaacggtaccaaaacccgtacccctaaactacgtaaactttaactttacgtacgtaaccgttactaaacgttccgttcccgtacccgttacgtttaccgggttctactacgtccgttcttcctcgtcggtacctaactaacttcgacgaccaaccggtccgtacccttaccacgtacctactcgtcgtcggtactcgtacgttacgacggaacggtacggtacgtctacgtactttacgttcgttgtcgtcttggtacgtccgtaacttcggttcggttcgggtttcgggtcggttcggagggtaccggtacgtaaccgggttcaaccggtgtacgaccgtaccgaccggacgtcctacccggtcccgttcggacctaccgttccgtacccgttccccg

SEQ ID NO: 283589 - DNA, 834 bp, Homo sapiens
  misc_feature: GYAE6OF01EYTVD.47.85.H08.1.454.CMB.1.raw
  modified_base (189)..(189): a, c, t, g, unknown or other
  misc_feature (189)..(189): n is a, c, g, or t
tcagagctcacgtacacgaccggtgctcgatttagtatcactcagtcgcggggtctgggagaggagcccccagcccccagaattcccaggagtttccattcggtgatcagcactgaacacagaggactcaccatggtagtttgggctgagcgttgggttttccttgttgtctattaataaaaggtgtcngtgtcaggtgcagcgtggtgggagttcggtgggggtatacgttcgggtacaacggccgtggggtacgggtccctaggacgtaccttctccgtgtcgacctcgccttgtgtacttcctaccttcgacgtagtaccttaactactagtcggacgtcgtacggcctcccggaccggtacgggtcccgtaacccggggaaggggggaaacgggtccggttaggggtaggtagggttaacgtttcgttaacttaacgacgttaacgtaaggtaggttaaggttacggttaactttaccgtaattaactaaccgtaccgtactaacggtcttcggttggtaacgggacgggttaccctacgtcccgtaacccgttcccgaacccggtaacggaaccctaaaccggtaccgtaaaacggtaaccgttacgtaaggtttacgggtctaccgggtagtaacggtaaaccgtacggaaaccgtaacccgtacggttaacgggaacggacccgggaaccgggtaaccgggacggttaccgggttttacccgtttaagtcccggtacgggaccggacgggtaacggtccccgggtacccttcccgtacccgttacccgtaacggttttcccgggtttagggttcccgggtaaccggg

SEQ ID NO: 283590 - DNA, 944 bp, Homo sapiens
  misc_feature: GYAE6OF01B50XT.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgttgggttttcctcgttgcttcgttttaagaggtgtccagtgtcgaggtgcgcgtgggtggagggtcggggggaggtcgtggtccaggcccgtgggaccgttccccgtggacgtacctcctccctggtcgccgacgtccctcgttcgggtcctttacctaaccctttacaaaacttaaactttaagtcgtccttaattcggtaccgtagggttccgggggttccccgtacccggaggggtcccttacccggacggggtaccgggaaacggggggtaccgttaacgggtaagggggttcgggggttcggggtaccgggttaccgtaacggtttaaccgttcccgggttaccccgtaaagggtttaccgggaacccttacggtttaccctttaacggtaacggtttaaacgtttaacccggtacccgtaaccggttaccccgttaccccgtacggggtacccggggtacccgtaaccgtttacccgaaccccttaacgttacccgttaacccgtaaggaaacccgtaaaccgttaacccgttaaccccccgaaacgtaaacccggttaacccggggtttaacctaacggttaccctacggtaccccttaaccccttacccggtaacccgtacccggtacccgtaacgggttaaacccgaacccggttaaaccggaacccgttaacccggtaacccgttacccgtttacccgttaacccgttaaccctttaccgttacgggtaccgtaacggtaacggtaggtaacggttaacgggacgttaacggtacgttaacgg

SEQ ID NO: 283591 - DNA, 756 bp, Homo sapiens
  misc_feature: GYAE6OF01AJIFA.47.85.H08.1.454.CMB.1.raw
  modified_base (695)..(695): a, c, t, g, unknown or other
  misc_feature (695)..(695): n is a, c, g, or t
  modified_base (710)..(710): a, c, t, g, unknown or other
  misc_feature (710)..(710): n is a, c, g, or t
  modified_base (726)..(726): a, c, t, g, unknown or other
  misc_feature (726)..(726): n is a, c, g, or t
tcagagctcacgtacacgaccggtgctcgatttagtatcactcagtcgcgggcgtgggagaggagcccagcactggaagtcgccggtgtttccattcggtgatcagcactgaacacagaggactcaccgtggtagtttgggctgagtcgttgggttttcctacgtttgcgttacgttttaagagtgttcctagtcgtcgaggtcgccgtcgttggtcggtagggtcggggggaggtcggtaggtccaggccgtacgggaccgtccgtaggacgtaccgttccgtccgttggcgacgtacgtccttcgtcggtccttccgtaaccttactaaacttaaagtttcgtagtaccttagtcggacgtacggtttacccgggcccggttaccgcgggtaccttacccggggaacgggtaccgggaaggggtttaccaacggggttagggtacggggtccgggtaaccggttacgtaacggttacggttacctacggtaacggtagtaccacgttctaacgttggtaacttacgacgtaccgtaccacggtacgggtaccggtacgtaacgtccacctacgttacctacgaacgaacgtaaccttaacgtaccaacgtacgtaccgtacgtaactccgtactaccgacctaccgacctacgtacgacgtaacacggtcaaaccgtccgtaactcttaaccnccgttaattaccggngtacgacgtagaacgngttacgagttacgagttctaggtctaacgg

SEQ ID NO: 283592 - DNA, 774 bp, Homo sapiens
  misc_feature: GYAE6OF01DC2E1.47.85.H08.1.454.CMB.1.raw
  modified_base (721)..(721): a, c, t, g, unknown or other
  misc_feature (721)..(721): n is a, c, g, or t
tcagagctcacgtacacgaccggtgctcgatttagtatcactcagtcggcggggggggtctcaggaggcagcgctctcaggacatctccacatggcctgggctctgctgctcctcaccctctcactcagggcaacgacggggtcctcgggcccagtctcggccccgatcagcctcgcctcggtgtcgtgggtctccgtggacaggtcgactccacctatctcctgacctacgtacgggaaacctaggttagtacggtacggtttggacgttaggttctagtactttacttacgtaccttccgttacggtaaacccaaaaaccgaaccgaaccccggaacgggaaccaaaaaccccggtacccctaaaaacgtttactaaaacgtttaaacttttaacggaccgtaaacggttacttaaacgttccggtttaccccggtaccccgtttagggttaccgggtttacctacgttacgtccgtactttcgttacgtacggtacctaacgttaaacgtcctacggtacccaaccggtacccggtaccctttaccgacgaccttctcggttacgtcgggtcttacgcggttacgaggaacgggtacgtagtcgttacgtactttgttcttcggttctacgtttgacggtacttaacgtttggttcggttaggttcggggtggttaccgggagtacggtaacgtgtaccggtaacgtcggtaacggcncgtaaccggcgttccgcccggtccctggtacctcgtccgtttcccgtaccccg

SEQ ID NO: 283593 - DNA, 731 bp, Homo sapiens
  misc_feature: GYAE6OF01AZ5FH.47.85.H08.1.454.CMB.1.raw
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
tcagagctcacgtacacgaccggtgctcgatttagtatcactcagtcgcggggtctgggagaggagcccagcactggaagtcgccggttgtttccattcggtgatcagcactgaacacagaggactcaccagtggagtttggctgagtcgttggttttcctgttgcttcgttttaagaggttgtccgagttcgtcgaggtggccgtccgttggggtacggaggggtcggggggaggtcggtcggtcccacggtccgtacggggtaccgttcccgtaggaacgtccttccgtaccgtggtcgccgtagtccgttntcggtccttaaccttaccttaanaaattaagttacgtgtaactagttggacgtgggtccggtaccgcgacgcctacgagggacgaagggtctaagggtagggtcgggttcggcgttaatacgttacgtccgtcagggtaccgaactacttttcgtacgaagtttaccgtacgctaacgtccccggtaaccgtggggaaccggtcgtacctaccgtaaccgtaacttcccgtaaacccggaagtaacgtaaacgttaaccctacccgtaaacgtaacccggtagttcctacgttaaccgtcaacccgtacaccgaaccacggtacgtacgaacgtacgtacgaccgacttcgtacttaccgacgttaacgtcgtacgaggtaccaaggtacgtacgtacgacgtacgtgttgtggtag

SEQ ID NO: 283594 - DNA, 701 bp, Homo sapiens
  misc_feature: GYAE6OF01AXJK9.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcacgtggaaccaggtagtgacgttggctagttcgtgattctatctcctggtaccaacaacacccaggccaaacgcccccaaactcaattaatttatcgacgtacaattcgttccgtccccgtcgtaacggggtttcctacgtacgtccgtcctttcgtccgttcggtaccttaccgtaaacttcgtggtaacctaacccgaccggtcccctaccctcgaccctattccgttccgtcgggtctacgtacgttcgtacgacgggacgaggtaccgttgtacttacgttcgttgttcgtcgttcgttacgggtactaacgttacgttacgggttcggtttagggttcggttcgggcgggtaacgggtaccgtaacgggtttccggtacccggttccgttacggtacccgaaccggtccccggaacggtcccgttcccgtaccccccggttacggtacccgttacccgttcccgttcccgtttacccccccg

SEQ ID NO: 283595 - DNA, 794 bp, Homo sapiens
  misc_feature: GYAE6OF01DCKRW.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctcgcctcctccacccttccacactcgacggcacgtagggtcctcgggcccagtcctcgaccccgtactccgacgcctcgccttccgtgtcgtcggtctccgtaggactacggtctactccactactcctcctagctacgtacggaacctagtaggtcgtagttacgcgtagttcgtagtacttcttacgttcctaccgttacgaacccaactaacccgaccgaacggtaaccgtaaaccccgaaccccaaagtaccttacgtttaactttagtaccgtacgtactaagttcccgtacccgtacccgtcggttacggtttcacgtacgtctccgttctccgtacgtacctacgtacttacggacgtaccaccgtcccgtaccctccgtacaccttactccgtaccgcggtacttacgacgttacggaccggacggaacgtcgtagttacgttcgtttacgtttcgttgttcccgtactttacgggtcgtaaccttacggtttacgggtttcgggtttacgggtttcggggttggtacccgggtacgggtaaaccggtatttacccgggaccggtttaccccgtacgggtacgtaccccggccggttacccgggtaacccgttcccttaacccccgggtccccgtttacgacccctttccccggttaacgttcccccggtttaaccccc

SEQ ID NO: 283596 - DNA, 689 bp, Homo sapiens
  misc_feature: GYAE6OF01C65QP.47.85.H08.1.454.CMB.1.raw
  modified_base (196)..(196): a, c, t, g, unknown or other
  misc_feature (196)..(196): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (259)..(259): a, c, t, g, unknown or other
  misc_feature (259)..(259): n is a, c, g, or t
tcagagctcacgtacacgaccggtgctcgatttagtatcactcagtcggcggggggggtctcaggaggcagcgctctcaggacatctccaccatggcctgggctctgctcgctcctccaccctcctcactcgagggcacgcgggtcctcggggcccagtcctcgccccgactcacgcctgcctcgtgtcgtggtcnccgtggactagtcactccactntcctcngctacgcggaaccagtcgtcgacgttggctcgttntgtattctactcgtcctacggtaaccaacaacgaccgacggtaccaaaccgaccccaaactactaacttaatttacgacgtacgtactaacgtcgttccgtacccgtacggttacggttctactcgtacgtcttcgtctacgtcctactaactcgtagaccgactaccgccgtcctcgactctcgtacgtcgtcgtcgtacgtcgtacggacggtacggcgtcgtagtactttacgtcgttcgtttacgcgtttacgttacggacttaaccgtttcggtttacgggttggtttacggggttcggttccgggtacggtacgggtaaaccgttacggttccgggttactacggtccggtacgaccggtccggtacggtaccggttcccggtcccgttaccgggtaccttaccgttccgttcccggttacccc

SEQ ID NO: 283597 - DNA, 780 bp, Homo sapiens
  misc_feature: GYAE6OF01CWV69.47.85.H08.1.454.CMB.1.raw
  modified_base (191)..(191): a, c, t, g, unknown or other
  misc_feature (191)..(191): n is a, c, g, or t
  modified_base (319)..(319): a, c, t, g, unknown or other
  misc_feature (319)..(319): n is a, c, g, or t
tcagagctcacgtacacgaccggtgctcgatttagtatcactcagtcggcggggtctgggagaggagcccagcactggaagtccgccggtgtttccattcggtgatcagcactgaacacgagacggactcaccagtgggtaggtttcggctgagtcgttcgggttttcctcgttgtcttacgttttaaggnggttcgtccagtgtcgaggtcgccggtcgtgggtgggagggtcggggggagtccggtgtccgacggtccgtgggacctccgtgacgtcctcgtcgtagcgctcgtcctgtcgtcttaccgtaccttanaatttaatacgtgtactagtcggtacggtcgggtccgggtacccgacgacggtcccgtaacgggacgggaccgggtaaggggtcctaaggggtacggggtcgggtacgggtaccggttactacgtaccggttaccggtacggtaagggtccgtaacttacgttaccttaaggagttaaccgtcgaaccggtaaccgtccgttacccgggtaggggtaccggtaccgttaaccttaccgaacccttcgtaccgaaaccgaacgaaaccgtaaacccgttacccgtaaccgtaaacggtaaccggttacgttaccgttacgtaccgtacccgtaaccacccgttaacgaccgtaccgtaacgtacggtaaacgtccggaaccgacctaaccgtaccgttcctaactacccgtttagaacgtgggtcgaagtagtacgtcgtacgagtattacggtggtgtcgg

SEQ ID NO: 283598 - DNA, 888 bp, Homo sapiens
  misc_feature: GYAE6OF01ARXP7.47.85.H08.1.454.CMB.1.raw
  modified_base (214)..(214): a, c, t, g, unknown or other
  misc_feature (214)..(214): n is a, c, g, or t
  modified_base (237)..(237): a, c, t, g, unknown or other
  misc_feature (237)..(237): n is a, c, g, or t
  modified_base (247)..(247): a, c, t, g, unknown or other
  misc_feature (247)..(247): n is a, c, g, or t
  modified_base (871)..(871): a, c, t, g, unknown or other
  misc_feature (871)..(871): n is a, c, g, or t
tcagagctcacgtacacgaccggtgctcgatttagtatcactcagtcggcggggggggtctcaggaggcagcgctctcaggacatctccaccatggcctgggctctgctcgtctcctccaccctcctcactcggagggacacgtacgggtccgtcgggccctagtcctccgccccgactcacgcctcgtccgtccggttgtccgttcggttccncccgtaggacgtacggttcaacncccttaaccnttcccgtccgttcggaaccaccggttaacggaaaccgttgggttagtcgggtaaccggtttcggacttaccgtttcgtgttaacttcctaacgttcccgttaccgtaaccggttaaacccaaacaacccggaccgtaaacgaacccgaaacccctaacccctaaacgttcttaaaaccgtttagttaccctaagtacccggtttacgttaaccgtttccgtaccccggtaccgttaccgggttttacggtacctacgttccgtaccgtttccgttccgtccggtaaaccgttaaccctttaacgaacccgtttcggaacccggtaaccccgtaaaccggtccccggttacctacccggtaaccctacccgtttgtcccgttaccgggtaccgttaccgggttaccgttaaggttaccggtaacgggtaacggtacgggttaccggttaacgtttacgttacgttacccgtttgttaccgggtttaccgtcgttacgttaccggtacgttaccgttacccggtttgggttacgggttcggttacggttacgggacgttaacggtacgttcggtaccgtcgtccgtacgtcgacgttccgcgtacccgtcccgtccttacggtccnccttcccgtccgtcccg

SEQ ID NO: 283599 - DNA, 793 bp, Homo sapiens
  misc_feature: GYAE6OF01ANI47.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagtcgttgggtttttcctcgttgtcttcttttaaagaggtgtccagtgtcgaggtgcgccgtgggtggagggtcggggggaggcggtggtcccaggccgtgggaccgtcccgtgacgtacctctccgtgtcgcacgcctcgtcggtccttaccacctttacaattaacttagtcgtacttatcgtcgtaggttccgggtccgccgaacggcctccggaacgggtacgaacggggtcgtagggtagggttcggggtcgggtaccggtactacgttacgtcccggtaacccgtagggttacggtaaccttaaccgttaccgtttacgtaaacggtttaacgttaacccggacctaacggtaaccccgttccccgggttagggacccgggggttacccgtactttacccgaaccctacgtcccgtaaccgaggtaacctaacctaaccgtaccccgaaagtaacccgtaccggttactacgtacctacgacccgtaaccgtacaccgtacgtaccgtacggtaaccgtacctaccggaaccgacccttacccgttacccgttaccgttaaccttaccctttacggtccggtacggtaccggtaacgggtaacggttacggttaaccggacggttaaccgttcgtaacgg

SEQ ID NO: 283600 - DNA, 744 bp, Homo sapiens
  misc_feature: GYAE6OF01DLK07.47.85.H08.1.454.CMB.1.raw
  modified_base (286)..(286): a, c, t, g, unknown or other
  misc_feature (286)..(286): n is a, c, g, or t
tcagagctcacgtaacacgaccggtgctcgatttagtatcactcagtcgcggggagctcgtgggagaggacgcccagcacgtggaagtcgccggtgtttccattcggtgatcagcactgaacacagagactcaccagtggagtttgggctgagtcgttgggtttttcctcgttgcttcgttttaaagaggtgtccagtgtcgaggtcgcgcgtgggtggaggtcggggggagcggtcggtccaggtccgtgggacctcccgtaggacgtacctcctccgtgtagcncgtcctgtacggtattcattcgtacagtcgactaccgatactcgacgtacggttcgggacccgcgtaaagttcgacggtaggaaccgtaacctgtaggtaaggttcggttcccgtttacgttagttcgtaccgttggtggtcggtacaccgagaacgtacgtagtacgcggtaacggccggtttacgggacggtacgggtcctacgttaccacctaacgtcccgtaacgaaagtaaagaaacgtcggaaacctaaacggttaccttccggttaactacgtttaccttaaacgaattacgaaactacggtaccgtagggaacggtcgggacccgggtaagtaccgggttaccggttagttaaacgttacgggttagtaagggttaacgaacggtagtaacccgggttaaacgtaggttaaacgggtaaacggtaaccgggtttatttaaaggttccggg

SEQ ID NO: 283601 - DNA, 806 bp, Homo sapiens
  misc_feature: GYAE6OF01E09KU.47.85.H08.1.454.CMB.1.raw
tcagagctcacgtacacgaccggtgctcgatttagtatcactcagtcggcgggggggggtctcaggaggcagcgctctcaggacatctcccaaccatggcctgggctctgctgctccctcaccctcctcactcagggcacagggtcctgggcccagtccgtcggccccactcacgcctcgcctccgtgtctgggtcctccgtggacagtcgatccactactctcctgcacgtacggaacctaggtagtcggacggtttggacctagtttctagtattactagtcctaccgtacggtaaccaaccaaaccaccccaacggtaccaaaaccgacccccaaacgtactaacttaaatttagtacgtaaccgtactaacgttccgttacccgtaccccgtttaccggtacgggggttttaccttccgtaccgttaccggtcctttccttcggtaccggtactacccgttaaaacgttccgttacggaactaacccgacccggtccctacccgtacgtaccctaactccgtccgtacggtctacgtacgtcgtacggacgggacggacggtcctattaacgttttaaccgtttacgttggtttaccgtccgtttcgttacggggtaacccttaaaccgttacgttttcggtttcgggttttacggggtttcggttaccggggtaccgggttaacgggaaccgttaacgggttaccgggtaacccggttacggttacccgtacgaccggtcccgaacggtcccgcccggtaccccctacggttaccaccgttcccgttcccgttaccccccg

SEQ ID NO: 283602 - DNA, 482 bp, Homo sapiens
  misc_feature: GYAE6OF02INVIA.47.85.H08.1.454.CMB.1.raw
  modified_base (471)..(482): a, c, t, g, unknown or other
  misc_feature (471)..(482): n is a, c, g, or t
tcagagctcacgtacacgaccggtgctcgatttagtatcactcagtcgcagggtcctgggcccagtctgcccgactcagcctgcctccgtgtctgggtctcctggacagtcgatcaccatctcctgcactggaaccagtagtgacgttggcagttctgattctatctcctggtaccaacaacacccaggcaaagccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcgagggaccaagttgaccgtcctaggtcagcccaaggctgcccctcggtcactctgttcccgccctcctctacgtgagctctgagcgggctggcaaggcgcatagnnnnnnnnnnnn

SEQ ID NO: 283603 - DNA, 499 bp, Homo sapiens
  misc_feature: GYAE6OF02F2V6C.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatctcagtatacgcagactccctgaggggccgatcaccatctccagagacaactcccagaacacggtctatctgcacctgaccagcctgacgactgacgacacgtctctctactctgtcgcgagagagtcgacgagtctattgtagg

SEQ ID NO: 283604 - DNA, 540 bp, Homo sapiens
  misc_feature: GYAE6OF02GJPSW.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataattatgacgtcaatgttcgcccctcagggtttctcatcgcttctctggctccaaatctggcaacacggcctccctgaccatctctgggctcgagtctgaggacgaggctgattacttctgttgctcttgggctaacttactgttcgttttgggtgtttcggcggtagggaccaaggttcgaccgtccgtaggtccacggccctaaggccttcggcccccgttggtcctacttccgtcgttcccccg

SEQ ID NO: 283605 - DNA, 558 bp, Homo sapiens
  misc_feature: GYAE6OF02INQXI.47.85.H08.1.454.CMB.1.raw
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (540)..(540): a, c, t, g, unknown or other
  misc_feature (540)..(540): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgccccaaactcataatttatgacgtcaatgttcgcccctntagggtttctcatcgcttctctgctcaatctgcacncgcctcctcgacatctctggctcgagtctgaggacgaggtctgtactttacttcgttgttcgtcttcgttcggactaacgttacgttcgttcggttttgggtggtttcggacgggtacgggtacgtaaggttcgtaccgttacgtggtaccacggtacccgaggcctccgtcccgtccggtcnccgttccgtcgttccccg

SEQ ID NO: 283606 - DNA, 512 bp, Homo sapiens
  misc_feature: GYAE6OF02H8PCB.47.85.H08.1.454.CMB.1.raw
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
tcagagctcacgtacacgaccggtgctcgatttagtatcactcagtcgcggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagccccaaactcataatttangacgtcaatgttcgccctcagggtttcncatcgcttctctggctccaaatctggcaacacggcctccctgaccatctctggctcgagtctgaggacgaggctgattactctgttgctcttgggctaactctgttcgtttggtgttcggcggaggacaagttgaccgtcgaggtcagcccaaggctcgccccctggtccacttcctgttcccccg

SEQ ID NO: 283607 - DNA, 552 bp, Homo sapiens
  misc_feature: GYAE6OF02F4ETC.47.85.H08.1.454.CMB.1.raw
  modified_base (361)..(361): a, c, t, g, unknown or other
  misc_feature (361)..(361): n is a, c, g, or t
  modified_base (388)..(388): a, c, t, g, unknown or other
  misc_feature (388)..(388): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacncggcctccctgaccatctctggctcgngtctgaggacgaggctgattacttcttgttcgcttcgttgggcctaacgttacgtgttcggttttggggttcgtttcgggcgggtagggaccaaggttcgaccgtcgtacggtcacgtcccgaaggtccgtcggccccttcggtccacgttcctcgttcccccg

SEQ ID NO: 283608 - DNA, 530 bp, Homo sapiens
  misc_feature: GYAE6OF02FT5PN.47.85.H08.1.454.CMB.1.raw
  modified_base (397)..(397): a, c, t, g, unknown or other
  misc_feature (397)..(397): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaatcataatttatgacgtcaatgttcgcccctcagggtttctcatcgcttctctggctccaatctggcaacacggcctcctgaccatctctgggctcgagtctgaggacgnggctgattacttctgttgctcttgggcaactctgttcgtttgggtgttcggcggagggacctagttcgaccgtccgttaggtccagcccgaaggtcctacggccccctcggtccaccgttccgtgttcccccg

SEQ ID NO: 283609 - DNA, 515 bp, Homo sapiens
  misc_feature: GYAE6OF02HXDEU.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccagcaaagccccaaactcataattatgacgtcaatgttcgccctcagggtttctcatcgcttctctgctcaaatctgcaacacggcctccctgaccatctctggctcgacgtctgaggacgaggctgatttactcttgttgctctggcaactctgttcgttgggtgttcggcggacggacgtagttcgaccgtcgtaggtcacgcccaaggcctcgccccgtcgtcctacgttctcgttccccg

SEQ ID NO: 283610 - DNA, 517 bp, Homo sapiens
  misc_feature: GYAE6OF02HHJXP.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccaggcaaagccccaaactcataattatgacgtcaatgttcgcccctcagggtttctcatcgcttctctggatccaaatctggcaacacggcctccctgaccatctctgggctcgagtctgaggacgagctgattacttctgttgctcttgggctaacttactgttcgtttgggtgttcgggcggtaggacctaagttcgaccgttctaggtcagcccaaggctcgcccctggtccactctgttcccc

SEQ ID NO: 283611 - DNA, 521 bp, Homo sapiens
  misc_feature: GYAE6OF02FMCDL.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaaactcataatttatgacgtcaatgttcgcccctcagggtttctcatcgcttctctggctcaaatctggcaacacggcctccctgaccatctctgggctcgagtctgaggacgaggctgattacttctgttgctcgttgggctaacgtactgttcgtttgggtgttcggcggagggaccagttgaccgtcgtaggtcagcccaaggctcgccccgtggtccacgtctgttccccg

SEQ ID NO: 283612 - DNA, 508 bp, Homo sapiens
  misc_feature: GYAE6OF02HNWX0.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaaactcataatttatgacgtcaatgttcgcccctcaggggtttctcatcgcttctctggctccaaatctggcaacacggcctccctgaccatctctgggctcgagtctgagcgaggctgattactctgttgctcttggcaactactgtcgtttgggtgttcggcggaggacagttgccgtcgtaggtcagccaaggctgcccctggtcactctcgttccccg

SEQ ID NO: 283613 - DNA, 526 bp, Homo sapiens
  misc_feature: GYAE6OF02HFZQP.47.85.H08.1.454.CMB.1.raw
  modified_base (320)..(320): a, c, t, g, unknown or other
  misc_feature (320)..(320): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagccccaaaactcataatttatgacgtcaatgttcgcccctnagggtttctcatcgcttctctgctcaaatctggcaacacgcctcctgaccatctctgggctcgagtctgagacgaggctgatttacttctgttgctcgttgggctaactctgttcgtttgggtgtttcggcggtagggacctagttcgaccgttccgtaggtccagcccgaaggcctcgccccttcggtcaccttctcgttacccc

SEQ ID NO: 283614 - DNA, 795 bp, Homo sapiens
  misc_feature: GYAE6OF02H9QN2.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgtgctgactcagccaccctcagcgtctgggacccccgggcaggagggtcactatccttcttgttcgtaggaagcagcctaccaacataaacgttaaaaaaattttgtaacttacgttaggttatacgaagaccaaccttaccccgaacggaaccccggaccccctaaaaccttcccgtacctatcgttaccgtaaggtaaattaactcgaacggccggtaccccgtacggtaccggggttccctacggtaacccggttatttcccgtcgttcggtacccttacccgtaaacgtttccgtacgggtaccctaacccgttcgaaccgttcccccgttaccccgttaccgggccctaacgtccggtaacgggttccggggtccgttccccggggtaccggaagggtacgtacgggacggtcgttacggtaagtttactttacgtggttcgtacgtagcgtaggtaggagttacgaaccgacggtccctcggtccgttcggttacgttaggtttcggggttcggtttaccggggaccggggtaacgggtaaccggaacggtccggttaccggtacccggtacccggttacggtaccgaccggacccggtaacggtcccgtacccggtcccccggtcggtaacccg

SEQ ID NO: 283615 - DNA, 538 bp, Homo sapiens
  misc_feature: GYAE6OF02F5IP3.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaatcataatttatgacgtcaatgttcgcccctcaggggtttctcatcgcttctctggctccaaatctggcaacacggcctcctgaccatctctgggctcgatctgaggacgaggctgattacttctgttgcttcgtgggcaactacgttgttcggttttgggtgtttcggcggtagggtacctaaggttcgaccgtccgtaggtcacggcccgaaggcctcggccccctggtccacttccgtcgttaccccc

SEQ ID NO: 283616 - DNA, 531 bp, Homo sapiens
  misc_feature: GYAE6OF02HTWBA.47.85.H08.1.454.CMB.1.raw
  modified_base (377)..(377): a, c, t, g, unknown or other
  misc_feature (377)..(377): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaaagcccccaaactccaattaactttatgacgttcaaattgttcgccccttcaggggttttctcatcgcttctctgctcaatctgcaacacggcctccngaccatctctggctcgagtctgagcgaggctgatttactcttgttgctcttgggctaactctgttcggtttggtgttcggcggaggaccagttcgaccgtcgtaggccagcccgaaggtcctcgcccccgtggtccaccttcgtcgttcccccg

SEQ ID NO: 283617 - DNA, 562 bp, Homo sapiens
  misc_feature: GYAE6OF02IPZWR.47.85.H08.1.454.CMB.1.raw
  modified_base (316)..(316): a, c, t, g, unknown or other
  misc_feature (316)..(316): n is a, c, g, or t
  modified_base (405)..(405): a, c, t, g, unknown or other
  misc_feature (405)..(405): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccagcaaagccccaaactcataattatgacgtcaatgttcgcccctntagggtttctcatcgcttctctgctcaatctgcaacacgcctcctgaccatctcgtggctcgagtctgacggacgaggctgattacttntgttgctcgttgggactaacttacgtgttcggtttgggttcgtttcgggcggtaacgggtaccgtaaggtttcgacccggttccgttaggtaccgacggtacccgtaaggccttccggcccccgttcggtccctaccgttcccgtccgttacccccg

SEQ ID NO: 283618 - DNA, 548 bp, Homo sapiens
  misc_feature: GYAE6OF02IB0O4.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctgggtggaggtcggggggaggcgtggtccagcctggggacgtccctgagactctcctgtgcagcctctggcttcaccttcaataattatgctatgcaggtcgggtccgccaggctccgaggcaaggggctaggaggtgggtggcggtcatatcgtccaggtggacattcttcagttattacgctagacctccgtggacggggtcctattccacctatcctacagacgactaacttcccaagaacctacggtctactctcgacctacctcgaccacgcctaggacgaactcggaaccgactacgtctctctactacgtgtcgacgagagtagtcgacgtagtctagttgtacg

SEQ ID NO: 283619 - DNA, 529 bp, Homo sapiens
  misc_feature: GYAE6OF02JN0XP.47.85.H08.1.454.CMB.1.raw
  modified_base (502)..(502): a, c, t, g, unknown or other
  misc_feature (502)..(502): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (524)..(525): a, c, t, g, unknown or other
  misc_feature (524)..(525): n is a, c, g, or t
  modified_base (527)..(529): a, c, t, g, unknown or other
  misc_feature (527)..(529): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaaactcataatttatgacgtcaatgttcgcccctcaggggtttctcatcgcttctctggctccaaatctggcaacacggcctccctgaccatctctgggctcgagtctgaggacgaggctgattacttctgttgctcttgggctaacttactgttcgtttgggtgtttcggcggagggtacctaagttcgaccgtcgtaggtcacgccgaaggctcgcccctcggtcactctcgttcccaccctcctctaccgtgacgtctccgtacgcgcggcgtacggcgaacggccgacgatacggtnacgtcagcancgntcncgcncnncnnn

SEQ ID NO: 283620 - DNA, 543 bp, Homo sapiens
  misc_feature: GYAE6OF02INWW4.47.85.H08.1.454.CMB.1.raw
  modified_base (365)..(365): a, c, t, g, unknown or other
  misc_feature (365)..(365): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacaccaggcaaacgcccccaaactcaataatttatagacgtcaattcgttcgcccctcgagggtttctcatcgcttctctgctacaatctgcaacncgcctcctgaccatctcgtggctcgatctgaggcgaggctgacttacgttctgttgcttcgttgggactaacttacgttgttcggttttgggtcgttcgggcggacgggtactaaggttcgaccgtccgtacggtcacgcccgaaggtcctaccggcccccgtggtcccacgttcccg

SEQ ID NO: 283621 - DNA, 676 bp, Homo sapiens
  misc_feature: GYAE6OF02J0Y0M.47.85.H08.1.454.CMB.1.raw
  modified_base (221)..(221): a, c, t, g, unknown or other
  misc_feature (221)..(221): n is a, c, g, or t
tcagagctcacgtacacgaccggtgctcgatttagtatcactcagtcgcgggggcgtggggtcgtcgaggaggcgagcgctctcaggacatctccaccatggcctgggctctgctgctcctcaccctcctcactcaggcacagggtcctgggcccagtctcgcccccgactcacgcctcgccctccgtgtcctgggtcctccgtggacagtcgatcacctntcctcctgcactggaaccagttagtgacgttggactagttctgtattctatcttcctggtaccaactaccacccaggaccaaaccgcccccaaactcaataatttatacgtacgtacaattcgtccacccctcggtacggtttctcacgtcgtcttcgtctcgctacctaatcgtagccaaacctccggacctcccgtacgacctatcctcgtcggctacgcgtacgtcggtacggacggacgggtcttaggtacgtttacctttcggtacgtttccggtcgtttaccggtttcgggaaccctttaacgtaccgtttcgggtttacggtttcgggtttcgggttcgggttaccgggacgggttaccgtaaggtttccgggaacccgtttccgtagggacctaccggacccggtaggtccgtacccggtcccccggtacgtccgttaccttcccgg

SEQ ID NO: 283622 - DNA, 584 bp, Homo sapiens
  misc_feature: GYAE6OF02GJW7J.47.85.H08.1.454.CMB.1.raw
  modified_base (317)..(317): a, c, t, g, unknown or other
  misc_feature (317)..(317): n is a, c, g, or t
  modified_base (360)..(360): a, c, t, g, unknown or other
  misc_feature (360)..(360): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggaggcctggtacagccgtggggggtccctggagactctcctgtgcagcctctggattcattcttcagtgactacgacatgcactgggtccgccaagttgcagganaacctctggaatgggtctcgttattgctacgtggtggtgccanagactatgcaggcctcggtggacggggccgtattccacctatcctacccgaagaacgaaaagtcggacaaagtaaccttccttagttacttccttaacaaatacgaaacacggacctggaacggtacggcccggggaacgacggcggttgtaagttacgtgtaggtaagaggacgcgtacgagttaggtaacggagggtaacttaagtcgttacgtttgtaacg

SEQ ID NO: 283623 - DNA, 551 bp, Homo sapiens
  misc_feature: GYAE6OF02IAZG4.47.85.H08.1.454.CMB.1.raw
tcagagctcacgtacacgaccggtgctcgatttagtatcactcagtcgcgggggagctctgggagaggagcccagcactggaagtcgccggtgtttccattcggtgatcagcactgaacacagaggactcaccatggagtttgggctgagctgggttttcctcgttgcttcttttaagaggtgtccagtgtcaggtgcgcctggtggaggtcggggggaggcgtggtccagcctgggacgtccctgagactctcctgtgcagcctctggcttcaccttcaataattatgctatgcagtcgggtccgccaggcctccgaggacgaaggggctaggaggtggggtggcggtcatactcgtcagtggacatcttcagtattacacagacctcctggacggggccgtattccacctatctaccgagacgaactaacttcccgaagaactacggtctatcctgaccacctcgacccagcctagaacgaactacgacgaccacgtctacctctacctaacgtcgtacgcgacgtagtacggttagacgtacgtctag

SEQ ID NO: 283624 - DNA, 580 bp, Homo sapiens
  misc_feature: GYAE6OF02HX752.47.85.H08.1.454.CMB.1.raw
  modified_base (472)..(472): a, c, t, g, unknown or other
  misc_feature (472)..(472): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctctgcatggaaccagtagtgacgttggcagttctgattctatctcctggtaccaacaacacccaggacaaacgcccccaaaactcaattaactttatagaccgtacaattcgttaccgcccctagtacgggtttctcatcgtcttctctgctacctaaatcgtagcaacgacggccctccctagacctatccgtcgtgggtcctcggactcgtaggacggacgaggctgaacttttactgttgttcgctcgttaggacctaacgtnttcggttcgtttgggtgttcggcgggtacgaccgtagtcgaccgttcgtaacgtcacggcccgtaggtccgtaccgccccgtaggtcctacttccgtccgttaccccc

SEQ ID NO: 283625 - DNA, 612 bp, Homo sapiens
  misc_feature: GYAE6OF02G0CVW.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccagcaaacgccccaaactcaataattatgacgtcaatcgttcgcccctcgtagggtttctcatcgcttctctggctacaatctgcaacacgcctcctgaccatctcgtggctcgagtctgacggacgaggctgtactttacttcgttgttcgtcttcgttgggtacctaacgttaccgtttgttcgggttttagggttcggtttcgggcgggtacggggaaccgtaaggtttcggtacccggttaccggtaacgggttaccacgggtaccccgtaagggtcccgttaccggtccccccgttaccggtcccgtaccgttcccgttacccgtttaccccccg

SEQ ID NO: 283626 - DNA, 513 bp, Homo sapiens
  misc_feature: GYAE6OF02FRFNR.47.85.H08.1.454.CMB.1.raw
  modified_base (174)..(174): a, c, t, g, unknown or other
  misc_feature (174)..(174): n is a, c, g, or t
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagnggtgtccagtgtcaggtgcgcctggtggagtcggggggaggcgtggtccagcctgggactccctgagactctcctgtgcagcctctggcttcaccttcaataattatgctatgcagtgggtccgccaggctccaggcaaggggctagagtgggtggcggtcatntcgtccagtggacntcttnagtattacgcagactccctggacggggccattcaccatctccagacgacaacttcccaagaacacggtctactctgccacctgaccacgcctgagaactgacgacacgtctctctactactgtgcgagagtagttggacgtagtctagttgtacgg

SEQ ID NO: 283627 - DNA, 755 bp, Homo sapiens
  misc_feature: GYAE6OF02JNU4Z.47.85.H08.1.454.CMB.1.raw
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggagcgttagttcagccgtggggagtccctgagctctcctgtgtagtctctggaatcagtttcagtaccttctggatgctacgtggggtcccgaccaaactccgaagggtaaggggctgggtgtcgggtctcgacgtatcgaactcctagagtggactagtagtttaataaattagtcggacggtacttccggtagggacgggggtcccgtaattccgaaggtcctaattccgtacccgaagggaacgaaaccgtaaaccgggactaaagggtaacgttaacgttaacgttacggttaaagtttacccggttaaagggtaaaaacttcggtaaaacgaaaccgttacggtacggtaacggttacggtaaccgggtacggtaaacgttcgggtacccgttagttaccgttaacttacgttagttttaggtttcggttttaacgttacggttaccggtcccggttttccgggtaccgggttaccccgggggtacggttttacccggttacggggggtacccccgttaacggggtaccccggttaccgggg

SEQ ID NO: 283628 - DNA, 774 bp, Homo sapiens
  misc_feature: GYAE6OF02H4G30.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctcgggcccagtctcgccccgactcagcctgcctccgtgtctgggtctcctggacagtcgatcaccatctcctgcactggaaccagtagtgacgttggctagttctgattctatctcctgtaccaacaacaccagcaaacgccccaaactcaataatttatgtacgtacaatcgttccgccctacgtacggggtttctcactccgtcttcttcgtcggtcctacctaaacttcgtacggtaccaaaccgtaccggaccccttcccgtacgaacccctaacttccgttcgtcgggtcccttacggtaacgttcgttacgggaacggtaaccggacgggtacttacggttaacgttttaacctttcgtttcggtttcgtaccgtttccggtttacggggaccttaaaccgtttaccgtttcgggttttaccggtttttagggggggtttcgtttccgggggtacgggtaacgggggttaacccgttaaacgggtttccgggtaaccccggtttaccggttaacgggttacccgaaccgggtacccccggtaaacgggtcccgtttcccgggtacccccccggttccgggttaccccgtaccgtttccccggtttacccgtttacccccccccgg

SEQ ID NO: 283629 - DNA, 517 bp, Homo sapiens
  misc_feature: GYAE6OF02FOZA6.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctctgtaccaacaacacccaggcaaagcccccaaaactcataatttatgacgtcaatgttcgcccctcagggtttctcatcgcttctctggctccaatctggcaacacgcctccctgaccatctctgggctcgagtctgaggacgaggctgatttacttctgttgcttcttgggctactactgttcgtttgggtgttcggcggaggactagttcgaccgtcgtaggtcacgcccgaaggcctcgcccctggtcactctgttccccc

SEQ ID NO: 283630 - DNA, 541 bp, Homo sapiens
  misc_feature: GYAE6OF02G5TRM.47.85.H08.1.454.CMB.1.raw
  modified_base (400)..(400): a, c, t, g, unknown or other
  misc_feature (400)..(400): n is a, c, g, or t
  modified_base (429)..(429): a, c, t, g, unknown or other
  misc_feature (429)..(429): n is a, c, g, or t
  modified_base (434)..(434): a, c, t, g, unknown or other
  misc_feature (434)..(434): n is a, c, g, or t
  modified_base (449)..(449): a, c, t, g, unknown or other
  misc_feature (449)..(449): n is a, c, g, or t
  modified_base (468)..(468): a, c, t, g, unknown or other
  misc_feature (468)..(468): n is a, c, g, or t
  modified_base (525)..(525): a, c, t, g, unknown or other
  misc_feature (525)..(525): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctcgtgtctgggtctccgtggacagtcgatcaccatctcctgccacgtggaaccagtagtgacgttggctagttctgattctatctcctgtaccaacaacacccaggcaacgcccccaaatcataatttatgacgtcaatcgttccgcccctcgtacggggtttctcatcgtcttctctggcctacaatctgacaacgacgcctcctgacctatctcgtcgggctcgngtcgtgacggacgaggctgtatttacttnttgtntctcgttggcacgtntgttcggttggtgttcggnggacggtactagtcgaccgtcgtaggtcacgcccgagtccgccgtcccgtcggtccncttcgtccgttacccc

SEQ ID NO: 283631 - DNA, 563 bp, Homo sapiens
  misc_feature: GYAE6OF02ICN0I.47.85.H08.1.454.CMB.1.raw
  modified_base (223)..(223): a, c, t, g, unknown or other
  misc_feature (223)..(223): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctcgccccgactcagcctgcctccgtgtctgggtctcctggacagtcatcaccatctcctgcactggaaccngtagtgacgttggcagttctgattctatctcctggtaccaacacaccaggcaaacgccccaaactcattaatttatgacgtcaatgttccgccctcgtacgggtttctcatcgtcttctctgctcaatcngcaacncgcctcctcaccatctcgtggctcgagtctgaggacgaggtctgtatttacttcttgttcgtcttcgttcgggtcctaacgtttctcggtttcggttttcgggttcgttcgggcgggtaacggtaccgtagttcgacccggttcgtacggttccgacgtcccgaaggccgtccgcccgttcgtccctactccgttcgttccccg

SEQ ID NO: 283632 - DNA, 524 bp, Homo sapiens
  misc_feature: GYAE6OF02GWL9F.47.85.H08.1.454.CMB.1.raw
  modified_base (404)..(404): a, c, t, g, unknown or other
  misc_feature (404)..(404): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaatcataatttatgacgtcaatgttcgcccctcaggggtttctcatcgcttctctggctccaaatctggcaacacggcctccctgaccatctctgggctcgagtctgagacgagctgnttacttctgttgctcttgggcaactctgttcgtttgggtgttcggcggtaggaccgagttcgaccgtcgtaggtccaggtcccaaggcctcggccccctggtcccacttctgttcccccg

SEQ ID NO: 283633 - DNA, 505 bp, Homo sapiens
  misc_feature: GYAE6OF02ICDIC.47.85.H08.1.454.CMB.1.raw
  modified_base (485)..(485): a, c, t, g, unknown or other
  misc_feature (485)..(485): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctctttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactccctggaggggccgattcaccatctcagagacaattcccagaacacggtctatctgccactcgaccacgcctgacgaactgacgacacgtctctctactactgtcgcgagngagtgacgagtctagttgtg

SEQ ID NO: 283634 - DNA, 531 bp, Homo sapiens
  misc_feature: GYAE6OF02FSLIL.47.85.H08.1.454.CMB.1.raw
  modified_base (225)..(225): a, c, t, g, unknown or other
  misc_feature (225)..(225): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcaggacacagggtcctgggcccagtctgcccccgactcagcctgcctccgtgtctgggtctcctggacagtcgatcaccatctcctgcactggaaccngtagtgacgttggcagttctgattctatctcctggtaccaacaacacccaggcaaagcccccaaactcataatttatgacgtcaatgttcgccctcagggtttctcatcgcttctctgctcaatctgcaacacggcctccctgaccatctctggctcgagtctgacggacgaggctgattacttctgttgcttcgttgggctaacgttactgttcggtttggtgttcggcggtaggaccgtagttcgaccgtcgttaggtcagtccgaaggctccggccccttcggtctacctcgtcgttaccccc

SEQ ID NO: 283635 - DNA, 595 bp, Homo sapiens
  misc_feature: GYAE6OF02GZTME.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctctgtaccaacaacacccagcaaacgccccaaactcaataattatgacgtcaatcgttccgcccctgtacggggtttctacactcgtcttctctgcctaccaaatctggacaacgaccggcctccctcgacctatcctcgtggctcgagtcgtgaggacgaggctgtatttacttcgttgttcgcttcgttgggcctaacgttcgtggtttcggtttgggttcggttcgggtacggtaacgggtaccgtaaggtttcggtaccggttccgtacgggtaccacggtacccgtaaggtccgtccgtccccggttcggtcctaccgttccgttccgttcccccg

SEQ ID NO: 283636 - DNA, 518 bp, Homo sapiens
  misc_feature: GYAE6OF02GF8VO.47.85.H08.1.454.CMB.1.raw
  modified_base (455)..(455): a, c, t, g, unknown or other
  misc_feature (455)..(455): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctctgtaccaacaacaccagcaacgccccaaatcataattatgacgtcaatgtcgccctcgagggtttctcatcgtcttctctgctacaatctggacaacacggtcctccctgaccatctcgtgggctcgagtcgtgaggcgagcgtgtacttacttgttgttgcttcgttggactaacgttctgttcgtttgggtcgttcggnggtacggacgtagttcgaccgtcgtggacacgccaggctccgcccgtgcacgtctcgttcccc

SEQ ID NO: 283637 - DNA, 533 bp, Homo sapiens
  misc_feature: GYAE6OF02JC868.47.85.H08.1.454.CMB.1.raw
  modified_base (341)..(341): a, c, t, g, unknown or other
  misc_feature (341)..(341): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggaccgtcctgagactctcctgtgcagcctctggcttcaccttcaataattatgctatgcaggtgggtccgccaggcctccgaggcgaaggggctaggaggtgggtggcggtnatatcgtccagtgacatcttcagtatacgcagacctcccgtggacggggccgtattccacctatcctccagaacgactaacttcccaagaaccacggttctactctcgcctacctcgaccagcctagacgtaactcgaacgacacgtctctactactctgtcgacgagagtagttgacgtagtctattgtgg

SEQ ID NO: 283638 - DNA, 566 bp, Homo sapiens
  misc_feature: GYAE6OF02HTRSQ.47.85.H08.1.454.CMB.1.raw
  modified_base (368)..(368): a, c, t, g, unknown or other
  misc_feature (368)..(368): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctgtaccaacaacaccaggcaaacgccccaaactcataattatgacgtcaatgttccgcccctcgtaggggtttctctatcgcttctctgctcaatctgcaacacgcctcctnaccatctcgtcggctcgagtctgaggacgaggctgtatttacttcgttgttgtcttcgttgggtactaacgttacgtgttcggttttgggttcggtttcgggcggtaacgggtaccgtaaggttcggtaccgtccgtacggtcacggacccgtaaggtcctaccggccccgtcggtcctacgttcctccgttaccccc

SEQ ID NO: 283639 - DNA, 547 bp, Homo sapiens
  misc_feature: GYAE6OF02IBM1Y.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggaggcgtggtccagcctgggacgtccctgagactctcctgtgcagcctctggcttcaccttcaatattatgctatgctaggtcggggtccgccaggcctccgaggcgaaggggctaggaggtgggtggcggtcagtacgtcgtccaggtcggactatcttacagttatacgcagactccgtgacgggcactcactactctccagacgactaactacccaagacctacggtactactctcgaccactacgacccagacctagacgaacgtgacgaccgacgtctactactactcgtacgtcggacgagagtagttacgacgtagtctagttgtacg

SEQ ID NO: 283640 - DNA, 697 bp, Homo sapiens
  misc_feature: GYAE6OF02JTD0L.47.85.H08.1.454.CMB.1.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtcctgagctctcctgtgcagcctntggcttcaccttnaatattatgctatgcaggtcgggtccncaggctccgaggcaaggggctaggngtgggtcgcggtcagtactcggtccaggtcgactagttcttacgagttacttacggccaggtaccctcccgtagggacgggggcctaacgtttccgaacctaacttccgtaccgaagaacgtacctaaacttaccccgaaggtaaaccgtaccgggttactaacgttccgtacgggtaccctaacccgttacgaaaccccgtacgtacccgttacggaaccggtaaaccgttcggaaacccggttaaccgtaccggttaccgttacccgttacccgttaaccgtttaccgttacggttaaccggaccggtaacgggtaacggttaacggtttcgggtaaacccggtaggtttaccgtaacggtttacggtaacggg

SEQ ID NO: 283641 - DNA, 513 bp, Homo sapiens
  misc_feature: GYAE6OF02HRMD3.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtccctgagactctcctgtgcagcctctggcttcaccttcaataattatgctatgcagtgggtccgccaggctccaggcaaggggctaggagtggggtggcggtcatatcgtcagtggacatcttcagttattcgcagacctcccgtggacggggccgattccacctatcctccagacgacaacttcccagaacacgtctatctgccactcgaccacgcctgacgaactcgacgacacgtctactctactactgtgcgagagagttgacgtagtctag

SEQ ID NO: 283642 - DNA, 764 bp, Homo sapiens
  misc_feature: GYAE6OF02JY1GL.47.85.H08.1.454.CMB.1.raw
  modified_base (137)..(137): a, c, t, g, unknown or other
  misc_feature (137)..(137): n is a, c, g, or t
tcagagctcacgtacacgaccggtgctcgatttagtatcactcagtcgcgggggggtcgtcgaggaggcgagcgctctcaggacatctccaccatggcctgggctctgctgctcctcaccctcctcactcaggcacnggtcctgggcccagtctgccccgatcagcctgcctccgtgtctgggtctcgtggacagtcgatcaccatctcctgcactggaacctgtagtgacgttggcagtttctgtattctactctccttggtaccaacgtaacaccccaggaccaaaacgacccccaaaactccaacttaaactttatacgtaaccgtactaaattcgttccgtcccctacgttacggggtttcctactagttccgtctttacctcgttacggtcctaacctaaattccgttacggcctaaaaccgtcccggtacccttaccccgtagtaaccctattcccgttcgtaccgggtcttacgggtacgttaccgtggtaacgggtaacggtacgggtacttacgttaacgtttacgtttccgttagtttcgtccttcggttttaccggggacctttaaaccggtccgtttcggttttaccgggtttcggggtttcggttaccgggggtaccgggtaacggggtaacccttaacggggttttccggacccgttttaccgggagggttttacccgacggttaaccccgaagggttcctacccggtccccgttacccggtctaacccggttcttcccgttaccccccg

SEQ ID NO: 283643 - DNA, 531 bp, Homo sapiens
  misc_feature: GYAE6OF02GGNE2.47.85.H08.1.454.CMB.1.raw
  modified_base (370)..(370): a, c, t, g, unknown or other
  misc_feature (370)..(370): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcacggggtttctcatcgcttctctggctcaatctggcaacacggcctccngaccatctctgggctcgagtctgaggacgaggctgtaattacttctgttgctcgttggcaactactgtcggtttggtgttcggcggaggacctagttgaccgtcgtaggtcacgcccaaggccttcggcccccttcggtccacgttccgtcgttacccccg

SEQ ID NO: 283644 - DNA, 555 bp, Homo sapiens
  misc_feature: GYAE6OF02G6IRX.47.85.H08.1.454.CMB.1.raw
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctgagggtttctcatcgcttctctggctccaatctggcaacacggcctcccngaccatctctggctcgngtctgaggacgaggctgatttacttctgttgcttcgttgggcctaacgttactggttcggttttgggttgtttccgggcggtaagggtacctaaggttcgaccgttcgtagggtccacgcccgaaggtcctccggcccccgtggtaccacgttccgtccgttcccccg

SEQ ID NO: 283645 - DNA, 554 bp, Homo sapiens
  misc_feature: GYAE6OF02IP0IM.47.85.H08.1.454.CMB.1.raw
  modified_base (306)..(306): a, c, t, g, unknown or other
  misc_feature (306)..(306): n is a, c, g, or t
  modified_base (336)..(336): a, c, t, g, unknown or other
  misc_feature (336)..(336): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaaacgcccccaaaactcaattaatttangacgtcaatgttcgcccctgtagggtttcncatcgcttctcgtgctcaaatctgcaacacgcctccngaccatctctgggctcgngtctgacggacgcggcttagatttacgttctgttgctcgttgggctaacgttctgttgtttgggtggtttcggcggtaacgggaccaagttcggaccgttccgtaggtaccagcccgaaggccctcggtcccccgttggtacctacgttccgtcgttcccccg

SEQ ID NO: 283646 - DNA, 524 bp, Homo sapiens
  misc_feature: GYAE6OF02ICIJB.47.85.H08.1.454.CMB.1.raw
  modified_base (521)..(521): a, c, t, g, unknown or other
  misc_feature (521)..(521): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcgggggagcgtggtccagcctgggacgtccctgagctctcctgtgcagcctctggcttcaccttcaataattatgctatgcaggtgggtccgccaggcctccgaggcgaaggggctaggaggtggggtggcggtcatatcgtcaggtgacatcttcagttatacgctagacctcccgtggacgggccattccacctatcctccagacgacaacttccagaacacgtctatctgccacctcgaccagcctagaacgaactcgaccgacacgtctacctctaacctactgtgacgagacggtagttgacgtagtntag

SEQ ID NO: 283647 - DNA, 529 bp, Homo sapiens
  misc_feature: GYAE6OF02HUELA.47.85.H08.1.454.CMB.1.raw
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
  modified_base (356)..(356): a, c, t, g, unknown or other
  misc_feature (356)..(356): n is a, c, g, or t
  modified_base (395)..(395): a, c, t, g, unknown or other
  misc_feature (395)..(395): n is a, c, g, or t
tcagagctcacgtacacgaccggtgctcgatttagtatcactcagtcggcggggggggtctcaggacggcagcgctctcaggacatctccaaccactggcctgggctctgctgctcctcaccctcctcactcagggcacagggtcctgggcccagtctcgccccgactcacgcctgcctccgtgtctgggtctcctggacagtcggatcaccatcncctgcactggaaccagtagtgacgttggcagttctgattctatctcctggaccaacaacaccagcaaagccccaaacncataacttatagacgtcaatgttccgccctgagggtttcncatcgcttctctgctcaaatcnggcaacacgcctccagacctatctcgtggctacgagtcnggacgacgacgctgatttactcgttgtcgcttcgtggctaactctgttcgtttgggtgttcgggcggaaggcctagttcgaccgtcgtggtcacgtccgaaggctccgccccgtggtaccacttctcgtacccc

SEQ ID NO: 283648 - DNA, 658 bp, Homo sapiens
  misc_feature: GYAE6OF02GONFX.47.85.H08.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (350)..(350): a, c, t, g, unknown or other
  misc_feature (350)..(350): n is a, c, g, or t
tcagagctcacgtacacgaccggtgctcgatttagtatcactcagtcgcggggggtcgtcgaggaggcgagcgctctcaggacatctccaccatggcctggctctgctgctcctcaccctcctcactcaggcacaggtcctgggcccagtctgccccgactcagcctgcctccgtgtctgggtcctccgtggaacngtcgatcaccatcctctcgcactggaaaccngttagngaacgttggnaggtttctgattctatctctgtaccacaacaccagacaaacgaccccaaatccaactaaactttatacgacgtactaatcgtttcgccccttacgacgggttttccncgtaacttcgtcttctctggtcctacctaaatccgttagacctaacgtaacccggacccttccgtacgaacctactcttacgtcggcttacggtacgttcttacggaaggacggaaggccgttaggtactttaacctttcgtcgttgttccttacggtttaggaccgtaactttaccgttgtttcgggtttcggtttggtccgtggggtaacggaccgttaagttcgaccggtaccgttaaggtcaaccggtaccccgaaggttcccaccggttcccccgtggtacctaccttcgtcccggttccccc

SEQ ID NO: 283649 - DNA, 569 bp, Homo sapiens
  misc_feature: GYAE6OF02H9IQ9.47.85.H08.1.454.CMB.1.raw
  modified_base (295)..(295): a, c, t, g, unknown or other
  misc_feature (295)..(295): n is a, c, g, or t
  modified_base (394)..(394): a, c, t, g, unknown or other
  misc_feature (394)..(394): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaaaaggtgtccagtgtgaggtgcaggtagtggagtccgggggaggcttagttcagcctggggagtccctgagactctcctgtgtagtctctggaatcagtttcagtaccttctggatgcactgggtccnccaaactccaggtaaggggctggtgtgggtctcacgtatcaatcctgatggctagtgttataaattatgcggtactccggtgagggccattcagcatcnccagacgacaacggcaagagtatactgtatcgtaggaaatagaaactaatcgtagagacgtcgaacgtatacggctgtactatcatttgttgttttacgattcgtcccgtttccgggtcccgtcgggttacgttccggtcggggtacccgtaacggggtaccccgttgggtaccg

SEQ ID NO: 283650 - DNA, 559 bp, Homo sapiens
  misc_feature: GYAE6OF02H85LX.47.85.H08.1.454.CMB.1.raw
  modified_base (339)..(339): a, c, t, g, unknown or other
  misc_feature (339)..(339): n is a, c, g, or t
  modified_base (361)..(361): a, c, t, g, unknown or other
  misc_feature (361)..(361): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccgtggagtttggctgagctgggttttcctcgttgcttcttttaagaggtgtccagtgtcaggtgcgcctggtggaggtcggggggaggcggtggtccagcctgggaccgtccctgagactctcctgtgcagcctctggcttcaccttcaaattaattatgctatgcagtgggtcccgccaggcctccgaggcgaaggggctaggaggtgggnggcgtcatatcgtccagtgacntcttacagtacttacgcagacctccgtgggacgggcctattccaccatcctaccagacgactaacttcccgaagaaccgacggttactactcctagcctaccgtagacccagccctagaacgaacctagaaccgactaccgtctactactactacgtgtacgcgaagtagtagttcgacgtagtactattggagtacg

SEQ ID NO: 283651 - DNA, 681 bp, Homo sapiens
  misc_feature: GYAE6OF02H4TFC.47.85.H08.1.454.CMB.1.raw
  modified_base (298)..(298): a, c, t, g, unknown or other
  misc_feature (298)..(298): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgcccccgatcagcctgcctccgtgtctgggtctcctggacagtcgatcaccatctcctgcactggaaccagtagtgacgttggcagttctgattctatctctggtaccaacaacacccagcaaacgccccaaactcataattanagacgtacaatcgttccgcccctcgtacgggtttcctacactcgtccttcgttcgtcggacttaccaaacttcgtacggaccaaaccgtacccggtcccttacccctacgaccctaacttccgtacgtcgggtccttcggtacgttcgtaggacgggtacggaggtcgttagtacgttttaccgttcgttacgtttcgtcgttcgttcgggacctaacgttacgttggttacggttttcggggttcgttccggggtacgggtaacggggtacctaaggtttccggtaccggtttaccggtaggttaccgaacggtccccggtaaacggtccgttaccggtcccccgttacgggtaccctacgttcccgttccgttaccccccg

SEQ ID NO: 283652 - DNA, 503 bp, Homo sapiens
  misc_feature: GYAE6OF02FO71S.47.85.H08.1.454.CMB.1.raw
  modified_base (302)..(302): a, c, t, g, unknown or other
  misc_feature (302)..(302): n is a, c, g, or t
  modified_base (442)..(442): a, c, t, g, unknown or other
  misc_feature (442)..(442): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcgggggaggcgtggtccagcctgggacgtccctgagactctcctgtgcagcctctggcttcacctttcaataattatgctatgcagtgggtccncaggctccgaggcaaggggctagagtggggtgcggtcatatcgtcagtggacatcttcagtattacgcagactccctgagggccattcaccatctccagagacaacttcccagaacacggtctatctgaccactcgaccngcctgacgactgacgacacgtctctctacctactgtcgcgagagtagttgacgtagtctag

SEQ ID NO: 283653 - DNA, 559 bp, Homo sapiens
  misc_feature: GYAE6OF02FINNV.47.85.H08.1.454.CMB.1.raw
  modified_base (226)..(226): a, c, t, g, unknown or other
  misc_feature (226)..(226): n is a, c, g, or t
  modified_base (386)..(386): a, c, t, g, unknown or other
  misc_feature (386)..(386): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggccccagtctgccccgactcagcctgcctccgtgtctgggtctcctggacagtcgatcaccatcctcctgcactggaaccngtagtgacgttggcagttctgattctatctcctggtaccaacaacacccaggcaaacgccccaaactcaataatttatgacgtcaatcgttcgcccctcgagggtttctcatcgcttctctggctcaaatctgcaacaccggcctccctgaccatctcgnggctcgagtctgaggacgaggctgattacttctgttgtctcgttgggacaacgttacgtgtttcggtttgggttgttcgggacgggtacgggtaccgtaagttcgacccgtcgtaacggtcacggtacccgaaggcctaccggtcccctcggtccacttccgtcgttcccccg

SEQ ID NO: 283654 - DNA, 592 bp, Homo sapiens
  misc_feature: GYAE6OF02IQV00.47.85.H08.1.454.CMB.1.raw
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagagctcacgtacacgaccggtgctcgatttagtatcactcagtcgcgggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctgggtggaggtcggggggagcgtggtccagcctgggacgtccctgagactctcctgtgcagcctctggccttcaccttcaataattatgctatgcgaggtcggggtcccgccgagggcctccgaggcgaaggggctaggaggtggggtggcggtnatacncgtcagtggacattcttcgagttatacgcagtacctcccgtggacggggccgattccacctatcctccaagacgacctaacttacccaagaacctacggtctactctcgcaccctagacccagcctagaacgaaacctcgaaccgaacgaccgttaccttcccgttaccttaaccttacgtcggtacggaccggtaaggtaaggtacggttacggaacggtacgttatacgg

SEQ ID NO: 283655 - DNA, 538 bp, Homo sapiens
  misc_feature: GYAE6OF02GXDGW.47.85.H08.1.454.CMB.1.raw
  modified_base (299)..(299): a, c, t, g, unknown or other
  misc_feature (299)..(299): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccncaggcctccgaggcaaggggctagaggtgggtggcggtcatatcgtccagtggacatcttcagtattacgcagacctcccgtggacggggccgattcacctatcctcagacgacaacttcccaagaaccacggtactatctcgccaccgtagacccagcctagaacgaactcgacgactacgtctacctactaccgtctgtcgcgaagagtaggttcgacgtacgtactagttgtacgg

SEQ ID NO: 283656 - DNA, 766 bp, Homo sapiens
  misc_feature: GYAE6OF02JJ5YJ.47.85.H08.1.454.CMB.1.raw
  modified_base (223)..(223): a, c, t, g, unknown or other
  misc_feature (223)..(223): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggcagttctgattctatctcctggtaccaacacaccaggcaaacgccccaaactcataattatgacgtcaatcgttacgcccctcgtacggggtttctcatccgtctttactcgtcggtcctaccgtaaactcgttaggacctaaccgtaacccggtcccttaccccttcggaaccctactttcccgttaccgttccggggtaccctttccgggaacgtttccgttacgggtaacggggtaaccggtacgggtcctttaacgggtaacttttaacccgttttcgttcggttttacggcctttaccggtttcgggggtaccctaaaaccgtttacccgtttgggtttaccgggtttttgggttaccgggttttcggggaccggggtaacggggtaacccgtaacggtttacggtaaccccggtttcccggtaacgggtttaccgaaccgggtcccccgtaaacgggtcccgttccggttacccccccggttcgggttccctaacccgtttccgttcccggtttaacccccccg

SEQ ID NO: 283657 - DNA, 533 bp, Homo sapiens
  misc_feature: GYAE6OF02H68Z6.47.85.H08.1.454.CMB.1.raw
  modified_base (394)..(394): a, c, t, g, unknown or other
  misc_feature (394)..(394): n is a, c, g, or t
  modified_base (460)..(460): a, c, t, g, unknown or other
  misc_feature (460)..(460): n is a, c, g, or t
  modified_base (516)..(533): a, c, t, g, unknown or other
  misc_feature (516)..(533): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacaccagcaaacgccccaaactcataatttatgacgtcaattgttccgcccctcgtaggggtttcctcatcgtcttctcgtggcctaccaaatctggacaacgaccggccctccctgaccatcctcgtgggcctcggagtcctggaggacggaggctgactttacttcgtgttcgacttcgttggacaacttatgttcggtttggtgttcggnggacggacctaagttcgaccgtcgtaggtcacgaccgaagctcgccccgtcgtcactctcgtcccnccctcctctacgtcgactctcgtgacggcggcgtcggacgaacggccacgatacgnnnnnnnnnnnnnnnnnn

SEQ ID NO: 283658 - DNA, 503 bp, Homo sapiens
  misc_feature: GYAE6OF02HR0C5.47.85.H08.1.454.CMB.1.raw
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (425)..(425): a, c, t, g, unknown or other
  misc_feature (425)..(425): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggcctccaggcaaggggctaggagtgggtggcggtcagtatcgtccagtggacatcttcagtatacgcagctcccgtgacggggccattcaccntctcaganacaatccagacacgtctatcngcactcgaccagcctgacgaactgacacacctctcctctactactgtcgcgacgagtacgtgacgagtctagttgtag

SEQ ID NO: 283659 - DNA, 601 bp, Homo sapiens
  misc_feature: GYAE6OF02JWBU4.47.85.H08.1.454.CMB.1.raw
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
  modified_base (378)..(378): a, c, t, g, unknown or other
  misc_feature (378)..(378): n is a, c, g, or t
  modified_base (408)..(408): a, c, t, g, unknown or other
  misc_feature (408)..(408): n is a, c, g, or t
tcagagctcacgtacacgaccggtgctcgatttagtatcactcagtcgcggggggtcgtcgaggaggcagcgcgtctcaggacatctccaccatggcctgggctctgctgctcctcaccctcctcacctcagggcacagggtcctgggcccagtctgccccgatcagcctgcctcgtgtctggtctccgtggaccagtcgatcaccntcncctgccactggaaccngtagtgtacgttggcaggttctgattcatctctgaccanaacaccagcaacnccccaancatatangactnaactgttcaccctcgtacgggttcactatcgtcttctctggcctcaaatctgcaacnccggacctcctacgactatccgtntcgggtctacgtagtccgtagcgggtaccnggtcttaggtactttacgttctcgtttgaccttcggtttgggaccttaacgttaccgtgggtttacggttttcggggtcgtttccgggacggtaccgggtataacgggtttcaccggttccgtaaacgggtctaaggcccccgtaagtccctcccggtccccttcggttactccgttacgtccggttcccccg

SEQ ID NO: 283660 - DNA, 547 bp, Homo sapiens
  misc_feature: GYAE6OF02HLJMR.47.85.H08.1.454.CMB.1.raw
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaaccagtagtgacgttggctagttctgattctatctcctggtaccaacaacaccaggcaaagccccaaactcataattangacgtcaatgttcgccctnagggtttctcatcgcttctctgctcaatctgcaacacgcctccctgaccatctctggctcgagtctgaggacgagctgtatttacttcttgttgctcgttgggctaacttacgtgttcggttttgggtgttcgggcggtagggacctaaggttcgaccggttccgtaaggtccacggacccgtaaggcctccgcccccgtcggtccaccgttccgttccgttaccccc

SEQ ID NO: 283661 - DNA, 550 bp, Homo sapiens
  misc_feature: GYAE6OF02HGFPH.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacaccaggcaaacgccccaaactcataatttatgacgtcaatgttcgcccctcagggtttctcatcgcttctctgctcaaatctgacaacacgcctcctgaccatctctggctcgagtctgaggacgaggctgtacttacttctgttgtctcgttggcctaactacgttgttcggtttgggttggttcgggcgggtagggaccgtaggttccgaccgtaccgttaggtcacggtcccaaggcctccggcccccgtcggtacctacgttccgtcgttccccccg

SEQ ID NO: 283662 - DNA, 641 bp, Homo sapiens
  misc_feature: GYAE6OF02FMURR.47.85.H08.1.454.CMB.1.raw
  modified_base (258)..(258): a, c, t, g, unknown or other
  misc_feature (258)..(258): n is a, c, g, or t
  modified_base (328)..(328): a, c, t, g, unknown or other
  misc_feature (328)..(328): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagcttgggttttcctcgttgctcttttaagaggtgtccagtgtcaggtgcgcctggtggaggtcggggggaggcgtggtccagcctgggacgtccctgagactctcctgtgcagcctntggcttccaccttcaaataattatgctatgcaggtcgggtccgccaggctccgaggcgaaggggctaggnggtgggtggcggtcatatccgtccaggtggactattcttacgaagttattacggcaagtacctcccgtagggacggggcctattaccaacctatcctccgaaggacgaacctaaacttaccccgaacgaaaccgtacggttaccttaactccgttacgaccctacccttacgaaccctacggcccttaaggaacgtaaccgttacggaaaccgaaccgtaccgttaccttaccttaccttaaccttacgttcggtcggaccggaaggtaacggtaggttacggacggtacgttagtaacgtttggtaggtacg

SEQ ID NO: 283663 - DNA, 524 bp, Homo sapiens
  misc_feature: GYAE6OF02G0ZZ8.47.85.H08.1.454.CMB.1.raw
  modified_base (224)..(224): a, c, t, g, unknown or other
  misc_feature (224)..(224): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggcagttctgattctatctcctggtaccaacaacacccaggcaaagcccccaaactcataatttatgacgtcaatgttcgcccctcaggggtttctcatcgcttctctgctcaaatctggcaacacggcctccctgaccatctctggctcgagtctgaggacgaggctgtattaccttctgttgctcttgggctaactactgttcgtttgggtgtttcggcggtaggacctagttcgaccgtcgtaggtcacggcccaaggctcgccccgtgtccactctcgttccccg

SEQ ID NO: 283664 - DNA, 576 bp, Homo sapiens
  misc_feature: GYAE6OF02IVOAQ.47.85.H08.1.454.CMB.1.raw
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgatcagcctgccctccgtgtctgggtctcctggacagtcgatcaccatcctcctgcactggaaccagtagtgacgttggctagttctgattctatctctggtaccaacgaacaccaggacaaacgccccaaatccataattatgacgtacaatgttccgccctcgagggtttctcatcgcttctctgctcaatctgcaacncgcctccncgacatctcgtcggctcgngtcngaggacgaggctgtactttacttctagttgtctcgttcgggactaaacgttcgtagttcggtttcggttggtttccggacgggtacgggtacgtaaggttacgtacccgttaccggtacggttacgacgtacccgtaaggcccgtaccgtccccgtggtacccacgttccgtcgtttacccccg

SEQ ID NO: 283665 - DNA, 621 bp, Homo sapiens
  misc_feature: GYAE6OF02FYN26.47.85.H08.1.454.CMB.1.raw
  modified_base (224)..(224): a, c, t, g, unknown or other
  misc_feature (224)..(224): n is a, c, g, or t
tcagagctcacgtacacgaccggtgctcgatttagtatcactcagtcgcgggggggtcgtcgaggaggcgagcgctctcaggacatctccaccatggcctgggctctgctgctcctcaccctcctcactcaggcacaggtcctgggcccagtctgccccgactcagcctgcctccgtgtctgggtctcctggacagtcgatcaccatctcctgcactggaaccngtagtgacgttggcagttctgattctatctctgtaccaacaacaccagacaaacgcccccaaaactcaataatttatgtactactaatgttaccgcccctgtacgggtttctacatcgctttctctcggcctaccaaactcgtaggacaaccgtcccggacccttcccgtcgtaccatcctacgtcgggtaccttcgagttccgtgacgggacgacggctggttaattccgtttcttgttgtctcgttagggtacctaacttacgttcggttgttttcggggttgttccggcggggttacggacgtaaggttcgtacccgtacgtcgggttacaccgggtacccgaacggtcgtccggccccccttggtaccctaccgtttacctccgttacccccc

SEQ ID NO: 283666 - DNA, 536 bp, Homo sapiens
  misc_feature: GYAE6OF02FGMU2.47.85.H08.1.454.CMB.1.raw
  modified_base (225)..(225): a, c, t, g, unknown or other
  misc_feature (225)..(225): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccngtagtgacgttggcagttctgatctatctctggtaccacaacaccaggcaagcccccaaatcataatttatgacgtcaatgttccgccctcagggtttcncatcgcttctctggctcaatctggcaacacggcctcctgaccatctcngggtctcgagtctgacggacgaggctgtattacttctgttgctcttgggcacgttactgttcgtttgggtgttccggagggacggtacctaaggttcgaccgtcgtacggtcacgcccgaggtccgtcggtcccccgtcggttccacgttctccgttaccccc

SEQ ID NO: 283667 - DNA, 512 bp, Homo sapiens
  misc_feature: GYAE6OF02HD03S.47.85.H08.1.454.CMB.1.raw
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (406)..(406): a, c, t, g, unknown or other
  misc_feature (406)..(406): n is a, c, g, or t
  modified_base (459)..(459): a, c, t, g, unknown or other
  misc_feature (459)..(459): n is a, c, g, or t
  modified_base (469)..(469): a, c, t, g, unknown or other
  misc_feature (469)..(469): n is a, c, g, or t
  modified_base (489)..(489): a, c, t, g, unknown or other
  misc_feature (489)..(489): n is a, c, g, or t
tcagagctcacgtacacgaccggtgctcgatttagtatcactcagtcgcggggggggtcgtcgaggaggcagcgctctcaggacatctccaccatggcctgggctctgctgctcctcaccctcctcactcagggcacagggtcctgggccagtctgccccgatcagcctgcctccgtgtctgggtctcctggaacagtcatccaacatctcctgacactggaaaccagtagtgacgttggcagttctgattctatctctggtaccaaacaacacccgaaggcaaaacgaccccaaactcaataattatgtactacaatcgttcgaccctcgtagggttctnacgtcncttctctgctacaaatctggacaacacggcctccctgaccatcgtctcgggctcgagtntcgagacgaggctgattatctgttgctctggcaagtctgtcgttgtgttcggngaggacagtnaccgtctagcagccgaagcncgccccgtgtcactctgtccccg

SEQ ID NO: 283668 - DNA, 550 bp, Homo sapiens
  misc_feature: GYAE6OF02HCLT1.47.85.H08.1.454.CMB.1.raw
  modified_base (224)..(224): a, c, t, g, unknown or other
  misc_feature (224)..(224): n is a, c, g, or t
  modified_base (392)..(392): a, c, t, g, unknown or other
  misc_feature (392)..(392): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggctagttctgattctatctcctggtaccaacaacacccaggacaaacgacccccaaactcaattaatttatgacgtcaatcgttcgcccctgtacgggtttctcatcgcttctctgctcaatctgcaacacgcctcctgaccatctcgtggctcgngtcgtgaggacgagtctgtattacttctgttcgtctcttgggcctaactacgtgttcggtttgggtgttcggcggagggtacctaggttcgaccgtcgtacggtcacggtacccacggtctccggtcccccgtcggtccaccttcgtccgtttccccg

SEQ ID NO: 283669 - DNA, 616 bp, Homo sapiens
  misc_feature: GYAE6OF02IV6AG.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctggtaccaacaaccaccaggcaaacgcccccaaactcataatttatagacgtcaatgttccgcccctcgtaggggtttctcatccgtcttctctggcctacaaatctgacaacgcgcctcctcgaccatctcgtcgggctacgtagtcgtgacggaacggacggtcttaggatttccgttatcgtttcgtccttcgttcgggactaaccttacgttgggtttcggttttggggttagttcccgggtagggtaacgggtaaccgtaaggttcggtacccggttccgttagggtccaaccggtcccgaacggtccgtacccggtccccgtcggtccctaccggttccgtccggttccccccg

SEQ ID NO: 283670 - DNA, 538 bp, Homo sapiens
  misc_feature: GYAE6OF02IGCSF.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaaacgccccaaaactcaataaatttatgacgtcaatgttcgcccctcaggggtttctcatcgcttctctggctccaaatctggcaacacggcctccctgaccattctctgggctcgagttctgaggacgaggctgtattacttctgttgtctcgttgggacctaactctggtttcgttttggggtgtttcgggcggacgggacctaagttcgaccggtctaggtcagcccaaggctcgccctcggtcactcctgttcccc

SEQ ID NO: 283671 - DNA, 823 bp, Homo sapiens
  misc_feature: GYAE6OF02IS7M9.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtcctgggtctccgtggacagtcgatccaccatcctcctgacactggaaacctaggtagtggacgttggcctagttctgacttctatctcctggtaaccaacaacaccaggacaaacgccccaaactctaattaatttactgaaccgtactaattcgttaccgcccgttcgtacgggtttcctacgtactccgtcttctcgttcggcctaacctaaagtccgtacggacctaaccgtaccggtccctacccgtacggaccctattcccgttcggtacgggtcctaccggtacgttccgtacgggaacgggttaaccggacggtaccgtttacggttaaacgtttttacccgtttacggtttcggtttccgttaccgtttaccgggtttacggggtaaaccctttaaacccggttttaccggtttacggggttttacccgggttttttcggggggttaccggggttttacccggggaacccgggggttaaaccgggggtaacccgtttaaagggtttccccggggtaaccccggttttaaccggttaacgggtttacccgaaccgggtaacccccgtaaggggttcccttacccgggaccccccgtttcgggtaccctaccgttcccggtttacccggttccccccgg

SEQ ID NO: 283672 - DNA, 588 bp, Homo sapiens
  misc_feature: GYAE6OF02HPE18.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatccaccatcctcctgcactggaaccagtagtgacgttggctagttctgattctatctcctggtaccaacaacacccaggcaaacgcccccaaactcataattatgacgtcaatgttccgcccctgtagggtttctcatcgtcttctctgctcaaatctggacaacacgcctccctgaccatctcgtgggctcgagtcgtgaggacgaggtctgtactttacttcttgttcgccttcgttgggacctaacgttacgtgttcggttttgggttcggtttcgggcggtacgggtacctaaggttcgacccggtttccgtacgggtaccgacggacccgtaaggccttccggtcccccgttccggttccaccgttccgttcccgttaccccc

SEQ ID NO: 283673 - DNA, 525 bp, Homo sapiens
  misc_feature: GYAE6OF02FZEHH.47.85.H08.1.454.CMB.1.raw
  modified_base (419)..(419): a, c, t, g, unknown or other
  misc_feature (419)..(419): n is a, c, g, or t
  modified_base (453)..(453): a, c, t, g, unknown or other
  misc_feature (453)..(453): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaatcataatttatgacgtcaatcgttcgcccctcgaggggtttctcatcgtcttctctggctccaaatctggcaacacgcctcctgacctatctctgggctcgagtctgaggacgagctgattacttctgttnctcgtggcactacgtgttcggttggttgttcggnggaggacgtagttcgaccgtcgtaggcacgccgaagctacgccccgttcggtcaccttccgtcgttcccccg

SEQ ID NO: 283674 - DNA, 549 bp, Homo sapiens
  misc_feature: GYAE6OF02JF8PX.47.85.H08.1.454.CMB.1.raw
  modified_base (224)..(224): a, c, t, g, unknown or other
  misc_feature (224)..(224): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (413)..(413): a, c, t, g, unknown or other
  misc_feature (413)..(413): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggctagttctgattctatctcctgtaccaacaacacccaggcaaacgcccccaaactcaataatttactgacgtcaatcgttccgcccctcgtagggtttctcatcgcttctctgctcaaatctggcaacncgcctccctgaccntctctgggctcgngtctgacggacgagctagtnttacttcgttgtcgtcttcgttggactaactctgttcggtttgggtcgttcgggcggtacggtaccgtagttcgtaccgtcgtacggtccacgtacccaggccgtcgccccgtcggtctacgtccttcgtcccccg

SEQ ID NO: 283675 - DNA, 572 bp, Homo sapiens
  misc_feature: GYAE6OF02IS5BE.47.85.H08.1.454.CMB.1.raw
  modified_base (364)..(364): a, c, t, g, unknown or other
  misc_feature (364)..(364): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctggtaccaacaacaccaggcaaacgccccaaactcataatttatgtacgtcaatgttccgccctcgtagggtttctctatcgtcttctctgctacaatctgacaacncgcctcctacgaccatctcgtggctacgagtcgtggacggacgagtctagtatttacgttctgttcgtctcgttgggactaacttacgtcggttcggttttggggttcgtttcggggtacggtacgggtaccgtagttcggtaaccggtcgttacggtcgacgtcccgaaggtccgtccgccccgttcgtcgacttccgtcgttcccc

SEQ ID NO: 283676 - DNA, 532 bp, Homo sapiens
  misc_feature: GYAE6OF02G0CUX.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctgttgctcttttaagaggtgtccagtgtcaggtgcgcctggtggagtcgggggagcgtggtccagcctgggacgtccctgagactctcctgtgcagcctctggcttcaccttcaattaattatgctatgcaggtcgggtccgccaggcctccgaggcgaaaggggctaggaggtggggtggcggtcatatcgtccagtggactagtcttcagttacttacgcagtacctccctggacgggccattcaccatctaccagacgacaacttcccaagacacgtctactctcgccacctcgaccacgcctagaacacgtacgacgactacgtcctactactactacgtgtacgcgagacgtagtgacgtagtctag

SEQ ID NO: 283677 - DNA, 507 bp, Homo sapiens
  misc_feature: GYAE6OF02F2USB.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggaggcgtggtccagcctgggacgtccctgagactctcctgtgcagcctctggcttcaccttcaataattatgctatgcagtgggtccgccaggctccaggcaaggggctaggagtgggtggcggtcatatcgtccagtggacatcttcagtattacgcagctcccgtgacggggccattcaccatctcagagacaatcccagaacacggtctactctcgcacctgaccagcctagacgaactgacgacacgtctctctactctgtcgcgagagagttgacgtagtcagttgtacgg

SEQ ID NO: 283678 - DNA, 523 bp, Homo sapiens
  misc_feature: GYAE6OF02FGMU5.47.85.H08.1.454.CMB.1.raw
  modified_base (333)..(333): a, c, t, g, unknown or other
  misc_feature (333)..(333): n is a, c, g, or t
  modified_base (362)..(362): a, c, t, g, unknown or other
  misc_feature (362)..(362): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgcccccgactcagcctgcctccgtgtctgggtctcctggacagtcgatcaccatcctcctgcactggaaccagtagtgacgtttggcagttctgattctatctcctggtaccaacaacacccaggcaaagcccccaaactcataatttatgacgtcaatgttcgccctcagggttttcncatcgcttctctggctcaaatctgcaacncggcctcctgaccatctctgggctcgagtctgaggacgaggctgattacttctgttgctcttgggcaactctgtcgtttggtgtcgcggagaccagttcgaccgtcgtaacggtccacgtcccgaaggcctcgccccgtggtccacttcgtcgttcccccg

SEQ ID NO: 283679 - DNA, 521 bp, Homo sapiens
  misc_feature: GYAE6OF02HD5BK.47.85.H08.1.454.CMB.1.raw
  modified_base (279)..(279): a, c, t, g, unknown or other
  misc_feature (279)..(279): n is a, c, g, or t
  modified_base (305)..(305): a, c, t, g, unknown or other
  misc_feature (305)..(305): n is a, c, g, or t
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
tcagagctcacgtacacgaccggtgctcgatttagtatcactcagtcgcgggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggagcgtggtccagccgtgggacgtccctgagactctcctgtcgcagcctctggcttcaccttnaatattatgctatgcagtcgggtccnccaggcctaccgaggcgaaggggctagaggtgggtggcgtnatntcgtcagtgacatcttacagttatacgcagtctcctggacgggctagttcacactctcagacacaacttccaagaccacgtactatctagcctaccgtcaccacgcctagacgaagtcgacgaccgacgtctacgtctactactgacgcgtagagtagtgacgtgtatacgg

SEQ ID NO: 283680 - DNA, 589 bp, Homo sapiens
  misc_feature: GYAE6OF02GIZMC.47.85.H08.1.454.CMB.1.raw
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctcctggacagtcgatcaccatctcctgcactggaaccagtagtgacgttggcagttctgattctatctcctggtaccaacaacacccagcaaacgccccaaactcataattangacgtcaatgttcgcccctntacggggtttctcatcgtcttctctggctacaaattctggacaacacggccctcctcgaccatctcgtggctcgagtctgaggacgaggctagtatttaccttcttgttgcttcgttgggctaaccttacgttgttcggttttcgggttggtttccgggcgggtaacggggtacctaggtttcgaccggttccgtaacggtccgacggtcccgtaacgggtcgtccggtcccccgttccgggtcctaccgttccgtaccggttccccccgg

SEQ ID NO: 283681 - DNA, 600 bp, Homo sapiens
  misc_feature: GYAE6OF02HPAZX.47.85.H08.1.454.CMB.1.raw
  modified_base (245)..(245): a, c, t, g, unknown or other
  misc_feature (245)..(245): n is a, c, g, or t
  modified_base (363)..(363): a, c, t, g, unknown or other
  misc_feature (363)..(363): n is a, c, g, or t
tcagagctcacgtacacgaccggtgctcgatttagtatcactcagtcgcggggggggtctcaggaggcagcgctctcaggacatctccaccatggcctgggctctgctactcctcaccctcctcactcagggcacagggtcctgggcccagtctgccccgactcagcctgcctccgtgtctgggtctcctggacagtcgatcaccatctcctgcactggaaccagtagtgacgttggctagttcngattctatctcctggtaccaacaacacccaggcaaacgccccaaactcataatttatgacgtcaatcgttcgcccctgtagggtttctcatcgcttctctggctcaaatctgacaacncgcctcctgaccatctctcggctcgacgtctgacggacgaggctgatttaccttcttgtttacctcgttagggcctaacgttcgttggttcggtttggggtcgtttccgggcgggtaacgggtacctaaaggttcgtaccgttaccgttaggtaccaggtacccaaggtcccgtaccggtccccccgttcggtaccctaccgtttccgttacccggttcccccgtccctttaccccg

SEQ ID NO: 283682 - DNA, 500 bp, Homo sapiens
  misc_feature: GYAE6OF02HCE7T.47.85.H08.1.454.CMB.1.raw
  modified_base (235)..(235): a, c, t, g, unknown or other
  misc_feature (235)..(235): n is a, c, g, or t
  modified_base (424)..(424): a, c, t, g, unknown or other
  misc_feature (424)..(424): n is a, c, g, or t
  modified_base (485)..(500): a, c, t, g, unknown or other
  misc_feature (485)..(500): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctnaggggtttctcatcgcttctctggctccaaatctggcaacacggcctccctgaccatctctgggcctcgagtctgaggacgaggctgatttacttctgttgctcttggcaactctgttcgtttgggtgttcgggcggagggacctaagttcgaccgttctaggtcacgcccaaggctcgcccctggtcnctctcgttcccaccctcctctacgtcgactcctctgacgcgggctggacaggcgacagtgnnnnnnnnnnnnnnnn

SEQ ID NO: 283683 - DNA, 509 bp, Homo sapiens
  misc_feature: GYAE6OF02FTYW9.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccagtagtgacgttggcagttctgattctatctctggtaccaacaacacccaggcaaagcccccaaatcataatttatgacgtcaatgttcgcccctcaggggtttctcatcgcttctctgctccaaatctggcaacacggcctccctgaccatctctcgggctcgagtctgaggacgaggctgtattacttctgttgctctggcactctgtcgttggtgtcggcggaggacagttcgaccgtcgtaggtcacgccgagctcgccccgtggtccactctcgttccccg

SEQ ID NO: 283684 - DNA, 518 bp, Homo sapiens
  misc_feature: GYAE6OF02ILF4X.47.85.H08.1.454.CMB.1.raw
  modified_base (499)..(499): a, c, t, g, unknown or other
  misc_feature (499)..(499): n is a, c, g, or t
  modified_base (504)..(518): a, c, t, g, unknown or other
  misc_feature (504)..(518): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctcctgaccatctctgggctcgagtctgaggacgaggctgatttacttctgtttgctcgttgggactaactactgtcgtttgggtgtttcggcggaggtaccaaggttcgaccgtcgtaggtcacgcccgaagccgtcgccccgtggtcaccttcgtcgttcccacccttcctactacgtcgatctcgtgacgcggtcgtcggcaacggcgacagtagntacgnnnnnnnnnnnnnnn

SEQ ID NO: 283685 - DNA, 797 bp, Homo sapiens
  misc_feature: GYAE6OF02JB2DS.47.85.H08.1.454.CMB.1.raw
  modified_base (198)..(198): a, c, t, g, unknown or other
  misc_feature (198)..(198): n is a, c, g, or t
tcagagctcacgtacacgaccggtgctcgatttagtatcactcagtcgcggggctggggtctcaggaggcagcgctctcaggaccatctccaccatggcctgggctctgctgctcctcaccttcctcactcaggcacagggtcctgggcccagtctgcccccgactcagcctgcctccgtgtctgggtctcctggacngtcgatcaccatctcctgccactggaaccagtagtgacgttgcagttctgatctatctcctggtaccaacaacaccagacaacgccccaaatcataattatgacgtcaatcgttccgccctacgtacgggtttctctactccgtctttacgtcgtcggtactaccgtaaacttcgttacggaccaaacgtaccccgggtccccgtttacccctacggtaaaccccctactttacccttccgggtttaccgggggtcccgtttcccgggacggttttacccgagggttaaaccgggaccgggtaaccgggttcgttacgggttaactttttaacccgtttcgtttcggtttaccggtccgttaccggtttacggggacccttaaaccgtttaacggtttcgggttttacccggggttttgggggttaccggttttccggggaccggggttaaccggggtacccgtttaagggttccccggttaacccgggtttacccgtttaacggggttacccgttaaccgggtaaccccggtaacgggttaccccgtttacccgggtcccccccggtttacgggttaccctacccgttttcccccggg

SEQ ID NO: 283686 - DNA, 718 bp, Homo sapiens
  misc_feature: GYAE6OF02G5B40.47.85.H08.1.454.CMB.1.raw
  modified_base (174)..(174): a, c, t, g, unknown or other
  misc_feature (174)..(174): n is a, c, g, or t
tcagagctcacgtacacgaccggtgctcgatttagtatcactcagtcgcggggtcgtgggagaggagccagcactggaagtcgccggtgtttccattcggtgatcagcactgaacacagaggactcaccatggagtttgggctgagctgggttttcctcgttgctcttttaagnggtgtccagtgtcaggtgcgcctggtggaggtcgggggaggcgtggtccaggccgtgggaccgtcctggagtacctcgtcctgtgacagcctcgtggtcttacaccttcaaattattatgactagtgtcgaggtcgggtaccgccaggcctaccgaggccgaaggggctaaggcggtggggtcggcgtacagttacgccgttcgagttcgggacttatccgtttacgaagttacttaccggataacggtacccttcccggtagggaacggggtcccgtaacgtttccgaacctacgttacctacccgaaggtaaccgaacgttaaccgttcccgaaaggttaaacccgtaccgggttaccttaagtccgtttagacccgtacccgttagggacccctacggtaccctggtaaacgtaaccgttacgggaaacgtaacccgtaccgttaccgttacttaacccgttaacgttaacccggttggtaccggtacggaaggtacgttaacgggttcgaaaccggtcgttacgttacgttcggtaacgg

SEQ ID NO: 283687 - DNA, 743 bp, Homo sapiens
  misc_feature: GYAE6OF02JBXPJ.47.85.H08.1.454.CMB.1.raw
  modified_base (693)..(693): a, c, t, g, unknown or other
  misc_feature (693)..(693): n is a, c, g, or t
  modified_base (741)..(741): a, c, t, g, unknown or other
  misc_feature (741)..(741): n is a, c, g, or t
tcagagctcacgtacacgaccggtgctcgatttagtatcactcagtcggccggggtacctacgggcccagtccttcgccccgactacaccgcctgccctccgtagtcctacgggtctccgtggacacgtcggaatcaccctatttcgtcctgcactggaaccagtagtgacgttggccagttctgtattctatctcctgggtaccaacaacacccaggacaaacggcccccgaaaactcaattaatttactgtaccgtcaaatgttccgtcccctcgagggtttcctcacttcgctttactctcggctaccaaactcgttggcaaccgaccggcccctccccgtacggaacctattccgtcgttcgggccgtcggagttcgtggacgggtacggagggccttacggtaactttaacgttcttaggttgtccttcgtacgggtactaaaccgttttacgtggtttaccggttttgggttcggtttaccgggaccggggttaagggacccgtaaagggttccggaacccgttccgtaacggttccggaaccggtacccgaaacgggtcctaccggtacccccgttggtacccgtacgttccgttccgttcccgtacccgtttaccgttacggttacgacgtacctcgtacggacggtccgggtcgtcggtacgacggtccgcgtacgtaacggtnacgtcgacacggtcgacgtcgtacgtctacgcgcgacgcgacgtcgcncg

SEQ ID NO: 283688 - DNA, 632 bp, Homo sapiens
  misc_feature: GYAE6OF02JWJX3.47.85.H08.1.454.CMB.1.raw
  modified_base (234)..(234): a, c, t, g, unknown or other
  misc_feature (234)..(234): n is a, c, g, or t
  modified_base (610)..(611): a, c, t, g, unknown or other
  misc_feature (610)..(611): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
  modified_base (625)..(625): a, c, t, g, unknown or other
  misc_feature (625)..(625): n is a, c, g, or t
  modified_base (627)..(627): a, c, t, g, unknown or other
  misc_feature (627)..(627): n is a, c, g, or t
  modified_base (630)..(632): a, c, t, g, unknown or other
  misc_feature (630)..(632): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccagcaaagcccccaaactcataatttatgacgtcaatgttcgcccctnaggggtttctcatcgcttctctgctcaaatctgcaacaccggcctcctcgaccatcctcgtcgggctcgtacgtcgtggaggacaggctagtactttacttctgtttcgcttcgtggacctaaccgttcttcggttcggttttagggttcgtttcggggaccgggtagggaacctaaggtttccgaacccgttccggtagttccgaacgtccccgtaacggtccgttcccgacccccgttcggttacccgtaaccgttcccgttccgttacccccttaccccgttcccttaccgttaccggttcgacgttccttcgtcggtacggccgggtaccgtcgggtaccaacgggccgtacgtaaacgtcgtacgcagcgnngcnctacgngctcngnctnnn

SEQ ID NO: 283689 - DNA, 721 bp, Homo sapiens
  misc_feature: GYAE6OF02GL79L.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacacgggtcctgggcccagtctgccccgactcagcctgcctccgtgtctgggtctccgtggacagtcgatcaccatcctcctgcactggaaccagtagtgtacgttggctagttctgattctatctcctgtaccaacaacaccagaccaacgccccaactcataattatcgacgtacaattcgttccgccctcgtacgggtttctcgtactcgtcttctcgtcgcctacctaacttcgtacggacaaccgtaccggtcccttcccgtacgaccctacttaccgttaccgtcgggtcctcggtacgttccgtaggacgggtacgacggtctaggtaactttacgtttcgtagtttcgtccgtttcggttacgggtacctaaccgttacgttcgtttacgggttttcgggtttacggttccggggtaccgggtaacgggtaacccgttaagggtttacccggtacccggttaccgggtttaacggggtacccgtaacccgggtaaccccggtaacggttaccccggttcccggttacccccggttaccggttacccttaccccggttccgtttaccccgtttacccccccg

SEQ ID NO: 283690 - DNA, 694 bp, Homo sapiens
  misc_feature: GYAE6OF02GZGXH.47.85.H08.1.454.CMB.1.raw
  modified_base (308)..(308): a, c, t, g, unknown or other
  misc_feature (308)..(308): n is a, c, g, or t
tcagagctcacgtacacgaccggtgctcgatttagtatcactcagtcgcggggggggtctcaggaggcagcgctctaaggacatctccaccatggcctgggctctgctgctcctcaccctcctcactcagggcacagggtcctgggcccagtctcgccccgactcagcctgcctcgtgtctgggtctccgtggacagtcgatcaccatctcctgcactaggaaccagtagtgtacggttggctagttctgattctatctcctggtaccaacaaccacccagacaaacgaccccaaactcataatttangtacgtacaattcgttccgcccctcgtacggggtttcctcgattccgtctttctcgtcggtacctaccaaacttcgtacgacaaaccgacccggtcccttccctacgaaccctacttccgttacgtcgggtaccttcggtacgttcgtaggaacgggtaccggacgggtccgtacggttaacttttaccgtttcgtttcggttacgtccgtttcggttacgggtaccttaaccgttaccgtttcgggtttaccgggttttgggtcgggtttcgggacggggtacggtaaccgttaggttaccgtacccgtccgtagggtccaaccggtccgtaacggtccgtcccgaccccgttcggtacctaccgtcttcccgttccctaccccg

SEQ ID NO: 283691 - DNA, 573 bp, Homo sapiens
  misc_feature: GYAE6OF02F9X1F.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctgtaccaacaacacccagcaaacgccccaaactcataattatcgactacaatcgttccgcccctcgtacgggtttctctactcgtcttctctgctacaatctgacaacacgcctcctgaccatcctcgtcggctcgagtcgtgacggacgagctagtattacttcttgttcgtcgttcgttagggactaacgttcgttgttcggtttgggttcgttccgggaggtacgggtacgtagttcgacccgttcgtacggtacacggtacccgaacggtccgtccgtccccgttcgtcctaccgttccgtccgttcccccg

SEQ ID NO: 283692 - DNA, 547 bp, Homo sapiens
  misc_feature: GYAE6OF02FIU8W.47.85.H08.1.454.CMB.1.raw
  modified_base (227)..(227): a, c, t, g, unknown or other
  misc_feature (227)..(227): n is a, c, g, or t
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtctccgtggacagtcgatcaccatcgtcctgcactggaaccngtagtgacgttggcagttctgattctatctcctggttaccaacaacacccaggcaaagcccccaaactcataatttangacgtcaatcgttcgccctcgacggggtttctnatcgtcttctctgctccaaatctggcaacgacggcctccctgaccatctcgtggctcgagtcctggacggacgagctagatttacttgtgttgcttcgttgggacaacgtactgttcggtttgggtcgttcggcggtaggacctagttgaccgtcgtaggtccaggcccgtaaggccgtcgtccccttggtcctctcgtcgttcccccg

SEQ ID NO: 283693 - DNA, 644 bp, Homo sapiens
  misc_feature: GYAE6OF02G87CB.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcgagggcacgagggtcctcgggcccagtctcgccccgactcagcctcgcctccgtgtcgtgggtctccgtggacagtcgatcacatctctgcacgtggaacctagtagtcgacggttggctagttctgtattctactctcgtacgtaaccaacaacaccgaggaccaaaccgaccccaaactactaattaactttacgtacgaaccgtactaacgttcgttcccgtcccgttacggttacgggtttctactcgttcgtcctttcgtcgtcggtcctaacctaaactcgtacggacctaaccgaccggtccctacccgtactacctactccgtacgtcgggtactcggtacgtcgtacggaacggacggacgtcttagtactttacgttgttgttcgtctcggttacggactaacgttcgtggtttcggttcgggtcgtcgggacggtacgacgtacgtcgacgtcgtacgtcgacacggtacgtcgtcccgccgttcgctaccgtcctaccgtcccg

SEQ ID NO: 283694 - DNA, 535 bp, Homo sapiens
  misc_feature: GYAE6OF02G02YV.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggagcgtggtccagccgtgggacgtccctgagactctcctgtgcagcctctggcttcaccttcaataattatgctatgcaggtcggtccgccaggcctccgaggcgaaggggctaggaggtggggtgcgtcatatcgtacgagtggacatcttcaagttattacgcacgtacctccctggacgggccattccaccatcaccagacgactaacttcccaagaacctacggtctatctgacctacctacgaccacgcctagaacgtacagacgactacgtctaccgtactactactgtagcgagacgtagtgacgtagtatag

SEQ ID NO: 283695 - DNA, 529 bp, Homo sapiens
  misc_feature: GYAE6OF02GT3B5.47.85.H08.1.454.CMB.1.raw
  modified_base (225)..(225): a, c, t, g, unknown or other
  misc_feature (225)..(225): n is a, c, g, or t
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (332)..(332): a, c, t, g, unknown or other
  misc_feature (332)..(332): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (455)..(455): a, c, t, g, unknown or other
  misc_feature (455)..(455): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgatcagcctgcctcgtgtctgggtctcctggacagtcgatcaccatctcctgcactggaaccngtagtgacgttggcagttctgattctatctcctggtaccaacaacacccaggccaaagcccccaaactcataatttangacgtcaatgttcgcccctnagggtttcncatcgcttctctggctccaaatctggcaacncggcctccngacctatctcngggctcggagtctgaggacgnggctgattactntgttgcttcgtggcaactctgttcgtttggtcgttcggnggaggacctaaggttcggacccgttcctagggtcctacgcccgaaggtccgtcgccccctggtcctacttcccg

SEQ ID NO: 283696 - DNA, 771 bp, Homo sapiens
  misc_feature: GYAE6OF02JYHXV.47.85.H08.1.454.CMB.1.raw
  modified_base (429)..(429): a, c, t, g, unknown or other
  misc_feature (429)..(429): n is a, c, g, or t
  modified_base (515)..(515): a, c, t, g, unknown or other
  misc_feature (515)..(515): n is a, c, g, or t
tcagagctcacgtacacgaccggtgctcgatttagtatcactcagtcgcgggggggtcgtcgaggaggcgagcgctctcaggacatctccaccatggcctgggctctgctgctcctcaccctcctcactcgagggccacacgggttccctggggccccaaggtcctcggaccccccgacttccgagcccttcggcccttcccggtgtccgtggggttcccttcccgtggaacctggttccgaattccaccctaatcccgtccttcgcctaacgtcgggaaaccctgtacggttacgtaccggttcggggactaggtttccgtgtctttctatcgttcctaggtaacccaacaaccacccaagggaccaaaaccgtaccccccaaatacccgaattaacgttaatcgtaacggtctaacgttacgttccnccccgttacgaacgggttttctccgaattcccggtctttactcgtggccttaccgtaaactcgcgtacaaccgacggtccctaccncgtaactactctcctcgggtactccgagttctacggaggacgtacggtctggtactttacttcgtcggtttacgtcttaacgggttcgggtactaaaccgttacgttcgggttaaccggttttggggtcgttttccggggcgggttaacgggtaccgttaaggttccgggtacccgttacggtaacggttccgtacggtacccgtacggtccgtaccgtccccgttacggtccctacgtccgtttcccggtacccc

SEQ ID NO: 283697 - DNA, 579 bp, Homo sapiens
  misc_feature: GYAE6OF02F3WP5.47.85.H08.1.454.CMB.1.raw
  modified_base (457)..(457): a, c, t, g, unknown or other
  misc_feature (457)..(457): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcctacctttagttcccttctttggattgaatttcggggtcccgcctaggacctccgaaggggaaggggcgtggaggttggggttgcaacataaactccagatggaagtcaaggaaacctagtgtggactctctgacgggccgattcaccatcctaccagagacaacgccaaagacctctctagtttcngacaaagtcggactgactggagtagtcgaagacgacggtctgtagtattaccgtgttgtacttcgtcctgacccggtccgttacgggtacccggtaccgttcggtcccgttggtacccgggg

SEQ ID NO: 283698 - DNA, 527 bp, Homo sapiens
  misc_feature: GYAE6OF02F3XFO.47.85.H08.1.454.CMB.1.raw
  modified_base (224)..(224): a, c, t, g, unknown or other
  misc_feature (224)..(224): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccngtagtgacgttggcagttctgattctatctcctggtaccaacaacacccaggcaaacgcccccaaactcataatttatgacgtcaatgttcgccccttcgagggtttctcatcgcttctctgctccaaatctgcaacacggcctccctgaccatctctggctcgagtctgaggacgaggctgtattacttctgttgctcgttggactaacgtacgtgttcggtttgggttcgttcggcggaggacctagtcgaccgtcgtaggtccagcccaggtctcgccccgtcggtcactcgtcgtcccc

SEQ ID NO: 283699 - DNA, 640 bp, Homo sapiens
  misc_feature: GYAE6OF02G9BA9.47.85.H08.1.454.CMB.1.raw
  modified_base (302)..(302): a, c, t, g, unknown or other
  misc_feature (302)..(302): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatccaccatctcctgcactggaaccagtagtgacgttggcagttctgattctatctcctggtaccaacaacacccaggcaaagcccccaaactcataatttangacgtcaatgttccgcccctctagggtttctcatcgctttctctggcttaccaatctaggccaacaccggcctcccgtgacctactctccgtggcctcgtagtctggacggtacggacggcgtagtactttaacctttcgttaggtttcgccgtttacgttcgggtaccttaaccgtacgtttcggtttcggttttcggggtttaccgtttcggggacggtaacggggtaccgttaacggttacgggtacccggttacgtaccgggtaccgacggtacccgaacggtccgtaccgtccccccggtacggtccctacgttccgttcccgtttccccccg

SEQ ID NO: 283700 - DNA, 594 bp, Homo sapiens
  misc_feature: GYAE6OF02JBLN4.47.85.H08.1.454.CMB.1.raw
  modified_base (409)..(409): a, c, t, g, unknown or other
  misc_feature (409)..(409): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccatggagtttgggctgagcttgggttttcctcgttgcttcttttaagaggtgtccagtgtcaggtgcgcctggtggaggtcggggggaggcgtggtccagcctgggaccgtccctgagacctctcctgtgcacgcctctggcttccaccttcaattaattatgcttatgctaggttcgggtcccgcgacggcctccgagggcgaaggggctagggaggtggggtggcggtcagtacgtcgtccgaggtggactatcttcagttactacgcacgaccttccgngggacgggccgtacttccactactcctacagacgactactacccgacgaaccgtacggttctactctcgccacctcgaccacgacctaggaacgtaacgtacgaccgacgtaccgttcctccttaccgtacttactggtacgacgtagtaggtacgttacggacgtacggttctagttggtacgg

SEQ ID NO: 283701 - DNA, 670 bp, Homo sapiens
  misc_feature: GYAE6OF02ISBKQ.47.85.H08.1.454.CMB.1.raw
  modified_base (281)..(281): a, c, t, g, unknown or other
  misc_feature (281)..(281): n is a, c, g, or t
  modified_base (321)..(321): a, c, t, g, unknown or other
  misc_feature (321)..(321): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcgtggtttcgcgttaggctctttaagaggtgtcagtgtcagtgcgctggtggagtcgggggagtcgtggtccagccgttgggacgtccctgagactctcctgtcgcagtcctcgtcggtacttcacccttanaattattaagtcgcttaagtgtaccgtaggtcggtacccnccgtaaggtcctccgaggccgaaaggggtctaggtaggtcgggtacggtcggtacagtacgtcgtccgaggtcgactacgtcttagagttactacggcctaaggacctcgtacgggtaggtacccgtagttaccacgtcttacaccgtaagacgaacctacgttacccgaagtaaccgtaccggtaccttcgtacgttaccgccgtaacctaccggtaccacgtacccgtagtaaaccgtaccgtaggaacccgtaatacccgttaccttaaccgtacgttacctaacgtcggttaacacgggtttaacggacgtttacggacggtaacgttaacgtccgtttaaacgg

SEQ ID NO: 283702 - DNA, 624 bp, Homo sapiens
  misc_feature: GYAE6OF02IYCEC.47.85.H08.1.454.CMB.1.raw
  modified_base (159)..(159): a, c, t, g, unknown or other
  misc_feature (159)..(159): n is a, c, g, or t
  modified_base (179)..(179): a, c, t, g, unknown or other
  misc_feature (179)..(179): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatgggagtttgggctgagctgggttttccncgttgctcttttaagaggtntccagtgtcaggtgcgcctggtggagtcggggggagcgtggtccagcctgggactccctgagactctcctgtgcagcctctggcttcaccttcaattaattatgctatgcaggtcgggtccgcaggctccgaggccgaaggggctaggnggtgggtcgcggtnatatcgtaccagtggacattcgttacagtaacttccgacacgtacctcccgtggacgggggtacccgtattacccaacctattacccgtaccaagggtaacaaacctaaacgttaccccgaaagtaaccgtaccggttctaacttcctcgacctacccgtacgaaccgtacgtccgtagaacgaacgttacggaccaacgtaccgttcctacttacctaaccttcgttacgtcggacgtaacggagttaacggttcgacggtacgtacgttagttaggtcgg

SEQ ID NO: 283703 - DNA, 815 bp, Homo sapiens
  misc_feature: GYAE6OF02HJVFK.47.85.H08.1.454.CMB.1.raw
tcagagctcacgtacacgaccggtgctcgatttagtatcactcagtcggcgggctgggagaggagccctagcactggaagtcgccgggtgtttccattcggtgatcgagtcacctgaaccacagaggaccgtcaccgtggtagtttgggctgagcttgggttttctcgttgcttacttttaaggaggtgtccgagtgtctaggtgcgtccgtggtcggaggtcggggggaggtcgttcggtccgtacgccgtcgggtaccgttccctgagtaccttcctccgtggtggcgagtcctcgtcggtccttctacctttacaattaaacttatagttcttaagtgacgtaggtcgggtccgaccgtaacggtcctaccggacgggaaccggaacggggtaccgtaaggtacgggttgggggtacgggtaccggtactaagttaacgtcccgtaaccgtaacgggtacggaaacttaacgtttacgtttaacgtaacggtttaaacgtttacggaccgtacgtaacccgttcccggtaagggtaccgggtaaccgtaacgtttaccaaccgtactttaccctaaccggaacgtaacgtacctaaccttacccgaaagtaacccgtacgttaacttaccgttcgtacgtaccgacgtaccgtaaccgtacgttaccgtaggtaacgtaaccgttacgtaacccgtacgttacccgttacttacccgtaccgttaacgtttacggttcggtacggtacgtaacggtacgtttaacgtaacggacgttaccggttaacgtaaggttttccggactttaaccgg

SEQ ID NO: 283704 - DNA, 553 bp, Homo sapiens
  misc_feature: GYAE6OF02FKNS5.47.85.H08.1.454.CMB.1.raw
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccagtagtgacgttggctagttctgattctatctcctggtaccaacaacacccaggcaaagcccccaaactcataatttatgacgtcaatgttcgcccctcgtagggtttctcatcgcttctctggctccaaatctggcaacacggcctccctgaccnctctcgtggctcgagtctgacggacgaggctagtacttacttcgtgttncttcgttgggactaacgttactgtttcggtttggtggttccggacgggtacggtacctaggtcgtaccgtcgtaggtcacgcccgaaggcctcggccccctggtaccacgtctccgttcccccg

SEQ ID NO: 283705 - DNA, 576 bp, Homo sapiens
  misc_feature: GYAE6OF02HZHDS.47.85.H08.1.454.CMB.1.raw
  modified_base (304)..(304): a, c, t, g, unknown or other
  misc_feature (304)..(304): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggaggcgtggtccagcctggggaccgtccctgagactctcctgtgcagcctctggcttcaccttcaataattatgctatgcaggtcgggtccnccgaggcctccgaggcgaaggggctaggaggtgggtggcggtcatagtcgtccgagtggacattcttcaagttacttacgcagtacctcccgtggacggggcctattccaacctatcctacgaagacgaacctaacttacccaagtaaaccgtacggttactactcgtacacctacctcgaacccacgcctaggaacgactggaacgacacgttcctctactacgtacgtcgtacgacgtagagtagttacggacgtagtactagttgtacg

SEQ ID NO: 283706 - DNA, 536 bp, Homo sapiens
  misc_feature: GYAE6OF02GASDB.47.85.H08.1.454.CMB.1.raw
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctctggtaccaacaacaccagcaaagcccccaaatcataattatgacgtcaatgttcgccctnacgggtttcncatcgcttctctgctcaaatctgcaacncgcctccctgacatctcgtacggctcgagtctgaggacgacgntggattcttctnttgcttcgttggctaactcgtagttcgttggtgttcggcggtacggacgtagttcgaccgtcgtacggtctacggcccgtaaggtccgtaccgtcccccgtacggtccacttccgtcgttcccccgg

SEQ ID NO: 283707 - DNA, 714 bp, Homo sapiens
  misc_feature: GYAE6OF02J0DVI.47.85.H08.1.454.CMB.1.raw
  modified_base (140)..(140): a, c, t, g, unknown or other
  misc_feature (140)..(140): n is a, c, g, or t
  modified_base (205)..(205): a, c, t, g, unknown or other
  misc_feature (205)..(205): n is a, c, g, or t
  modified_base (705)..(705): a, c, t, g, unknown or other
  misc_feature (705)..(705): n is a, c, g, or t
tcagagctcacgtacacgaccggtgctcgatttagtatcactcagtcgcggggggggtcgtcgaggaggcgagcgctctcaggacatctccaccatcggcctgggctctgctgctcctcaccctcctcactcagggcacnggtccgtggcccagtcgcgccccgactcagcctcgcctccgtgtctcggggtcctcctacggganacgtcgattccacccatcctcccttggccctaacttcggggaaacccaggttacggttgtacccggtttggggctaacggttttcgtggtaactttctaacttccgttccgttacggttaaccccaaacgtaaaccgaccccgaagggaccaaaacccgccccccgaaaacttccaaattaacttttacgagtacgtactaaagtccgttacgccccctaggtacgggttactcacgttcgtcttcgtctggtcctacctaatcgtggacctaagtaccccggtcctccggtacaccgtacttcttcgcgggtctacggacttcgtcgtacgggacgtagtccgtgtaactttaccgttctgtttcggtactccggtttacggccgttaaacttcgtttacggttccgggtttaggtttcggtacgggccggtaggacccgtaggttcgaccggttccgacgttgtaccgacgacgtcgtccggacctccgtgacttccncgttccccg

SEQ ID NO: 283708 - DNA, 688 bp, Homo sapiens
  misc_feature: GYAE6OF02FRBKX.47.85.H08.1.454.CMB.1.raw
  modified_base (299)..(299): a, c, t, g, unknown or other
  misc_feature (299)..(299): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcatcacatctcctgcactggaaccagtagtgacgttggctagttctgattctatctctgtaccaacaacacccaggcaaacgccccaaactcaataatttangtacgctaatcgttccgcccctgtacgggtttctctactcgtcttctctcggtcctaccaaacttctaggaccaaaccgaccggtcccttcccctacgaccctaacttcccgttacgtcgggccttcggtacgttacctagggacggtaaccggacgggtacttacggtaactttaccgtttcgttcggttcgtctttacggttcggggacctaaactttacggttcgtttacggggttttcggggttcggtttccgggtcgggtaacgggtaccgttaacggtttcggacccggttacgttacggtccgtaaccggtacccgtaaccggtccgtacccgtcccccggttaccgtccgtacccgttcccgttcccggtttacccccccg

SEQ ID NO: 283709 - DNA, 610 bp, Homo sapiens
  misc_feature: GYAE6OF02JK2XJ.47.85.H08.1.454.CMB.1.raw
  modified_base (224)..(224): a, c, t, g, unknown or other
  misc_feature (224)..(224): n is a, c, g, or t
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagagctcacgtacacgaccggtgctcgatttagtatcactcagtcggcgggggggtctcgaggaggcgaggcgcgtctcaggacgatctccaccatgggcctgggcctctcgtctcgcctcctcacccttcctcactcagggcacagggtcctcgggccctagtctgccccgatcagcctcgcctccgtgtctgggtctccctggacagtcgatcaccatcncctgcacgtggaacccagttagacgtaaacgttggctacgttctgtacttcgtctactcctggtaaccaaccaaccgaccctaggaccaaacgccccaaactccaattagttactgaccgtacaattcgtcgtaccccgtagtcggttctacagtctcgtctcgtcgctacaatcgtacgacaacgccgtcctccgtcgactactcgtcgtcggacgtcgagtcgnggtagacgngtcgtcgttattacttgtcgttgtccgtcgtagtactacgtacgtgttacggttgggtcggtttcgggacggtacggacgtacgtcgtacgtcggtcgtacgtacgcgaacgtcgtccgtcccgtcccgtcgtaccttcgtccgtaccccg

SEQ ID NO: 283710 - DNA, 611 bp, Homo sapiens
  misc_feature: GYAE6OF02G22YP.47.85.H08.1.454.CMB.1.raw
  modified_base (297)..(297): a, c, t, g, unknown or other
  misc_feature (297)..(297): n is a, c, g, or t
  modified_base (304)..(304): a, c, t, g, unknown or other
  misc_feature (304)..(304): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
tcagagctcacgtacacgaccggtgctcgatttagtatcactcagtcgcggggggggtctcaggaggcagcgctctcaggacatctccaacatggcctgggctctgctgctcctcaccctcctcactcagggcacagggtcctgggcccagtctgccccgactcagcctgccctcgtgtctgggtctcctggacagtcgatcaccatctcctgcactggaaccagtagtgacgttgctagttctgattctatctcctgtaccaacacacccagacaaacgccccaactcataattangtacgtnaatgttcnccctngggttcncatcncttctctgctacaatcnggacaacncgcctcctcgacctactctcgtcggctcgagtctgaggacgnggctgtaacttcgttcttggttcgtctcgttagggactaaccgtacgtttgttacggttttgggttacgttcgggtacgggtacggtaccgttaagggttaccgtacccggttacggtacggtaaccgaccggtaaccccgtaacgggtccccttaccgggtccccccggttaccggttacccgttaccttccccggttcccgtttaccccccgg

SEQ ID NO: 283711 - DNA, 719 bp, Homo sapiens
  misc_feature: GYAE6OF02HMJTP.47.85.H08.1.454.CMB.1.raw
  modified_base (226)..(226): a, c, t, g, unknown or other
  misc_feature (226)..(226): n is a, c, g, or t
tcagagctcacgtacacgaccggtgctcgatttagtatcactcagtcgcgggggctggggtctcaggaggcagcgctctcaggacatctccaccatggcctgggctctgctgctcctcaccctcctcactcaggtcacgacgggtcctcgggcccagtcctcgcccccgactcacgcctcgcctccgtgtcgtcggtcctcctggacagtcgatccaccatctccngcactagaacctagtagtgacgttggctagttctgtattctatctctcggtaccaacaacaccctaacggaccaaaccgacccctaaactactaaattaacgtttatacgtacgttaactaacgttcgtttacccgtaccccgttacggttacggggttttacctaccgtaccgttaccggttcctttcgtcgtacggtacctaccgtaaacttcgtacgacctaacgtacccggtcctacccgtacacgtactccgtcgtcggacgtacgtacgtcgacggacggacgacgtcgtagttaacttcttacgtgtcgttccgttcggttacgtacctaacgttcgttacggtttcggtttacgggttcgtcgggtaccgggtacgggtaccgttacggttaccggttaacccggttaccggttacggaccgtacccggtaccgtaaccggtccggtaacccgttccccggtaccggttcctaccggtttccccg

SEQ ID NO: 283712 - DNA, 550 bp, Homo sapiens
  misc_feature: GYAE6OF02GBRWH.47.85.H08.1.454.CMB.1.raw
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
tcagagctcacgtacacgaccggtgctcgatttagtatcactcagtcgcggggggggtctcaggaggcagcgctctcaggacatctccaccatggcctgggctctgctgctcctcacctcctcactcagggcacagggtcctgggcccagtctgccccgactcagcctgcctccgtgtctgggtctcctggacagtcgatcaccatctcctgcactggaaccagtagtgacgttggcagttctgattctatctctggtaccaacaacaccaggcaaacgccccaaactcataattatgacgtcaatgtcgccctcgagggtttctcatcncttctctgctcaatctgcaacncgccctcctcgacctatctctgggctcgtagtctaggaggacgaggctgtaacttacttctgttcgcttcgtggtacaacttcgtgttcggtttgggtcgttcgggtcggaggtacctaaggttcgaccgttacgtacggtcacgacccgtaacggtcgtccggtccccgtcggtcctaccgttcgtccgttcccccg

SEQ ID NO: 283713 - DNA, 680 bp, Homo sapiens
  misc_feature: GYAE6OF02GEOLM.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtccctgagactctcctgtgcagcctctggccttcacctttcaaattaattatgcttatgactaggtcgggtccgccgaggcctccgaggcaaggggctaggacggtggggtcggcggtcagttacgtccggtccaggtcggaactagttcttacaaggttacttaccggctaacggtaccttcccgtggaacggggtccgtacttccaccgtatcctaccgaaggtacgaccggtaacttaccccgaaggtaaaccgtaccgggttacctacgtccgtacgtaccctaacccgttacgaacccgtacgtaccccgttaggaacgtaaaccgtcggaaacccgtaccgtaccgtttaccttacccgttaaccttaaccgttaccgttacggttacgtaccggtaaggacggttacggtttacggaacggttacgttaccgtaagg

SEQ ID NO: 283714 - DNA, 632 bp, Homo sapiens
  misc_feature: GYAE6OF02GOY9M.47.85.H08.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
tcagagctcacgtacacgaccggtgctcgatttagtatcactcagtacggacgggggacggtgggggtcctcgagggaggcaagcgcgtctcaggaccatcgtccaccgatcggcctgggtctcctcgctgctcctcaccctcctcgactcagggcacagggtcctgggccagtctacgccccgatcacgtccgtgcctcgtgtcctgggtctctggacngtcgatcacctntctctgcactggaaccngtagcgaacgttgctagttctgtagttctatctacgtacggtaccaacgaccaccgacgactaacgtccctaatactaattaattactgacgtcgtactcgtccgcccctaggtacgggttctctactcgtctctcgtcgtcctacgaagtctacgacaacgtaccgtcctaccacgaccagtccgtcggtcggccgtacgacggtcgtggacggtacgagtctagtacttactgttcgtcgtacgttcgtagggacctaacggttcgttcggttacgggtttgggtcggttacgggtacgggtacggacgttaggttcgaaccgttcgtacggtccgtacgtccgaacgtccgtcccgtacccggtcgtaccctacgttccg

SEQ ID NO: 283715 - DNA, 584 bp, Homo sapiens
  misc_feature: GYAE6OF02GQM8T.47.85.H08.1.454.CMB.1.raw
  modified_base (196)..(196): a, c, t, g, unknown or other
  misc_feature (196)..(196): n is a, c, g, or t
  modified_base (319)..(319): a, c, t, g, unknown or other
  misc_feature (319)..(319): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcacctcagggcacagggtcctgggcccagtctgccccgactcagcctgcctccgtgtctgggtctcctggacngtcgatcaccatctcctgccactcggaaccagtagtgacgttggcagttctgattctatctcctggtaccaacacaccaggcaacgccccaactcataatttatcgtacgtcaattcgttccnccctcgtagggtttctctatcgcttctcctggcctacaatcgtacgacaacacggcctcccngacctatctcnggtctcgacgtcgtgaggcgacgctgtacttactcttgtcgtcttcgttcggtactacgttacgtcggttcggtttcgggtgttcgggcggtaacggacgtagttcggaccgtacgttacggtacgaccggtacccgtaacggtccgtaccgtcccccgttcggtcctacccgttcgtcccgttaacccccg

SEQ ID NO: 283716 - DNA, 681 bp, Homo sapiens
  misc_feature: GYAE6OF02G57XS.47.85.H08.1.454.CMB.1.raw
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
tcagagctcacgtacacgaccggtgctcgatttagtatcactcaggtcggggggaggcgtggtccagcctgggacgtccctgagactctcctgtgcagcctctggcttcaccttcaataattatgctatgcaggtgggtccgccaggctccaggcaagggggctagagtgggtggcggtcatatcgtccagtggacatcttcagttattacgcagactccgtgacggggcattcaccatcncaganacaatacccagaacacggtctatctgccactgaccagctagagactgacgacacgtctctctactatgtgacgaggacgtagttgacgtagtactagttgagtagtcgttcgaccttccggcgggggaccgtaacggggtaacccgttgggtaccgacgttccgttccgtcccgtacctaaccggtccctacccgaacccgaaccgggtccccaacggttcccggttaccccgttcccccggtcgggccccgttcccgtaccgtccgtacccgacgggtaccgaccctacccgtacccgaacgaccgtacccgaaccgccgggacccggcccggtaccgggtcgtcccggtcccggttacccggtaacggtaaaccggttaccgtttaccgttaccccgtagtttaaccgtacttaacccgttcgaggtaccggg

SEQ ID NO: 283717 - DNA, 764 bp, Homo sapiens
  misc_feature: GYAE6OF02GGUC7.47.85.H08.1.454.CMB.1.raw
  modified_base (123)..(123): a, c, t, g, unknown or other
  misc_feature (123)..(123): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
tcagagctcacgtacacgaccggtgctcgatttagtatcactcagtcggcgggggggtctcaggaggcagcgctctcaggacatctccaccatggcctgggctctgctgctcctcacctcctnactcagggcacagggtcctgggcccagtctagccccgatcagcctgcctccgtgtctgggtctcgtggacagtcgatcaccatccgtcctgcacgtggaaccngtagtcgacgttggctagttctgacttctatctctggtacaacacaccaggcaacgcccaatcattacttangacgtcaagttcgtaccgtcccgtagtacgggtttctactacgttccgactttccgtacgttcggtaccttaaccgtaaacgttaccgttacgggaacctaaacccggtaaccgggtccccttacccggttaccggaaaccctacgtttcccgtaaccggttcgggtaccgttacggtaacgttccgttacgggtaaacggtaccggtaacggtccgtttaacggtaacttttaccggttacgttaccgggttcgtaccgtttaccggttacggggtaacctaaacgttaaccggtttcggtttaaccgggtttgggttaccgggtttaccggaaccggggttaacggaaacccggttaggtttaccgtacccgttacggttaaccgttaccggaaccgttcccgtaaggtaccgttcccggtaccccgttacggttaccgcctttaccggtcccgttacccccgg

SEQ ID NO: 283718 - DNA, 584 bp, Homo sapiens
  misc_feature: GYAE6OF02G8AJE.47.85.H08.1.454.CMB.1.raw
  modified_base (349)..(349): a, c, t, g, unknown or other
  misc_feature (349)..(349): n is a, c, g, or t
  modified_base (580)..(580): a, c, t, g, unknown or other
  misc_feature (580)..(580): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggaggtcggggggagcgtggtccagccgtgggacgtccctgagactctcctgtcgcagcctctggcttcaccttcaattaattatgctatgcaggtggtccgccgaggcctccgaggcgaaggggctaggaggtggggtggcggtnatagtcgtcagtggactagttcttcgaagttattacgctacgacctcccgtaggacgggtccgaattccacctattccgtaccagaacgactaacttacccgaagaacccgtacggttacctacgtcctagccacctcgaaccacgtcctacggaagtaaccagaaccgaccaccgttacctaccttcctaactacgttcgtacgacgtaaggagtagtaggacgtacgtntacg

SEQ ID NO: 283719 - DNA, 834 bp, Homo sapiens
  misc_feature: GYAE6OF02IOR6B.47.85.H08.1.454.CMB.1.raw
  modified_base (333)..(333): a, c, t, g, unknown or other
  misc_feature (333)..(333): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcacgtggaaccagtagtgacgttggctagttctgtattctatctcctgtaccaacacaccagacaacgaccccaactcataatttatgacgtacaatcgttccgcccctgtagggtttcnccgtatccgtctttactcgtcggtcctacctaaattcgtacggaccaaaccgacccggtcccttaccccgtaccgtaaccctacttacccgtccggtacgggtccgttcccggtaagttccgtaacgggtaacgggtaaccggaacgggtacgttacgtaacttttaaccgttccgtttagggtttccgttaccgtttccggtttacggggtacctaaaaccgtttaccggttttcgggttttaccggggtttttacgggggtttcgggttttacccggggggaccggggttaaaccgggggtaacccggttaaacgggttttaccgggtaccccggttttaacccggtttaaacgggggttaccccgaaaacccgggttcccccgggtaaaacggggttccccctttaccccggggtttaccccccccggtttccggggttaacccccgtttaaccccggtttcccccggtttacccccggttttaacccccccccccgg

SEQ ID NO: 283720 - DNA, 836 bp, Homo sapiens
  misc_feature: GYAE6OF02H89G9.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctctcactcagggcacagggtcctgggcccagtctgccccgactcagcctgcctccgtgtctggtctcgtggacagtcgatcacatctcctgcactggaaccagtagtgacgttggctagttctgtattctatctcctgtaccaacaacaccaggacaaacgccccaaactcaattatttatgtacgtcaattcgttccgcccctcgtacgggtttctactactccgtctttccgtcgttggacccttaccaaacttccgtacgggtaccctaaaccgtaacccggggtccccttcccccgtacgtaaccctaacgtttcccgttaccgtttaccgggggccttaccgggtacgttaccgttacgggaacggtaaccgggtacgggtaccgttcgttaaacgtttttacccgtttaccgtttggtttcgtacccggttttaacggttccggggtaaccttaaaaccgtttacgtttcggggttttaccgggtttttagggggtttccggttttccgggggaccgggttaacgggggttaacccgttaaagggttttacgggaacccccgggttttacccggtaaaaccgggtttcccgaaaacccggggtaccccggtaaacggggtcccccgtttcccgggtacccccccccgggtttacggtttacccccgttaaccccggttttccccggtttacccgggttttaacccccccccg

SEQ ID NO: 283721 - DNA, 503 bp, Homo sapiens
  misc_feature: GYAE6OF02F2RX3.47.85.H08.1.454.CMB.1.raw
  modified_base (277)..(277): a, c, t, g, unknown or other
  misc_feature (277)..(277): n is a, c, g, or t
  modified_base (328)..(328): a, c, t, g, unknown or other
  misc_feature (328)..(328): n is a, c, g, or t
  modified_base (488)..(489): a, c, t, g, unknown or other
  misc_feature (488)..(489): n is a, c, g, or t
  modified_base (491)..(503): a, c, t, g, unknown or other
  misc_feature (491)..(503): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaaagcccccaaactcataatttatgacgtcaatgttcgcccctcaggggtttctcatcgcttctctggctccaaatctggcaacncggcctcctgaccatctctggctcgagtctgaggacgaggctgattacttntgttgctcttgggcaactactgttcgtttgggtgttcgggcggagggtacctaaggttgaccgtcgtaggtcagcccaaggctcgcccctcggtccactctcgttcccacccttcctctacgtgacgtctctgagcgggcgtggcgaaggcgacagtagnngnnnnnnnnnnnnn

SEQ ID NO: 283722 - DNA, 611 bp, Homo sapiens
  misc_feature: GYAE6OF02G0Z8D.47.85.H08.1.454.CMB.1.raw
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctctgcactggaaccagtagtgacgttggcagttctgtattctatctcctgtaccaacaacaccaggacaaacgccccaaactcaataattatgacgtcaatcgttccgcccctgtacgggtttctcgtactcgtcttctctggtcctacctaaatccgtaggaccaacaccggtccctaccctcgaaccctactctccgtggtcctcggtacgtctggacggtacgaggtctagtacttacgttcgtgttcgtcgttcgttcgggtacctaacgttacgttgttcggttttgggtcgttcgggcggtaaggtaccgtaagttcgaccggttaccgtacggtccacggacccgtaaggtccctaccgtccccgttacggtccgtaccttccgtccgttacccccg

SEQ ID NO: 283723 - DNA, 599 bp, Homo sapiens
  misc_feature: GYAE6OF02FWLKH.47.85.H08.1.454.CMB.1.raw
  modified_base (328)..(328): a, c, t, g, unknown or other
  misc_feature (328)..(328): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatctcctggtaccaacaacacccaggacaaacgcccccaaactcaataatttatgacgtacaatcgttccgcccctnacggggtttctctatccgtcttctctgcctacaatctgacacgcgcctccctgacctatctcgtggctcgagtctgacggacgagctagtactttacttcgtgttctcttcgttgggacctaacttaccgtggtttccggtttggggtacggttccgggacgggtaacgggtaccgtaaggtttccgaccgttaccggtacggtcctacgggaccccgtaaggtcccgtcggtcccccgtacggttcctaccgttccgtcccgttcccccg

SEQ ID NO: 283724 - DNA, 633 bp, Homo sapiens
  misc_feature: GYAE6OF02HA8AJ.47.85.H08.1.454.CMB.1.raw
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (355)..(355): a, c, t, g, unknown or other
  misc_feature (355)..(355): n is a, c, g, or t
tcagagctcacgtacacgaccggtgctcgatttagtatcactcagtcggcggggctgggagaggagcccagcactggaagtccgccggtgtttccattcggtgatcagcactgaacacagaggactcaccatggagtttgggctgagctgggttttccncgttgctcttttaagnggtgtccagtgtcaggtgcgcctggtggaggtcgggggagcgtggtccagcctgggacctccctgacgactctcctgtncagcctntcggcttcaccttnaaattaattntgactatgctaggtcgggtccnccgaggcctccgaggacgaaggggctaggnggtgggtcgcggtnagtntcggtccagtcggactatctacgagtactacgcagtacctcccgagggtacggggcctacttccaccgtactccgtaccgaagacgtaactaacgttacccgaagtaaccgtacggttactaacgtctacgaccgtaccgtacgtaaccgacgtacccgtaggaacgtaaccgtacggaacctaccgttaccgttccttaccgtacttaaccgtaccgttggtaccggtacgtaacggtacggtacggttacgaacgtacggttactaggttgtacgg

SEQ ID NO: 283725 - DNA, 657 bp, Homo sapiens
  misc_feature: GYAE6OF02JG7H1.47.85.H08.1.454.CMB.1.raw
  modified_base (225)..(225): a, c, t, g, unknown or other
  misc_feature (225)..(225): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgatcagcctgcctccgtgtctgggtctccgtggacagtcgatccaccatcctcctgcactggaaccngtagtgacgttggctagttctgattctatctctgtaccaacacacccaggcaaacgccccaaactcattaatttactgactctaattagttccgccccttacgacggggtttctacactccgtcttcctacttcggaccttaccaaattcgtacggaccaaccaccgggtccctccccgttacgaaccctacttccgtaccgtggggaccttcggacgttccgtggaacgggtacgagggtcctaggtacttttaccgttcttgttcgtcttccgttgggaccttaaacgttcgttcggttcggttttgggtcgtttccggggacggacggtaccgtaaggttcgtaacccggtcgttacggtactaccgtacccgtagtaccgtccccgtcccggttccggttacctaccgttccgttcccgttacccccg

SEQ ID NO: 283726 - DNA, 810 bp, Homo sapiens
  misc_feature: GYAE6OF02GJKJR.47.85.H08.1.454.CMB.1.raw
tcagagctcacgtacacgaccggtgctcgatttagtatcactcagtcggcggggagctctgggagaggagcccagcactggaagtcgccggtgtttccattcggtgatcagcactgaacacagaggactcaccagtggagtttgggctgagtcgttgggttttcctcgttgtcttcttttaagaggtgtccagtgtcgaggtcgcgccgtgggtggagggtcggggggaggcgtcggtccaggccgtgggaccgtcccgtggacgacttcgtcctggtcgtagtcctgtaggaatcgtagtttcacgttaccttcgtggtactgtaccgtaccggttcggggtaccccaaccgtaaaccgtcccggtaaggggttaacggggcgttgggttacgggttcgggttccttaccgtacgttactaccgtaacttccgtaggtagttcggacgttaggtttagtttaaacttaaagtttacgtcggtacggtaccgttccgggtaggggtaccggggtaccttaacggttacgaacgtaccgttacgttcccgtaaccggaaagggtaaccgaaaccggtaacggaacgtaaaggtaagttactaccggtttagtaaccgtacgtaaagggtaaactaacgtaaacgtagttcggtaaggaacgggtacgtaacgtaacggtaacgttccgggtacttagtaccttaactttcggttagtttttagggtttacccagtttaccgggttccccggtttacggggtccggtacgggtttacccggttcggggtaccgggtaccggtaaccccgggg

SEQ ID NO: 283727 - DNA, 765 bp, Homo sapiens
  misc_feature: GYAE6OF02HC1O2.47.85.H08.1.454.CMB.1.raw
  modified_base (327)..(327): a, c, t, g, unknown or other
  misc_feature (327)..(327): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctccgtgtctgggtctccgtggacagtcgatccaccatcctcctgccacgtggaaccagtagtgacggttgctagttctgtattcgtatctccgtcggtacctaaacgaacaacccacggacaaaacgacccccaaaactacaacttaaatttancgtaactctaaagtcgttaccgcccttcgtacggggtttacctacaacttcgtcctttacgtccgttcggcctacctaaaattccgtacggaccaaaccgtacccggtacccttaccccgtaccgaacctactccttacggtcgggaccttcggacggttcgtacgggaacgggtaacggtaacgggtcgttacgttaaccgtttacgttttacgttgggttactccgtttcgtttacgggtaacctttaaccgtaacgttttcgggtttacgggttttcggggtttcgggtttccgggacggggttaacgggtaacccgttaagggttccggaccggtttaccgttacgggtacgtaaccggacccgtaaacggtccgttacccggtacccccggttccgttaccggtacccttccgttacccgtttacccccccgg

SEQ ID NO: 283728 - DNA, 626 bp, Homo sapiens
  misc_feature: GYAE6OF02JIY7R.47.85.H08.1.454.CMB.1.raw
  modified_base (305)..(305): a, c, t, g, unknown or other
  misc_feature (305)..(305): n is a, c, g, or t
  modified_base (338)..(338): a, c, t, g, unknown or other
  misc_feature (338)..(338): n is a, c, g, or t
tcagagctcacgtacacgaccggtgctcgatttagtatcactcagtcgcggggggtctcaggaggcagcgctctcacggacatctccaccatggcctggctctgctgctcctcaccctctcactcagggccacagggtcctgggcccagtctgccccgatcagcctgcctccgtgtctgggtctcctggacagttcgatcacctatcctcctgcacgtggaaccagtagtgacgttggctagttctgattcgtatctcctacggtaccaactaccaccaggacaaacgccccaatcattaattangacgtcaattcgtccgcccctagtagggttccncgtatcgtcttctctgactacctaatcgtgtaccaacgtccggtaccctcctgtacctatccgtcgtggtctagtacgtgtagcggaacgcgtacgttagtacgttcttcgtgttacgtcgttcgtaggactacgtcgtagtttcggtttacgggttggtccgggtacggtaacgggttaccgtaacggttcgtacccggttacgtaacggtaccgttaaccggtacccgtaacggttacgtccccggtccccgtacgtccgtaaccttccgttacccgttacccccg

SEQ ID NO: 283729 - DNA, 744 bp, Homo sapiens
  misc_feature: GYAE6OF02F1VNY.47.85.H08.1.454.CMB.1.raw
  modified_base (378)..(378): a, c, t, g, unknown or other
  misc_feature (378)..(378): n is a, c, g, or t
tcagagctcacgtacacgaccggtgctcgatttagtatcactcagtcgcgggggagctctgggagaggagcccagcactggaagtcgccggtgtttccattcggtgatcagcactgaacacagaggactcaccatggagtttgggctgagctgggttttcctcgttgctctttaagaggtgtccagtgtcaggtgcgcctggtggaggtcggggggaggcgtggtccagccgtgggaccgtcccgtgacgactcctccgtgtcgcacgcctcgtggtccttcaacccgtttacaaattaacttatggtacttaagtcgacgtaggttcggggtcccgaccgtagggcctaccggagggacgaagggggtcttaacggngggttcgggggtcggacggtaccaagttacgttccgacgtaggtcggaactacgtttcgtttacgtaagtttacgttaaccggcgtaacggtacccgttcccggtagggaaccgggggtccctaaacgttcccgtaaacccgtacgtccctacccgacggaacgtaacctaacgttacccgaagtaaccgtaccggttacttacgtccgtagaccctaccgtaccgaaccgtacggtcccgtaaggaaccgtaacgtacggaacccgtaacgtaccggttccttaccgttaaccttaccgttaaccggtcggtaccgtacggaagggttacggtacggtttaccggacggttacgttacgttaagg

SEQ ID NO: 283730 - DNA, 930 bp, Homo sapiens
  misc_feature: GYAE6OF02GXCLD.47.85.H08.1.454.CMB.1.raw
  modified_base (325)..(325): a, c, t, g, unknown or other
  misc_feature (325)..(325): n is a, c, g, or t
tcagagctcacgtacacgaccggtgctcgatttagtatcactcaggttcggcggggctggggtctcaggtaggccagcggacctctcgaacggacatctccacctatcggtccctcgggctctgtctgcctccctcaccctccgtcgactacgagggctacgacgggtcctggggtcccctacggtccgtccgccccccgtattccgtacggtcccttcggacccggtccgtggtccgttcgggtcccttcccgtggacacgtcggactcgaccatcctcgtgcacgtggaacctagtacgtcgtcggttcgacgtacgttaacngtacttcgtacttcctccgtacgtaccaacctaactaccgaggtaccaaccgtacccccaaactacgtaacttaattacgcgaaccgttacaagtaccgttacccgtcccgttacggtacggttcgacgtacgtcgttcgtttccgtcggtacgtacctacctaagtccgtacggtactaaccgccgttaccctaccgtacgtaacccgtacgttacccgtacggttccggtacgtttaccgtacgtttccggtaacgggtaaaccgggttacggtaacggttaccgtaaccgttttaacgtttacccgggtttcgtttccggttacccgggtttaccggtttaccgggttaaccggggtaacccgtttaaacccggttacgggtttaccgggttttaccggggggtttacgggttttaccgggtaccggggtttaacggggtaacccgggtttaccggtaaccgggtttacccggggttacccggtttaacccggtaaccccgggttaacccgttaacccggttacccgggtaaccggtttacccccggttccccgggttaaccccccggtttcgggttacccccgtacccggtttacccccgg

SEQ ID NO: 283731 - DNA, 717 bp, Homo sapiens
  misc_feature: GYAE6OF02FVNQC.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctgccccgactcagcctgcctcgtgtctgggtctcctggacagtcgatcaccatcctcctgcacgtggaaccagtagtgacgttggctatttctgattctatctcctgtaccaacaacaccagcaaacgccccaatcataattatagacgtacaattcgtccgcccctcgtacgggtttctcactccgtcttctcgtcggtacctactaactcgtacgacaaccgtccggtccctacctacgacctactccgtcgtcgggtacctcggtacgtcgtacggacgggacgtacggtcttacgttaactttccttacgttcggttcgtaccttcggttaacgggtaccttaacgtttaccggtttcggttttccggggttttcgggttacggggtttcggggtaccgggttaacgggtaacccgtttaggttccgggttaacccggttaccggttaccggggtacctaacccgggtaccccggtaaacggttcccgttacccccggtcccccggtttaccgggttacccttacccgtttaccccgttccccgggttttcccccccgg

SEQ ID NO: 283732 - DNA, 739 bp, Homo sapiens
  misc_feature: GYAE6OF02HQBA9.47.85.H08.1.454.CMB.1.raw
  modified_base (227)..(227): a, c, t, g, unknown or other
  misc_feature (227)..(227): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcgagggcacgagggtcctcgggcccagtctcgccccgactcacgcctcgcctccgtgtcgtgggtcctccgtggacaggtcgatccacctatccttccngacctacgtggaaaccaggttacgtggtaaccggttggactaggttctgtaacttctatctccgttacggtaaccaaaccaaaccacccgaggaaccaaaaccgacccccctaaaactctaattaatttaacgtacgtaacgtactaagttacgttccgaccccgtacgtacgggtttctactacgtcgtccttcgttcgacgtctaacgtaaactctacgactaaccgaccgtccgtacctacgaccactcgtccgtgggtccgtaacgtcgttgtacggaacgggaccggtaggtcgtagttaaactttacgttcgttcgttcgcctttcggttaccgggtaacctaaacgttcgttcgggtttcggttttgggttcggtttccgggacggaccgggttaaccgttaacggttccgtaaccggttcggtaacggtcctaaccggtaccgaacggtcccgtacccggtcccccgttacggtacctaccgttacgtccccgttaaccccccg

SEQ ID NO: 283733 - DNA, 673 bp, Homo sapiens
  misc_feature: GYAE6OF02IK2M2.47.85.H08.1.454.CMB.1.raw
  modified_base (325)..(325): a, c, t, g, unknown or other
  misc_feature (325)..(325): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggccccagtcctcggcccccgactcacgcctgcccttccgtgtcgtgggtctcgtggacagtcgatcacctatctcctgacctcgtacggaacctaggtagtggacgttggctagttctgtattctatctcctagaccaacaacacccaggacaaacgaccccaaactacattaatttanacgacgtacaagtcgttccgacccttacgtagggtttctacactcgtcttctctggcctccgaagtcgtaggaaccgacgaccctaccgtacgaccgtcgacgacgaggtacggaccgggtacggggatagggacgtaccgttagttacgttttggtacgtaggttggtagggtaagttaactttaagtttcggtataacgttagttaggtttcggttcgggcgggtaacggaaccgtaacggccgttacgtacccgtccgttaccggacgtaaccgacccgtaagcccgttcccgacccccgttcggtaccttaccgtccgttcccgttacccgtccccgttacccg

SEQ ID NO: 283734 - DNA, 706 bp, Homo sapiens
  misc_feature: GYAE6OF02JB1ZI.47.85.H08.1.454.CMB.1.raw
  modified_base (196)..(196): a, c, t, g, unknown or other
  misc_feature (196)..(196): n is a, c, g, or t
  modified_base (226)..(226): a, c, t, g, unknown or other
  misc_feature (226)..(226): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctgccccgactcagcctgcctccgtgtctgggtctcctggacngtcgatccaccatctcctgcactggaaccngtagtgacgttggcagttctgattctatcctctcgtaccaacaccacccagaccaacgaccccctaaactctattaacttatcggtaactcaattcgttacccgtcccccttacgtcgggttttcctcctagtccgttctttccgttcgttggtccctactaaagttccgtaggacctaaaccgaccggtcccttacccctcgaaccctacgtcgtaccgtcgggtacctcggtacgttcgtagggtacggacggaggtctacggttatttaccgtttacgttgttcgtccgttcgttcggtcttaacgttccgtttaggtttcgggttttggggttccggtttcggggacgggtaaccggggacgttaacggttccggtaccggtaccggttacggtaccgacgggtaccccgtaacggtcccggtcccggtaccccgttcccgggtactacccggttcccgttccgttacccccccgg

SEQ ID NO: 283735 - DNA, 693 bp, Homo sapiens
  misc_feature: GYAE6OF02IGF5F.47.85.H08.1.454.CMB.1.raw
  modified_base (322)..(322): a, c, t, g, unknown or other
  misc_feature (322)..(322): n is a, c, g, or t
  modified_base (366)..(366): a, c, t, g, unknown or other
  misc_feature (366)..(366): n is a, c, g, or t
tcagagctcacgtacacgaccggtgctcgatttagtatcactcagtcgcggggagctctgggagaggagcccgagcactggaagtcgccggtgtttccattcggtgatcagcactgaacacagaggactcaccatggagtttgggctgagcgtgggttttcctcgttgcttcttttaagaggtgtccagtgtcaggtgcgcctggtggaggtcggggggagcgtggtccagccgtgggactcctgagactctcctgtgcacgcctcgtggtccttcctaccttacaaattaacttatgtcttaatgctaggttcgggtcccncgaggtcctaccgaggcgaagggctaggaggtgggtggcggtanatacgtcgtacgaggtcggactactcttacgaagttacttaccggactaacgtaccctcccggtagggacggggtaccctactttacccaacctacgttcctacccgtaagaacgtaacctaacgttacccgaaagtaaacccgtaccggttacttaactccgttacgacccgttaaccgtacggaaccctacggtaccgttaacggaaaccgtaacggtacggaaccgtaccgtaccggtttacctaccgttaccgttaaccttacggttacggtacggaccggtacggaacggttacggttacggaaccggtaggttaccttagg

SEQ ID NO: 283736 - DNA, 680 bp, Homo sapiens
  misc_feature: GYAE6OF02HQ40U.47.85.H08.1.454.CMB.1.raw
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaagaggtgtccagtgtcaggtgcgcctggtggagtcggggggagcgtggtccagcctgggacgtccctgagactctcctgtgcagcctctggcttcaccttcaattaattactgctatgcaggtcggtcctccgaggctccgaggcgaagggggctaggacgtggggtcggcggtcaagtcgtcgtccgagtggactatctcagtatacgcagacctcccgtgggacggggtcctattccgaacctatcctaccgaagaacgactaacgttaccccaagtaaacctacgggtaccttaacttcgtacggtccctaaccctacgaaccctaacggtccccgttagggaaaccgtaaaccgttacggaaacccgtaaccgtacccgttaccgttacccttacccgtttaaaccgttaccgttcgggtaccgtaaccgggtaagggtaaccggttaacgggtttaacggaaccgggttaacgtttacccgaaaggttttcgggtaacggtaaccggg

SEQ ID NO: 283737 - DNA, 575 bp, Homo sapiens
  misc_feature: GYAE6OF02F1FPI.47.85.H08.1.454.CMB.1.raw
  modified_base (303)..(303): a, c, t, g, unknown or other
  misc_feature (303)..(303): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
tcagagctcacgtacacgaccggtgctcgatttagtatcactcagtcggcgggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatcctcctgcactggaaccagtagtgacgttggcagttctgattctatctcctggtaccaacaacacccagcaaacgccccaaactcataatttangacgtcaatgttcgcacctcgagggtttctcatcgtcttctctcggctaccaaatctaggacaacaccggccctcccgtacgaccatctcgtcggctcgtagtctgagggacgaggctgtattaccgttntgttancgttcgttggactaacgttcgtggttcggtttgggtcgttcggcggtacggtaccgtagttcggtaccgttccgtaaggtccgacggtacccgaggtccgtccgtcccccgttcgtcctaccgttcgttaccccgg

SEQ ID NO: 283738 - DNA, 608 bp, Homo sapiens
  misc_feature: GYAE6OF02H308P.47.85.H08.1.454.CMB.1.raw
  modified_base (249)..(249): a, c, t, g, unknown or other
  misc_feature (249)..(249): n is a, c, g, or t
  modified_base (589)..(589): a, c, t, g, unknown or other
  misc_feature (589)..(589): n is a, c, g, or t
  modified_base (592)..(593): a, c, t, g, unknown or other
  misc_feature (592)..(593): n is a, c, g, or t
  modified_base (595)..(608): a, c, t, g, unknown or other
  misc_feature (595)..(608): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctctttttaaaaggtgtccagtgtgaggtgcaggtagtggagtccgggggagcttagttcaggccggggatccctgagactctccngtgtagtctctggaatcagtttcagtaccttcgtggatgcacgtgggtcccaccaaacgtcccgaagggtaacggggccgaagggaaccctggtcacggccgttctcctcaccgtccctccgaacccgaacgggcccctaacgttcccgggttcccttccccccgtcggcccgtccccgtcgccctcccgaagggaccgcccaacccgtccggacgacgtccaccgacggcccggcccgtgggcctcgcccgtggtacaacgggttaccttacgttccgtaacgtcgacgcctcgtggtacggccgggtacgtcggaccgtaaggccggacaaacgtcgncgnngnnnnnnnnnnnnnn

SEQ ID NO: 283739 - DNA, 701 bp, Homo sapiens
  misc_feature: GYAE6OF02G9Y41.47.85.H08.1.454.CMB.1.raw
tcagagctcacgtacacgaccggtgctcgatttagtatcactcagtcgcggggctgggagaggagcccagcactggaagtcgccggtgtttccattcggtgatcagcactgaacacagaggactcaccatggagtttgggctgagcttgggttttcctcgttgcttcttttaagaggtgtccagtgtcaggtgcgcctggtggaggtcggggggaggcgtggtccgggagccgtgggaccgtcccgtgacgacctctcctgtcgcacgccttcgtggtctttaccacctttcaaattaattatgcttatgcaggtcgggtcccgccagggcctccgaggacgaaggggctaggaggttggggtgggcggtacattacgtccggtccgaggttcgggactagtttccttacgaaggttaacttacgctaacggtaccttcccggtagggacggggggccgtacgttaccacccgtaactccgttacccgaagtaacgacctaaacgttacccccgaagtaaacccgtaccggttaccttagttcccttacggaccctaccgttccgaacccgacgtacccgtaggaacgtaaccgtacggaaaccggtacctaccgttccctaccttaccttaccgttacgtcgttacggcggtaacgtaggttacggttacggtaccgttacgtccgttaggttgttacgg

SEQ ID NO: 283740 - DNA, 685 bp, Homo sapiens
  misc_feature: GYAE6OF02H48NP.47.85.H08.1.454.CMB.1.raw
  modified_base (148)..(148): a, c, t, g, unknown or other
  misc_feature (148)..(148): n is a, c, g, or t
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (658)..(658): a, c, t, g, unknown or other
  misc_feature (658)..(658): n is a, c, g, or t
tcagagctcacgtacacgaccggtgctcgatttagtatcactcagtcggcggggggggtcgtcgagggaggcgagcgctctcaggacatctccaccatggcctgggctctgctgctcctcacctcctcactcgaggcacgagggtccngggcccagtcncgaccccgactcacgcctcgcctccggtgtctgggtctcgtggacngtcgatcaccatctcgtgactctacggaacagtagtggacgtttgggctagttctgtattctattctcgtcggtaaccaacaacaacccgaggaacaaaccggaaccccctaaactacctaattaaacgtttatacggtacgtacaaattcggttccacccgttcgtacggggtttctacgtacgtcggtcttcgtactcggtctacctaaactcgtacgtacgaaacctacggcctcctacggtacctacgtctcgtcggtcgtcggtacgtcgttacggacgggaaacggtcggacgtacgtaactttcctagttcgttcgttcttcgttacggggtactaacgttacgtgttcgggttttcgggttggttacggggtcggaaccgggtacgtacggtacggtaccggttcggtaccgtcgtacgacccgtacggtacgccgttaccccgngtacctacgtccgttccgttaccccgg

SEQ ID NO: 283741 - DNA, 730 bp, Homo sapiens
  misc_feature: GYAE6OF02I9X8M.47.85.H08.1.454.CMB.1.raw
  modified_base (646)..(646): a, c, t, g, unknown or other
  misc_feature (646)..(646): n is a, c, g, or t
  modified_base (686)..(686): a, c, t, g, unknown or other
  misc_feature (686)..(686): n is a, c, g, or t
  modified_base (719)..(719): a, c, t, g, unknown or other
  misc_feature (719)..(719): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagtcgttcgggttttcctcggttcgcttcgttttaaagaggttgtccagtgtcgaggtcgcgtccgtgggtgggaggtcggggggaggtcgtggtccgagtccgtgggaccgtcccgtgacgtacctcgtccgtgtcgccgacgcctgtcggtccttccgtaccttactaattaattatgtactagtcggtacgtacggggttcgggtccccgaccgtacggcccgtaccggacggggaaccggtaagggggtccttaagggtagggtcgggggtcgggtaccggtacgtacgttaaccgtccggtaccgtagggtaccgacttacgttcttacgtaagttaacctttaccgacgtaaccgtacccgttccgtaaggggtacccgggtaccttaacttacccgaccctacgttaccgtaccggaagtaaccgtaacccgtaaccgttaacccgaacgtaacccgtacgttcctactcggtccgtacaccgtaccgaacncgtcgtaacgactaccgtcgaacgttcaccttctaccgtntaacctcgtcgacgaggtagtagttcgtaacgngttactagtcg

SEQ ID NO: 283742 - DNA, 613 bp, Homo sapiens
  misc_feature: GYAE6OF02JJIQO.47.85.H08.1.454.CMB.1.raw
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (392)..(392): a, c, t, g, unknown or other
  misc_feature (392)..(392): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctgggtctccgtggacagtcgatcaccatctcctgccacgtggaaccaggtagtcgacgtttggcctagttctgattctatctcctggtaccaacaaccaccaggacaacgccccaaactcataattangactcaatcgttccncccctcgtagggtttctcatccgtcttctctcggctaccaaatctcgacaactaccgccctccacgaccnctctcgtcggctacgtacgtcttggacggacgtacggctagtactttacttcgttgttctcgtcgttaggtacctaaacttcgttacggttcgggtttcgggttacgttccgggacgggtacggtaaccgttacgttcggtacccgttcggtaacggtcgaacggcccgtaaggtccgtcccggtcccgtacgttcccaccgttctcccgtttacccccgg

SEQ ID NO: 283743 - DNA, 784 bp, Homo sapiens
  misc_feature: GYAE6OF02IEH6I.47.85.H08.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (190)..(190): a, c, t, g, unknown or other
  misc_feature (190)..(190): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (268)..(268): a, c, t, g, unknown or other
  misc_feature (268)..(268): n is a, c, g, or t
tcagagctcacgtacacgaccggtgctcgatttagtatcactcagtcgcggggtctgggagaggagcccagcactggaagtcgccggtgtttccattcggtgatcagcactgacacagaggactcaccatggagttgggctgagctgggttttccngttgctacttttaagnggtgtccagtgtcaggtncgcctggtggagtcgggggagcgtggtccagcctgggacgtcctgagactctctgtgcngtcctntggcttcacttanaattaatatgactatgacctaggtccgggtccaccgtaggtcctacgaggccgaaagggggtcctagggaggtcggggtcggtaccgtcgtaagtcgtaccggtccgtaggttcgggaaccttagtacgttaaccgtaagggtttaacgttaaccggccaacggttaaccccgttcccgggtagggggtaaaccggggtacccggtaaccttttacccgaaaccccgttaacgttccccgttaaccgtaacggtaaccgtaaacccgtaaccggtttaaccccgaaagggttaaaacccgttacccgggtacctttaaaccggttacccgttacggaacccggttaacccgttaccggtaaccccggtacggtaccggtttaacgaacgggtaaaccgtaccggtaacgtaaccgtaccgttaccttaccgtaccgttaaccgtacgttggtaaccggtacgtaacgtaggttaaccggttacggtaaccgtaggtaaccgttagttaggtacggg

SEQ ID NO: 283744 - DNA, 747 bp, Homo sapiens
  misc_feature: GYAE6OF02JABPO.47.85.H08.1.454.CMB.1.raw
  modified_base (196)..(196): a, c, t, g, unknown or other
  misc_feature (196)..(196): n is a, c, g, or t
tcagagctcacgtacacgaccggtgctcgatttagtatcactcagtcgggggaggcgtggtccagcctgggacgtccctgagactctcctgtgcagcctctggattcatcttcagtgactacgacatgcactgggtccgccaagttgcaggagaacctctggaatgggtctccgttattgctactggtggtgccanagactatgcaggctccggtagggacgggaccgtataccacctagtcctaccgtaggaagtaagtacggacgaaacgaacttccgttagttaacttcctaaacaaagttacgaaagacgtacctaggaacgacgggaccgggaacgaccgggtacgtagttaacgttacgtagttaagtaaggtagaacgtacgtagtaggtacggtaaacggtagggttaactttaaggacgtttacgtttaggacgtttacgtacgggtacgggtaaccgtaaagggaacctaaggtacgtaccgtacgtacttaccttacgaccgtaccctacccgaaccggtaccggtaccctaacggtcccgttaccccgttaccccggtacggtccccgtaccgtacgtaccctaccggacggtccgtaccgacccgtaccggaccgtaccgaccaaccggaccggcccgtaccggcggtccgtaccggtaccggtcgaccgtcaaaaccggttccgtacccgtttacccgtaacggtacggtaaccgtccgtaccgtagggaccg

SEQ ID NO: 283745 - DNA, 784 bp, Homo sapiens
  misc_feature: GYAE6OF02I0L6Q.47.85.H08.1.454.CMB.1.raw
  modified_base (212)..(212): a, c, t, g, unknown or other
  misc_feature (212)..(212): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcgagggcacgagggtcctgggcccagtcctcggccccgactcacgcctgcctcgtgtcgtgggtctctggacagtcgatcaccntctcctgctacgtacggaacctagtacgtggtacgttggctagttctgtacttctacttccgtccgtacggtaacccaaaccaacccacccgaacgaccaaaccgaccccaaactactaattaattagtacgtactacgtaacgttcgttaccgccccgttcggttacgggtttctacgtactcgttcttcgtcgtcgtacctactaacttcgtacgacaccgtaccggtccctcccgtactacctacgttccgtacggtcggtccggtacgtacggtcgtacgggacgggtacggacggtacgttagttacgtttacttcgtttacggttcgtacggtttcggttacggtaccgttaaccgtttacgtttacggggttttcgggttttacggggtttcgggttaccgggggtacgggtaaccgggttaaccgggttcggttaacccgggtacccggttaccgggttaaccggtccggtaaaccccggtaccggtaacccgggtcccggttacccggtacccccggttccggtacccgtttacccgttccgggttacccctttaacccccgg

SEQ ID NO: 283746 - DNA, 768 bp, Homo sapiens
  misc_feature: GYAE6OF02H004N.47.85.H08.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (591)..(591): a, c, t, g, unknown or other
  misc_feature (591)..(591): n is a, c, g, or t
tcagagctcacgtacacgaccggtgctcgatttagtatcactcagtcgcggggggggtcgtcgaggaggcagcgctctcaggacatctccaccatcggcctgggctctgctgctcctcaccctcctcactcgagggcacgacgggtcctcgggcccagtctcggccccgactcgacgcctgccctccgtgtcgtcgggtctcgtcggacnggtcactcaacctntcgtctgctacgtggaaaccnggtagtcggtacgttggactaggttctgtacttctactcctcgtcggtaaccaacacgtaaccgacggactaaaccgacccctaaactactaattaacgtttatacgtaccgtactaacgttacgttccgccccgttagggtaacggttttccaccgtaagttccgtctttaccgttcgtcgggttacctaacctaaacgttcggacggtaaccctaaccgtacccgttccgtacccgtggtaacccttactccgttccggtacgggtaccggttacgtacgtcgttacgggtacggggaccacggggttcaacggttaacttttccgttacggttcgggtttacnccggtttacgggttacgtaaccggttaaacttcggttcggtttaccggtttgggttccgggttcgggtacggacgggttaacgacggtttaccggttacgtaccggtcggtacgcggtaccgtaacggtccgtacccgtcccggttaccggacctcggttcccgttccgttaccccg

SEQ ID NO: 283747 - DNA, 727 bp, Homo sapiens
  misc_feature: GYAE6OF02HNNRF.47.85.H08.1.454.CMB.1.raw
  modified_base (182)..(182): a, c, t, g, unknown or other
  misc_feature (182)..(182): n is a, c, g, or t
  modified_base (580)..(580): a, c, t, g, unknown or other
  misc_feature (580)..(580): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagcttgggtttttccctcgttgcttctttttaagnggttgtccagtgtcaggtgcgcctgggtggaggtcgggggagcgtggtccagccgtgggaccgtccctgacgcttctcctgtcgcacgcctcgtcggtcttccaccttacaaattaattatgctagtgcgtaggtcggtcccgccgaggcctccggaggacgaaggggtctaaggcggtgggggtcggtcggtcaagttacgtcggtaccaaggtcggtactacttccgttacaagtttattaccgcctaagtcccgtcccgtagggaccgggtccctagttaccaaccgtacgttctacccgtaacggaacgtaacctaacctttaccccgaaacgaaaccgttaccgggttaccttacgttaccgttaccgtacccgtaacccgttccggaacccnccgtaccggtacggaaacggttaaccgacggtaacccgaccgttacccgttcccttacccgtttacccgttaaccgttacggttcggttacggaccggtaggttaacggttacggttaccggtaacggttacggttacgtttaacgg

SEQ ID NO: 283748 - DNA, 648 bp, Homo sapiens
  misc_feature: GYAE6OF02IBPD7.47.85.H08.1.454.CMB.1.raw
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (612)..(612): a, c, t, g, unknown or other
  misc_feature (612)..(612): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
tcagagctcacgtacacgaccggtgctcgatttagtatcactcagtcgcggggtcctgggcccagtctgccccgactcagcctgcctccgtgtctgggtctcctgacagtcgatcaccatctcctgcactggaaccagtagtgacgttggcagttctgattctatctcctggtaccaacaaccacccaggcaaacgccccaaactcataattangacgtcaatcgttccncccctgtagggtttctcatcgcttctctggtctacctaaatctggtaccaacaccggtcccctacccgtcgacctattcctcgtcgggcctcggagttctaggacggacgaggtctagtacttacttcgtgttcgtcgttcgttaggcctaacttacgtggttacggttttgggtcggttcgggacgggtacggaacctaggttcgacccgttcgtacggtacacggacccgaacggtccgtccggtacccccgttcggtacctacgttccgttccggtttcccccgtacccttccgttaccgttaccggtcgtaccggtccgttcgtacggaccgggtccggtccgtacgggtaccgtaacgggtccggactaacgtacgntcgngcgngacgcgctcgntcgtacgcncncncntc

SEQ ID NO: 283749 - DNA, 699 bp, Homo sapiens
  misc_feature: GYAE6OF02G6HL6.47.85.H08.1.454.CMB.1.raw
  modified_base (585)..(585): a, c, t, g, unknown or other
  misc_feature (585)..(585): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctcgggcccagtcctcgcccccgactcagcctgccctcgtgtctgggtctccgtggacagtcgatcaccatcctcctgcacgtggaaccagtagtgacgttgctagttctgtattctatctctcgtaccaacaccaccaggaccaaaccgaccccaaactacaattaaacgtttatacggtaacttactaattccggttcccgtacccccgttacggttacgggttttcctactacgttccgttctttccgtcgtcggtcctaacctaagtcgtacgaccaaccgtcccgtcccttccctacgacctactccgtcgtcggtacctggtacgtcgtaggacgggaccgtagtcgttagttaaccgtttacgttcgttgttcgtcgttcggttcggaccttaaccgtttgttcgggtttcggtttacggggtcgtttaccggggngggtaaaccggtacgtaagtccggttacggtaccggttcggttacggaccgtaccggtacccgtaggtcccgtacccggttccccgtcggtaccgtacccgttccgttccccgg

SEQ ID NO: 283750 - DNA, 674 bp, Homo sapiens
  misc_feature: GYAE6OF02H8FUC.47.85.H08.1.454.CMB.1.raw
  modified_base (314)..(314): a, c, t, g, unknown or other
  misc_feature (314)..(314): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
tcagagctcacgtacacgaccggtgctcgatttagtatcactcagtcggcgggggggggtctcaggaggcagcgctctcaggacatctccaccatggcctgggctctgctgctcctcaccctcctcactcagggcacgagggtcctgggcccagtctcgccccgactcagcctgcctccgtgtcgtgggtctccgtggactagtcgatcaccatctcctgcacgtaggaacctaggtagtgtacgttggctagttctgtattctatctctgtaccaacaacaccagaccaacgaccccaactacaattaattangtactactaatcgtccncctcgtacggttcncatctcttctctcgctactaatcgtacgacctaacaccgtccctaccgtacgaccctactaccgtcggtcgggtcctacggtacgtcgtggaacgggaccgtaggtacttacggttactttacgttcgttagttcgtcgttaccggttacgggtaccttaacgttccgttgggtttccgggttttacggggtcgtttaccggggacgggtaaccgggtaccgttaacggttaccggtacccggttacgtaacggtaccgtaccggacccgtacggtcccgttcccggccccgttaccggtacctacgtttccccgtacgttccccccgg

SEQ ID NO: 283751 - DNA, 861 bp, Homo sapiens
  misc_feature: GYAE6OF02F4PBG.47.85.H08.1.454.CMB.1.raw
  modified_base (175)..(175): a, c, t, g, unknown or other
  misc_feature (175)..(175): n is a, c, g, or t
  modified_base (265)..(265): a, c, t, g, unknown or other
  misc_feature (265)..(265): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccatggagtttgggctgagcttgggttttcctcgttgcttcttttaagnggtgtccagtgtcgaggtgcgcctggtggaggtcggggggaggcgtggtccagccgtgggacgtccctgacgactctcctgtgcagcctntggcttcaccttacaattaacttatgactatgctaggtcgggtcccgcgaggtcctccgaaggccggaaagggggtcttaagggaggttcgggggtcggaccgggttcaacgttacgttccggttacccgaaggggttcgggaaacctacgtttcccgtttacgtaaacggtttaaacgtttaccgacgtaaaccgggtaccccgtttacccccggtaggggggaacccgggggtaccccgttaaacgttttaccccggaaacccttaacgttaccccgttaaccccggaaagggtaaacccgtaaacccgttaaaacccgttacccccgtaaaacgggaaaacccgttacccggggtttaccttaacgtttcccgttaaccggtaccccgttaaccccggttaccgggaaaccctacgggtaccccgttaagggaaaccgttaaaccgtaccgggaaacccgtaaccgttacccgtttccttacccgttaccgtttaacccttaccggtacggttacggtaaccgggtaacggttaagggttacgggtttacgggaaaccggttacggtttaccggttaggtttaggtaaccggg

SEQ ID NO: 283752 - DNA, 628 bp, Homo sapiens
  misc_feature: GYAE6OF02IFCAB.47.85.H08.1.454.CMB.1.raw
  modified_base (348)..(348): a, c, t, g, unknown or other
  misc_feature (348)..(348): n is a, c, g, or t
  modified_base (471)..(471): a, c, t, g, unknown or other
  misc_feature (471)..(471): n is a, c, g, or t
tcagagctcacgtacacgaccggtgctcgatttagtatcactcagtcgggggaggcgtggtccagcctgggacgtccctgagactctcctgtgcagcctctggcttcaccttcaataattatgctatgcagtgggtccgccaggctccaggcaaggggctagagtgggtggcggtcatatcgtccagtggacatcttcagtattacgcagactcctgacgggcattcaccatctccagagacaacttcccaagaacacggtctagtctgcacctgaccagcctagagaactgaacgacacgtctctctaacctctagtgcgagtacgagttgacgagtcattgtgagntttcgacctaccgtggggaccaacggggaacccttggtcacgttccgtctccgtactacgtcccttccgaacccgaaacgggtcccctacgttaccggttccctttcccccgtcgggtccccncccgttccggccttaccggaacgggtaccgacccgacccgttccggaacggacgcccaccgaccggccgtacccggtccgggcgtcggccgtaccgggtcctaacgggtaacccttacggttcccgaacggtccggtacgtcccgtcgtaggaccgg

SEQ ID NO: 283753 - DNA, 696 bp, Homo sapiens
  misc_feature: GYAE6OF02JLIZJ.47.85.H08.1.454.CMB.1.raw
  modified_base (136)..(136): a, c, t, g, unknown or other
  misc_feature (136)..(136): n is a, c, g, or t
  modified_base (205)..(205): a, c, t, g, unknown or other
  misc_feature (205)..(205): n is a, c, g, or t
tcagagctcacgtacacgaccggtgctcgatttagtatcactcagtcgcggggggggtctcaggaggcagcgctctcaggacatctccaccatggcctgggctctgctgcctcctcaccctcctcactcaggcacngggtcctgggcccagtctcgccccgatcagcctgcctccgtgtctggtctcctggacagtcgatcaccntctcctgcactggaacctgtacgtgacgttgctagttctgtattctactctctcgtaacctaacaaccaccgaggaccaaaccgacccccaaactcaattaactttatacgactactaatcgttccgcccctggtacgggttctctactccgtcttcctcgtcgtacctactaaagtcgtgacctaccgtaccggtcccttacccgacgtaaccctcgttaccttccggtcgggtccttaccggtcgttcgtaggacgggtacggacggtctacgttactttaccgtttcgttgttccgttcgtccgttacggtaccttaacgttacgtttgggtttccggttttagggtcggttaccggggtacgggtaaccgggtacgtacggtttaccggccgttacccggttagtacccgacggttacccgaacggttcccgtacccggtcccccggttacggtaccctaccggtttcccgttacccgttcccccgg

SEQ ID NO: 283754 - DNA, 775 bp, Homo sapiens
  misc_feature: GYAE6OF02JT1ES.47.85.H08.1.454.CMB.1.raw
  modified_base (155)..(155): a, c, t, g, unknown or other
  misc_feature (155)..(155): n is a, c, g, or t
tcagagctcacgtacacgaccggtgctcgatttagtatcactcagtcgcggggggggtcgtcgaggaggcagcgctctcaggacatctccaccatggcctgggctctgctgctcctcaccctcctcacctcagggcacagggtcctcggggcccngtctcgccccgactcacgcctcgcctcccgtgtccgtggtcctccgtggacagtcgactcaccatcgtcctgactactcgggaaccagtacgtcggacgttggctagtttccgtggtctttacgtacttccgtccgttcggtaccctaaacgaaccaccccgagggaaccaaaaccggtccccccaaaacgtcctaattaaagtttactacgtaccgttactaacgtttcgttacccgccccttacgtacggggtttcctaccgtacgttaccgcgttttacccgtcgtcgggttcctaacccgtaaaagttcccggttaaggaccctaaaccggacccggtaccccttcccgtaacgggtaaccctcggttcctaccggtccggcgttaacggtccgtacggttacggacggtaacggtcggacgttacgtaccgttttacgttcgttacgttccgtcggttaccgttggtacctaacgtaccgtttcgggttcgttcgggttcgttacggcgggtaacggtacgtacggtcgtaccggtaccgttacggccgtacggtacgtaacggtccgtacccgtccccggtagttcccgtaccgttcccgtcccggttccccgg

SEQ ID NO: 283755 - DNA, 658 bp, Homo sapiens
  misc_feature: GYAE6OF02FZ6XV.47.85.H08.1.454.CMB.1.raw
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
  modified_base (645)..(645): a, c, t, g, unknown or other
  misc_feature (645)..(645): n is a, c, g, or t
  modified_base (655)..(656): a, c, t, g, unknown or other
  misc_feature (655)..(656): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaaactcataatttatgacgtcaatgttccgcccctcaggggtttctcatcgtcttctctggctaccaaatctgcaacacggcctcctgaccatctcgtgggctcgagtctgacggtacgaggctagtactttacttcgttgttcgtcgttcgtcgggactaacgtacgttcggtttcggttttggggtcggtttccgggacgggtaacggggtaaccttaacgggtttacggtacccggtttaccgttacgggtaccgtaacggaccccgtaaagggtcccgttccggtaccccccgttcgggttaccctaccgtttccgttacccggttcccccgtcccttcccgttacgttaccgttcgacgtccgttcgtcggacggtccggtctcgggacgtacggaccgtcgaacgtacgactgcgtacgcgtcgngtcgngtcgtcncgcgcgacgnncg

SEQ ID NO: 283756 - DNA, 635 bp, Homo sapiens
  misc_feature: GYAE6OF02FNBHR.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggctagttctgattctatcctcctggtaccaacaaccacccaggccaaacgcccccaaatccaattaatttaatcgactacaatcgttccgcccctctaggggtttctcatcgtcttctctgtctacaaatctgacaacacgccctcctcgaccatctctcgggctcgagtctgacggcgaggtctgtactttacttcgttgttcgtacttcggttgggacctaacgttacgttcggtttcgggttttggggttcggtttaccgggacgggttacgggaaccgtaaggtttcccgaccggttccgttaacgggtccgaaccgggcccgtaacggtcccggttacccggtaccccccggttcggttaccctaccggttcccgtttaccgtttacccccccg

SEQ ID NO: 283757 - DNA, 713 bp, Homo sapiens
  misc_feature: GYAE6OF02GZOLZ.47.85.H08.1.454.CMB.1.raw
  modified_base (155)..(155): a, c, t, g, unknown or other
  misc_feature (155)..(155): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtcncgccccgatcagcctgcctcgtgtctgggtctccgtggacagtcgatcacctatcctcctgctacgtggaacctagtagtgacggttgctatttctgtattctatctcgtagtaaccaacaacaccgaggaccaaaccgacccctaaactctaattaactttagtacgtacgtactaacgttcgttccgtccccttaggtacgggtttacacctacgttccgttcttaccgttcctacgggtcctaaccgtaaacgttcgtaccgaaccgtaaccgtacccggtccctacccgtaccgtaaccctacgttcccgtacggtcgggtccgtacggtacgttcgtacgggtacggtacggtacggtcgttacgttactttacgttcgttagttcgtcgttcggttacggtacctaacgttcgttgtttacgggttcgggttgggttaccggacgggtaaccgggtacgtacggttaccgtaccggttcgtacggtacgacggtaacccgacgtccgttaccccgtcccggttctacccgtacgttccgtcccgttcccccg

SEQ ID NO: 283758 - DNA, 676 bp, Homo sapiens
  misc_feature: GYAE6OF02HTJAX.47.85.H08.1.454.CMB.1.raw
  modified_base (341)..(341): a, c, t, g, unknown or other
  misc_feature (341)..(341): n is a, c, g, or t
  modified_base (400)..(400): a, c, t, g, unknown or other
  misc_feature (400)..(400): n is a, c, g, or t
tcagagctcacgtacacgaccggtgctcgatttagtatcactcagtcggcgggggggggtctcaggaggcagcgctctcaggacatctccaccatggcctgggctctgctgctcctcaccctcctcactcagggcacgagggtcctgggcccagtctcgcccgactcagcctgcctccgtgtctgggtctccgtggacaggtcgactccaccatctccgtcgactcgtacggaaccagtacgtgacggttggcgtagttctgtacttctatctctacgtaaccaacaacaccagaccaaacgccccaaatcattatttacgagtactataactcggtaccnccccgtagttacgggttcctactacgtgttcctctcgttcgctacaatcgcgactaacnccgtacctcctagccctatctcgtcggcctaggtatcgtcggaggtacgagggtccttaggttaacgtttctaccggttgttcgcgtttcgcggtaacgtacctttaggtcggttttcgggttacgggttacggttcggggacgggtacggtaacgtacgggttcgtacccggttaccggtacggtaccgtaaccgggtaccctaacgggcccgtttacccggaccccggtttaccgggttccctttaccggttttaccccggtccccttccccgg

SEQ ID NO: 283759 - DNA, 559 bp, Homo sapiens
  misc_feature: GYAE6OF02GUUO0.47.85.H08.1.454.CMB.1.raw
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
  modified_base (543)..(543): a, c, t, g, unknown or other
  misc_feature (543)..(543): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctccgtggacagtcgatcaccatctcctgcactggaaccagtagtgacgttggcagttctgattctatctcctggtaccaacaacacccaggcaaacgccccaaactcataatttangacgtnaatgttcgcccctgtacgggtttctcatcgcttctctggctccaaatctgcaacgcgcctccctgacctatcctctcgggcctcggagttctggacggacgaggcctaggtactttacgttcttgttcgtcttcgttcggactaacgttacgtgttcggtttgggtcgttcgggcggtaaggacctaagttcgaccgtcgtaggtcacggccaaggtctccgccccgtggtaccncgttcgtcgttccccg

SEQ ID NO: 283760 - DNA, 556 bp, Homo sapiens
  misc_feature: GYAE6OF02HCYCH.47.85.H08.1.454.CMB.1.raw
  modified_base (299)..(299): a, c, t, g, unknown or other
  misc_feature (299)..(299): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgccctcgtgtctgggtctccgtggacagtcgatcaccatcctcctgccactggaaccagtagtcgacgttggcagttctgtattctatctctgtaccaacaacaccagcaacgccccaatcaatattangacgtnaatcgtccnccctgtagggttctnactcgtcttctctgtcctacaatcgtgcaacgacgcctcctcgacctatctcgnggctcgagttcagacgacgagtctgtattcgttntcgttctctcgtcggactactcgtgttcgtttgggcgttcgggagtagggtacctaaggttcgaccggttacgtcggtaccacggacccgtacggcgttcccgtccccgtacggtcctaccgttccgtaccgttccccg

SEQ ID NO: 283761 - DNA, 803 bp, Homo sapiens
  misc_feature: GYAE6OF02H6ZUZ.47.85.H08.1.454.CMB.1.raw
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
tcagagctcacgtacacgaccggtgctcgatttagtatcactcagtcgcggggctgggagaggagcccagcactggaagtcgccggtgtttccattcggtgatcagcactgaacacagaggactcaccatggagtttgggctgagcgttgggttttcctcgttgcttctttttaagaggtgtccagtgtcgaggtgcgccgtgggtggagggtcggggggaggcgtggtccagccgtggggaccgttcctggacgtacctcgtccgtggtcgcgcgccttcgtcggtacctttccgaccttanaaaattaattagtgtaccttatcgtacgtacggttcgggtccccnccgtaaggccctaccgagggacggtaacggggcttaagggacgggtggggttacggtcggtacgtaacttacgtcccgtaccggtaggttacggtaactcgtttaccgtttacgaaagggtttaactttaaccggaccgttaaccggtacccttccccgggagggaccggggtccgtaacgtttaccacctaacgttctacccggaagtaaccgaacgtaaccttacccaacggaaaccgttaccgtacgttaactcgtacgacccttaccgaccgaaccgaccgtaccgtaggtaaaccgtaaccgtaaccgggaaccgtaaaccgttcccttaaccgttacccttacccggtttaaagttaccccgtacgggttacggaaccggttaaggtaacgggtttaacggtacgggtaaaccggttaccgttttaacggtacggttttggaacccggg

SEQ ID NO: 283762 - DNA, 731 bp, Homo sapiens
  misc_feature: GYAE6OF02FM8O8.47.85.H08.1.454.CMB.1.raw
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (350)..(350): a, c, t, g, unknown or other
  misc_feature (350)..(350): n is a, c, g, or t
tcagagctcacgtacacgaccggtgctcgatttagtatcactcagtcgcgggggctggggtctcaggaggcagcgctctcaggacatctccacatggcctgggctctgctgctcctcaccctcctcactcagggcacagggtcctgggcccagtctgcccccgatcagcctgcctccgtgtctgggtctcctggacngtcgatcacccatctcctgcactggaaccaggtagtgacggttcgntagtctgacttctatctcctggtaaccaacaacacccgtaggcaaacgccccaaactctaattaatttatagacgtacaattcggttccacccctgtacgggtttcncatcgtcctttcgtctcggtcctacctaaatcgtcggactaaccgaccggtccctcccgtacgacctactcgttacgtcgggtcctccggtagttaccgtacgggtaacggacccgggaagggttacctacgggttaaacgttttacctttacggtttcggtttaacggtcccgttttacgggttaccggggtaacccttaaaccgttaacgtttcgggttttacggggttttacgggtttcgggttaccggggtaccggggtaaccgggtacccgttaaggtttcccggaacccggtttaccgtaaccgggttaccgaccgtacccggaagggttccctacccgggtcccccgttaccgggttccctacccgttacccgg

SEQ ID NO: 283763 - DNA, 610 bp, Homo sapiens
  misc_feature: GYAE6OF02GVA0V.47.85.H08.1.454.CMB.1.raw
  modified_base (449)..(449): a, c, t, g, unknown or other
  misc_feature (449)..(449): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctcgccccgactcagcctgcctccgtgtctgggtctccgtggacagtcgatcaccatcctctgcactggaaccagtagtgacgttggctagttctgattctatctcctgtaccaacaacaccaggacaaacgccccaaactcataatttatgtacgtcaatgttccgtcccctcgtagggtttcctctatccgtcttctctcggctaccaatctgacaacaccggtccctcctacgacctactctcgtcgggctcgagtcgtggacggcgacggctacgttattacgtttctgttcncgttcgttcgggctaacgttacgttgttcgggtttagggttcggttcgggcggtacgggacctaggtttacgtaccggttacgtacgggtaccacggtacccgaacggtcccgttcccggtccccgttaccggtcctaccgttcccgttacgttccccccg

SEQ ID NO: 283764 - DNA, 783 bp, Homo sapiens
  misc_feature: GYAE6OF02H562B.47.85.H08.1.454.CMB.1.raw
  modified_base (547)..(547): a, c, t, g, unknown or other
  misc_feature (547)..(547): n is a, c, g, or t
tcagagctcacgtacacgaccggtgctcgatttagtatcactcagtcgcgggggggggtctcaggaggcagcgctctcaggacatctccaccatggcctggctctgctgctcctcaccctcctcactcagggccacgacgggtcctcgggccccaggtcctcggccccgactcgacgcctcggcctccggtgtcgtcgggtactccgtggacctacgtcgatccaccatcctcctgcctacgtacgggaaccagtcggtacggtacgttgggctaggttctgtacttcgtacttctccgtacggtacccaaataacccacccgacgaccaaaccgacccccaaaactctaaatttaacttttacgacgtacgtactaagttcgttacccgccccgttagtacggggttttccctaccgtagttccgttccttccgtacgtcgtaccctactaaaccgtcgtaccggacaaacccgacccggtccctcccgtaaccgttaactccgtaccgtccggttacgggtccgttacggtcggtactaccgggnggtacccggaggtccgtagttactttacgttcgttcgttacggttcttcggttgggaccttaaccgttcggttcgtttcgggtttcggttaccgggttcggggccgggtaaatacccgggttaaaggttccccgggaaccggtttaacgccgggttacgaaccggtacccgggtacgtccccggttaccctacccgggtttccgtacccgtacttacccggtccccgttacccccg

SEQ ID NO: 283765 - DNA, 610 bp, Homo sapiens
  misc_feature: GYAE6OF02G26MJ.47.85.H08.1.454.CMB.1.raw
  modified_base (198)..(198): a, c, t, g, unknown or other
  misc_feature (198)..(198): n is a, c, g, or t
  modified_base (316)..(316): a, c, t, g, unknown or other
  misc_feature (316)..(316): n is a, c, g, or t
  modified_base (324)..(324): a, c, t, g, unknown or other
  misc_feature (324)..(324): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggcccagtctcggccccgactcagcctgcctccgtgtctgggtctcctggacngtcgactcaaccatcctccgtgccacgtacggaacctagtacggtgacggttggctagttctgacttctatcctcctagtaccaacacaccaggaccaaacgcccaactcataattangactcatntccgccctgtaggttctcatcgtctctctcgctacaatcgtacgacacgaccgtcctccacgacctactcgtcgtcggtcgtggtacgtcgtagacggtagacggtctagttaacttacgtttcgttgttacgtctttcggtacggtactaacttcgttgtttcgggttggttacgggttcgggacggtacgggtactaggttaccgtaccggtacgtacgtaccacggtaacccgtacgtcgtcccgtcccgtacggtccctacgttacccgttcccttcccccg

SEQ ID NO: 283766 - DNA, 842 bp, Homo sapiens
  misc_feature: GYAE6OF02GVZKF.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggcccagtctcgccccgactcagcctgccctcgtgtcgtgggtctccgtggacagtcgatcaccatctcctgcacgtggaacctagttagtcgtacgtttggactaggttctagtattactatcctccgtaggtaaccaacaaccaccacggaccaaaacgacccccgaaactacaattaaactttagtacgacgtactaagttcgtccggtacccctacggttaggggtttcctacctacgtccgtactttccgtcgttacgtaccgttaaccaaaacgttcgtacggaaccctaaaccgtacccggtaccccgtaccccgtcggaacccttacttcccgtaccgggtcggggtccgtaccgggtaacggtttccgtaacggggtaacggggtaaccggtacgggtacccgttaggtaaaccgtttttacccgttaacggtttacgggtttacgttccggttttaccgggttacgggtaaccctttaaaccgtttaccggtttggggttttacccgggttttggggttccgggtttacggggaccggttaacgggggaacgttacggttacgggttacccccggttacggtaacgggtacccggtaccgggtaaccccgtaagggtcccttacccgggttaccccccgttccggggtaccctttacccggttacccgttaccccgttcccccccg

SEQ ID NO: 283767 - DNA, 741 bp, Homo sapiens
  misc_feature: GYAE6OF02JN8JO.47.85.H08.1.454.CMB.1.raw
  modified_base (244)..(244): a, c, t, g, unknown or other
  misc_feature (244)..(244): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
tcagagctcacgtacacgaccggtgctcgatttagtatcactcagtcgcggggggggtcgtcgaggaggcagcgctctcaggacatctccaccatggcctgggctctgctgctcctcaccctcctcacctcgagggcgacggggtcctcgggcccagtctcgccccgctcacgctgcctccgtgtcgtgggtctccgtggtacagttcgatcaccatctcctgccactacggaccaaggttcgngtacggttgccngttcngtattctagtcctctcggaactaacgaaccacccgacgacgaaaccaccccaaacctagattaattacagcgtaaccagttacgttccctaccccgttcggtacgggtttctacgtacttcgtccttcgtcgtacgtccgttacaactttcgacgacgtaaacccgaccgtcctacccggtacaaccttgtccttcggtacgccttacggtcgtacgtacgaggtacgacgtcgtacggtacttacgttcgtttcggtccgtcgttaacgttggggtaccctaaaccgtttcttccggggttttgggttttacggggtcggttttaccgggaccgggttaacgggaacccggtttacgggttacccgtaccgggtttacgtccgggttaaccgtaccggaccgtaccggttaaccgttcccgggtaacccccgttccgggacccttaccggtccgtttccccggtaccccctttccccgg

SEQ ID NO: 283768 - DNA, 688 bp, Homo sapiens
  misc_feature: GYAE6OF02IMCXP.47.85.H08.1.454.CMB.1.raw
  modified_base (137)..(137): a, c, t, g, unknown or other
  misc_feature (137)..(137): n is a, c, g, or t
  modified_base (379)..(379): a, c, t, g, unknown or other
  misc_feature (379)..(379): n is a, c, g, or t
  modified_base (532)..(532): a, c, t, g, unknown or other
  misc_feature (532)..(532): n is a, c, g, or t
tcagagctcacgtacacgaccggtgctcgatttagtatcactcagtcgcgggggggtctcaggaggcagcgctctcaggacatctccaccatggcctgggctctgctgctcctcaccctcctcactcgagggcacgngggtcctgggacccagtctcgccccgactcagcctgccctccgtgtcgtcgggtctccgtggacagtcgatccaccatcctcgtgacactaggaacctagtgtcgtaacgtcggctaggtctagtacttctactccgtcgtacgtaaccaacaccgaaccgacgaccaaaccgaccccaactactaacttaacgtataccgtactactaacgtcgttaccgtcccttggttaacgggttctntacgtctcttcgtcgtcggtctaactaaacgttcgacgtccaacgccgtcctaccctacgacctacgtcgtaccggtcggtctaccggtagttacgtcggaaagtccggtaagtcgtagttaacctttgttacgtcgtacgtcgtaccggttnaaccggttaaccttggtccggtttaccgggtttgggttacggttacggggtaccgtaaacgggtcgtaacggttccggtaccgttacggtacgtcggaaccgtccggacgttccgacccggtccctaccggttacacgttcccgtaccttccccgg

SEQ ID NO: 283769 - DNA, 646 bp, Homo sapiens
  misc_feature: GYAE6OF02JSY0T.47.85.H08.1.454.CMB.1.raw
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (591)..(591): a, c, t, g, unknown or other
  misc_feature (591)..(591): n is a, c, g, or t
  modified_base (596)..(596): a, c, t, g, unknown or other
  misc_feature (596)..(596): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcgagggccacgacgggtccgtcgggaccccagttccgtcggcccccgacttcgacgccctgcctccgtagtatcgggtctcgtggaccagtcgatccaccatcctcctgcctagtcggaaccagtacggtgacgttggctagttctgtattctatctcctaggtaacccaanaacaccgagaccaaacgccccaaacgtcaattagtttacngaccgtctaatttcgtccgcccttacggtgggtttcctacacgttcgtacttcgtcgtcgtacctacctaacgttcgacgttacaaccgccgtacccttccgacgtaaccgtctacgtcgtacggtacgtcgacgtcgttacgacggtacgacgcgtgttacttcgttacttgttacgtcgttcgttacggtacctacgtaccgttggttcgtttacggtcggtcgacggtacgtacgacgttcgacgttcncggtntcgacgtacgaccgtcgacccgttcggacttaccgcgttaccgtccccgg

SEQ ID NO: 283770 - DNA, 592 bp, Homo sapiens
  misc_feature: GYAE6OF02HAAQ1.47.85.H08.1.454.CMB.1.raw
  modified_base (174)..(174): a, c, t, g, unknown or other
  misc_feature (174)..(174): n is a, c, g, or t
  modified_base (285)..(285): a, c, t, g, unknown or other
  misc_feature (285)..(285): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
  modified_base (480)..(480): a, c, t, g, unknown or other
  misc_feature (480)..(480): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagctgggttttcctcgttgctcttttaagnggtgtccagtgtcaggtgcgcctggtggaggtcggggggaggcgtggtccagcctgggacgtccctgagactctcctgtgcacgcctcgtggcttcaccttcaattaattntgcttatgactaggtcggggtccgccgaggcctccgaggcgaaggggctaggaggtgggnggcggtcatatccgtaccaggtggactntcttcgagttattacgcacgacctcccgtagggcggggcctattccaccacttccacgagagactaactcccaagaaccacgtctactctcgaccacctacgaaccncgacctagaacgacctacgaacgacctacgttcctacgttacctaccgttacttcggtagaccggaaggtacggtacggttacggaacgttacgtacttagtttaggtacgg

SEQ ID NO: 283771 - DNA, 745 bp, Homo sapiens
  misc_feature: GYAE6OF02G5F7U.47.85.H08.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacgagggtcctgggcccagtctcggccccgatcagcctgcctcgtgtcgtggtctccgtggacngtcatccacntctcctgccactggaaccngtagtgacgttgctagttctgtattctatcctcctacggtaacctaacaacacccaggaccaaaccgacccctaactactacttaatttatacgtacgtactaacgttcgttccgtaccccgttcggttagggtttaccctctaacgtcctacgttccttactcggtaccttacctaactccgtcggacctaaccgtaccgtcccttacccgtctaacccgtacgtacctcgtacgggtcttacggtcgtctacggacggacggtacgtcgttacgttaactttacgttcgttgttacgtccgtttccggttacgggtaccttaacgttacgtttcgggttacgggtttcggggttcggtttaccggggtacgggtaaccgggtacgttaaccgggtaccggttacccggttaaccggttcggtacccgtaaccggacccggtaaccgggtcccggttcccggttaccccggttaccggttcccggttaaccttcccgttacccggtttcccccccgg

SEQ ID NO: 283772 - DNA, 814 bp, Homo sapiens
  misc_feature: GYAE6OF02I63E2.47.85.H08.1.454.CMB.1.raw
  modified_base (256)..(256): a, c, t, g, unknown or other
  misc_feature (256)..(256): n is a, c, g, or t
  modified_base (355)..(355): a, c, t, g, unknown or other
  misc_feature (355)..(355): n is a, c, g, or t
tcagagctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctcgccccgatcagcctgcctcgtgtctcggtctccgtggacagtcgatcacctacttctcctgccacgtcggaaaccagtagtcgtacggttggctagttcntagttctatctcgtcgtacaacaaccaccagacaaaccacccaacgtctattaattacgtacgtacgtactacttcgtccgcccgtcgtacgggtttcnctactcgtcttctcgtctacctaccaagtcgtacgaccgaacgtacccgtccctaccgttacgaccgttacgtcgttaccggtcgggtaaccgttccggtacgttacgtacgggtacggtaacggtacgggtaccgtttaacgttacgttttaaccgtttacggtttacggtttccgttaccggttttaccgggtttaccgggttaaccgtttaaacccgttttccgggttttaccgggttttccgggggttttttaccggggttaccggggtttttaccggggacccggggtttaaacggggttaacccgtttaacgggttacccgggttacccggttaacccggttcccgggttaaccgtaaccggtacccggttaacccgggttccccgttacccgttcccccggttaaccggtttacccctaccggttttccccgttaccccgtttaaccccccg

SEQ ID NO: 283773 - DNA, 683 bp, Homo sapiens
  misc_feature: GYAE6OF02IHD6D.47.85.H08.1.454.CMB.1.raw
  modified_base (271)..(271): a, c, t, g, unknown or other
  misc_feature (271)..(271): n is a, c, g, or t
  modified_base (470)..(470): a, c, t, g, unknown or other
  misc_feature (470)..(470): n is a, c, g, or t
  modified_base (562)..(562): a, c, t, g, unknown or other
  misc_feature (562)..(562): n is a, c, g, or t
tcagagctcacgtacacgaccggtgctcgatttagtatcactcagtcgcggggagagaggagcccagcactggaagtcgccggttgtttccattcggtgatcagcactgaacacagaggactcaccagtggagtttgggctgagcgttgggttttcctcggtttgtccttcgttttaaggaggttgtcctagttgtcgaggtcgtcgccgtgggtggaggtcgggggaggtcgtaggtccaggccgtgggaccctcccgtgacgtcttccnccgtgtacgtcacgtccttcgtgtcctttcctacctttagtaaaattaacgttatcggacttatggtccgaggttccgggtccctacgacggtccttaccggaaggtcggaaacggggtcgtaagggtggttacggggtcggtccggtacagtttcgccgtacgtagggtcgactacgttctaacgtagtaaacgtccngaacgtccctcgtagggccggtatacgtcaccgtcttaccgactagaaccgtaactactaaccgtacgaacggttcgtctaacgtctcgacnccttacgaccgtagcccgtaggacctaacgcgaaccgtacgtacgtcttaccgtactacttcggacggtacacggtaacggtagtaggttcgacggttacgtcgtaagttccgtaggtacg

SEQ ID NO: 283774 - DNA, 559 bp, Homo sapiens
  misc_feature: GYAE6OF02JTZZA.47.85.H08.1.454.CMB.1.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
  modified_base (467)..(467): a, c, t, g, unknown or other
  misc_feature (467)..(467): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggtttcctcgttgctctttaagaggtgtccagtgtcaggtgcgctggtggaggtcggggggagcgtggtccagccgtgggacgtccctgagctctcctgtncagcctctggcttacacttcaatatatgctatcgcgaggttcggccnccgaggtccaccgaggacgacggggntaacggngggtggggtggcggtcaatgtcggtcaggtgactacgttctanagttataccgngtaacgtccgtcccgnggacgggccgtatccgaccngtcctcagactaccgtactccaagacctaacgtctactcgtacnccacgtacgaccacgtcctagacaacgtcgacaaccgtcgtactactctacctagtcgtagcgtaacgcgtaggttcgacgtagtcctaagg

SEQ ID NO: 283775 - DNA, 617 bp, Homo sapiens
  misc_feature: GYAE6OF02GNQOA.47.85.H08.1.454.CMB.1.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgatcagcctgcctccgtgtctggtctcctggacngtcgatcaccntctctgcactggaaccngtagtgacgttgctagttctgtattctatctcctcgtaaccaacaacaccagacaaacgaccccaaactcattaattatcgacgtactaattcgttccgccccttcgtacggggtttctactactccgtctttctcgtcgcctactaaatcgtacggaccaacgaccggtccctcccgtacgacctatccgtacgtcggtccgtcggacgttcgtaggacgggaggacggtctcgttaactttaccgttcgttacgttcgtcgttcgttacgggacctaacgttacgttcggtttcggtttgggttcggttcgggacgggtacgtacgtagtcggtacctacgtcgacgtacgaccgagtccgtcgccccgtcggtcctacgtccgtccgtccccg

SEQ ID NO: 283776 - DNA, 682 bp, Homo sapiens
  misc_feature: GYAE6OF02I4UCG.47.85.H08.1.454.CMB.1.raw
  modified_base (314)..(314): a, c, t, g, unknown or other
  misc_feature (314)..(314): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagctgggttttcctcgttgcttcttttaagaggtgtccagtgtcaggtcgcgcctgggtggaggtcggggggaggcggtggtccgaggcccgtgggtaccgtcccgtggacgtacctcctcctgtcgcacgtcctcgtggtccttccgtaccttacaaattaacttntgtctagtgcgtaggtcggtccgacgacggtcctccgacggacggaagggcgtaggaggtcggggtggcgtctacgtcgtcggtcagtacgactcgtcttagtagttacgtacgacgtacgtaccgtccgtacggacgggtaccgtaacgtccgacctacgttccgaccgaacggaaccgtaacctaaaccgttacccgaaacggtaaaccgtaccggtacttacgtccgtacgaccctacccgacgtaacccgacgaccgtacggaacgtaacgtacggaacctaaccgtaccgttccctaccgttaaccgttaccctagtacggtacgtacggtacgaaggttcgtaacggtacgtagtagtacgg

SEQ ID NO: 283777 - DNA, 635 bp, Homo sapiens
  misc_feature: GYAE6OF02FGBJQ.47.85.H08.1.454.CMB.1.raw
  modified_base (309)..(309): a, c, t, g, unknown or other
  misc_feature (309)..(309): n is a, c, g, or t
tcagagctcacgtacacgaccggtgctcgatttagtatcactcagtcgcggggagctctgggagaggagccccagcactggaagtcgccggtgtttccattcggtgatcagcactgaacacagaggactcaccatggagttttgggctgagctggttttcctcgttgcttcttttaagaggtgtccagtgtcaggtgcgcctggtggaggtcggggggaggcgtggtccagccgttgggacgtccctgagactctccgtgtgcacgcctcgtggtccttccaccgtttcaaattaattacgtgccttancgtcgaggttcgggtcccgccaggcctccggaaggtccgaaggggctaggaggtgggggtagccggtcatagtccgtaccgaggtggactagttcttgtacgttattacgcgtaacgtaccctccgtggtacggggcctagttacccaccgtactccgtaccaggaactaacgtaacctttacccgaagaaaccgtaccggtcttacgtctacgccctacgttaccgaactacggacccttaggaactaacgtccgaactacctcgtacctccgtcctaactacgtacgtcgaccgaggtacgtacgttacgaccgtagtctacgg

SEQ ID NO: 283778 - DNA, 696 bp, Homo sapiens
  misc_feature: GYAE6OF02GKGMU.47.85.H08.1.454.CMB.1.raw
  modified_base (272)..(272): a, c, t, g, unknown or other
  misc_feature (272)..(272): n is a, c, g, or t
  modified_base (297)..(297): a, c, t, g, unknown or other
  misc_feature (297)..(297): n is a, c, g, or t
  modified_base (315)..(315): a, c, t, g, unknown or other
  misc_feature (315)..(315): n is a, c, g, or t
tcagagctcacgtacacgaccggtgctcgatttagtatcactcagtcgcggggctgggagaggagcccagcacgtggaagtcgccggtgtttccattcggtgatcagcactgaacacagaggactcaccatggtaggtttgggctgagtcttgggttttcctcgttgtcttcttttaagaggtcgtccagtgtcgaggtgcgccgtgggtggagggtcgggggaggcgtggtccaggccgtgggccgtcccgtgacgtcctctccgtgtgcncgtcctcgtggtccttccaccttanaaacttattatcgtactntcgcgtaggtcgggtaccgacgtacggcctaccggagggaccgtaggggtctagggtacgggttggggtccggtacggttacagtaccgttccggtaccgtaaggtccggaactacgtttcgttacgtaagttaacttacgcaccgtaccgtcccgagggcgggtaccgtacttccgaacctactccgtacgaacgtacgtaactaaccgtacccgaacgtaaccgtaccgtacttacgtctcgacctacgtacaccgtacgtaccgtagaacgtaacgtacggaacctaccgtacccgttactaccttaccgttaccgtacgtacggtacgtacggtacggtagtacggttacggaccgtagtaccgttagtacgtacgg

SEQ ID NO: 283779 - DNA, 800 bp, Homo sapiens
  misc_feature: GYAE6OF02F8AIB.47.85.H08.1.454.CMB.1.raw
tcagagctcacgtacacgaccggtgctcgatttagtatcactcagtcgcgggggagctctgggagaggagcccagcactggaagtcgccggtgtttccattcggtgatcagcactgaacacagaggactcaccatggaattggggctgagctgggttttccttgttgctattttagaaggtgtccagtgtgaggtgcaattggtgcaatcgtgggggagcttggtccagccgtcggggggtccctcagactctcctgtgcacgcctcgtggtattcctacctttacgttcctcgttggatagtaagtttcgggtccgaccagaccttacccggaaggggaacggggtcgtagggagggttggggttacggacgtaaaccaataaaacgtccaagacgtaggaacgtacgaaagtaaaacccgtagtaggtacggtaccttcgttacgtaggaacgggtccgtaatttaccaaccgtactaccgtacccgtaaggaaccgtaaccaaacccggaccctaaaacggtaacccgtttaccgtttacgtttacggttttaccgtaccgtaaaccgtttaaaacggttacgggtaacccgaaccggttacccgttaaggggaaccggttaaccgggtaacgggaaaccgtaaacggtaaccgggtcgtttaccgggtaagtttaaccgttacggttggttaccggttcgttacccgttccgtacgggtacccgtcccgggttacccggggttaccccgggttacccggtttaccggggttccctttccggggttaccccgggggg

SEQ ID NO: 283780 - DNA, 711 bp, Homo sapiens
  misc_feature: GYAE6OF02JVGMP.47.85.H08.1.454.CMB.1.raw
  modified_base (440)..(440): a, c, t, g, unknown or other
  misc_feature (440)..(440): n is a, c, g, or t
tcagagctcacgtacacgaccggtgctcgatttagtatcactcagtcgcggggggggtcgtcaggaggcagcgctctcaggacatctccaccatggcctgggctctgctgctcctcaccctcctcactcagggcacgagggtcctcgggcccagtctcgcccgactcagcctgcctcgtgtcgtggtcctccgtagacagtcgatcaccatcctccgtgccacgtaggaacctaggtagtacggacgttcggctagttactgtacttctatcctccgtaggtaccaaacaacaccagacaaacgaccccaactcaataacttatagacgtacaagtcttaccgcccctacgtcgggttctactactcgtacttctcgtcgtcgtacctaacgtcgtcggacctaacgccggtacccttcccgtacgtaacctgtttcccncgtcgggtctcggtaagttcgaggtacggtacggacgtaccgttacgttaacgtttcttacgttcggtttagccgttacggttcggtaacctaacgttccgtttacggttttccggttcggggtttagtttcccggggacggtaaaccgggttaccgttaaggttccggtacccgttacggtcggttaaccaccgggtaccctacgggtacccttcccgggttacccccttccgggtaccttacccgtttaccgtccccgttaaccccccg

SEQ ID NO: 283781 - DNA, 620 bp, Homo sapiens
  misc_feature: GYAE6OF02GIOCY.47.85.H08.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (602)..(603): a, c, t, g, unknown or other
  misc_feature (602)..(603): n is a, c, g, or t
  modified_base (605)..(605): a, c, t, g, unknown or other
  misc_feature (605)..(605): n is a, c, g, or t
  modified_base (607)..(610): a, c, t, g, unknown or other
  misc_feature (607)..(610): n is a, c, g, or t
  modified_base (613)..(616): a, c, t, g, unknown or other
  misc_feature (613)..(616): n is a, c, g, or t
  modified_base (618)..(620): a, c, t, g, unknown or other
  misc_feature (618)..(620): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaacgcccccaaactcataatttatgaccgtnaatgttccgcccctgagggtttcncgatcgcttctctggtctaccaaatcctggacctaacgaccggccctccctgaccatctcgtgggctcgagtctaggaggacgaggctacgtattacttccgtagttcgaccttcgttgggtactaactacgttcggtttacgggtttggtacggttcgggacgggtaacggtacctaaggtttcgacccgttcgtacggtcgacggcccaaggtccgtccgccccgttcggtcctaccttccgttccgttcccctaccccgttcccttaccgttaccgtacggacgtccttacgtacggtaacgggtcccgggtaccgttacgggacccgtaacgggccgtacgtaagtacgtnngncnnnngcnnnncnnn

SEQ ID NO: 283782 - DNA, 788 bp, Homo sapiens
  misc_feature: GYAE6OF02ITQ7M.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagttgggctgagctgggttttcctcgttgcttcttttaagaggtgtccagtgtcaggtgcgccgtggtggaggtcgggggagcgtggtccagcctgggacctccgtgagactcgtccgtgtcgcacgtcctcgtcggtccttacctaccttacaaattaatttacgtcgtacttagtacggaccgtagggttccgggtaccccgccggtaacggtcccgttacccggaggggtacccgggaaacgggggtccgttaaagggacggggtttggggggtacggtccggtacgtaattaacggtcccggtacccgtaagggtcggtaaccttagttccgtttacgtaacggtttaacgttaccggtaaccgaaccgggtttaccctacccggtaggggtaccgggggtacccgttaaccttacccgaacccgtacgtttacccgccggtaaaggtaccgtaaaccgtaaccttacccggaaacgtaaccgtaaccgggttactacgtaccgtacgacccgtaaccgtccgacctacggtcccgtaagaacgtaccgaggtaaccgtaacccgtcgttaccgttaccgttacgttaccgttacgtcgtaccggacgttacggtaacggtcggttaacggcggttataccggttagg

SEQ ID NO: 283783 - DNA, 676 bp, Homo sapiens
  misc_feature: GYAE6OF02GA4U5.47.85.H08.1.454.CMB.1.raw
  modified_base (261)..(261): a, c, t, g, unknown or other
  misc_feature (261)..(261): n is a, c, g, or t
  modified_base (322)..(322): a, c, t, g, unknown or other
  misc_feature (322)..(322): n is a, c, g, or t
  modified_base (376)..(376): a, c, t, g, unknown or other
  misc_feature (376)..(376): n is a, c, g, or t
  modified_base (423)..(423): a, c, t, g, unknown or other
  misc_feature (423)..(423): n is a, c, g, or t
tcagagctcacgtacacgaccggtgctcgatttagtatcactcagtcgcggggagagaggagccagcactggagtcgccggtgtttccattcggtgatcagcactgaacacagaggactcaccatggtagtttggctgagcttgggttttctcgttgcttacttttaagaggtgtcctaggtgtcgtagggtcgcgccgttgggtaggaggtcggggggggagcggttggtaccgaggcccgttgggaccgtcccgtgganacctcttccgtgtgacgacgtccttacgtggtcttaccacgtttactaaattaatttacgngtactagtggactagggtcgtacctccgagctccgaggacgagggctagtaggngggttcggctcgaatcgcgtcaaggtcgcattcgtacagtataccgnaagtcctccgtgggacgggtcctacgtacgacctcgtacctacgacggaacgactaacgtaccgtaacgtaaccgtacggtacttaacgtcctacgccctaaccgtacgtaaccgaccgtccgtacgtaacgtaacgtacgtaaaccacgtaccgttactaccgttaccttatacccggtggttccgaacgggttaacgaccggtttaaggtaaccggttacggttactacgttagtttaggtacgttaccgg

SEQ ID NO: 283784 - DNA, 678 bp, Homo sapiens
  misc_feature: GYAE6OF02IVDIZ.47.85.H08.1.454.CMB.1.raw
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgactcagcctcgcctccggtgtcgtgggtctccgtggacagtcgatccaccatcctcctgcactcggaaccagtgtggacgttggctagttctgtattctactctccgtacgtaaccaacaaccaccgaggaccaaaccgaccccctaaatcaattaaatttagacgtaacgtactaacgttcggttaccgccccgtacgttacggggttctactacgtcgtcttctcgtcgtacctactaagtcgtagactaacgccgtccctcccgtacacctactccgttcgtacggtactacggtcgtcgtaggacgggtaaccgacggtcgttacgttaacttacgtttcgttagttcgtaccgtttcggtacggtacttacgttcggtttcggtttcgggtttgggttacgttcggggacggtaacggtacgtaacggttccgtacccggttacggtaacggtcgaccgtccgtaacggtcctacccgtcccgttcgactacccgttccgtcccgtccccg

SEQ ID NO: 283785 - DNA, 643 bp, Homo sapiens
  misc_feature: GYAE6OF02GOLJN.47.85.H08.1.454.CMB.1.raw
  modified_base (225)..(225): a, c, t, g, unknown or other
  misc_feature (225)..(225): n is a, c, g, or t
  modified_base (319)..(319): a, c, t, g, unknown or other
  misc_feature (319)..(319): n is a, c, g, or t
  modified_base (368)..(368): a, c, t, g, unknown or other
  misc_feature (368)..(368): n is a, c, g, or t
tcagagctcacgtacacgaccggtgctcgatttagtatcactcagtcgcgggggggggtctcaggaggcagcactctcaggacatctccaccatggcctgggctctgctgctcctccaccctcctcactcgagggcacgagggtcctgggccctagtctcgcccgtactcacgcctcgcctccgtgtcgtgggtctccgtggaccagtcgatcaccatcctcctnctacgtacggaacagtagtgtacggttggctagttctgtacttctagtctcgtacgtaccaacaacaccgagacaacgacccaatcaattattngtaacgtacagtcgtccgcccttagtacgggttctctacgtcgtcttcncgtgacctactaacgtcgtcggactaaccgcctacctccgtacaacctcgtcgtcggtcggtctagtcgctaggacggacgacgtctagttaacttaccgtcgttgtaccgtcttacgggtcgaactacgttacgttcggttacgggtttcgggttcgggtacggtacggacgggtactaacgggttgtacccgtcggtacggttaaccgccggtaacccgtaggtccccgtacgcccccggttacgttaccgtaccgttccgtcccgtcccccg

SEQ ID NO: 283786 - DNA, 724 bp, Homo sapiens
  misc_feature: GYAE6OF02F5OMW.47.85.H08.1.454.CMB.1.raw
  modified_base (312)..(312): a, c, t, g, unknown or other
  misc_feature (312)..(312): n is a, c, g, or t
  modified_base (345)..(345): a, c, t, g, unknown or other
  misc_feature (345)..(345): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcagggcacagggtcctgggccccagtctgccccgactcagcctgccctccgtgtctgggtctccgtggacagtcgatccaccatcctcctgccactggaaccaggtagtgtacggttggctagttctgattctatcctctcggtaccaacaacaccagcaaacgccccaaactcaataatttanagtactcaatcgtccgcccctgtacgggtttcncacgtccgcttctctcgtcctacctaaactcgtacgaccaaccgaccggtccctaccccttacgacccttacgtccttacggtacgggtaccctacggtacggtttcgagggtaacgggtaccggacgggtccttaggtaacgttttaccttcggttcgttacgtcccgtttcggttacggggtacctaaaccgtttaccggttcggttttacgggtttaggggttcgggttaccggggacggtaacgggtaaccgttaacgggtttcggtacccggttaccggtaacggttaaccggacccggtacccgaacgggtcccgttcccggttaccccggtccggttacccgaccgtttcccggtacccgtttaccccccgg

SEQ ID NO: 283787 - DNA, 667 bp, Homo sapiens
  misc_feature: GYAE6OF02I5K61.47.85.H08.1.454.CMB.1.raw
  modified_base (584)..(584): a, c, t, g, unknown or other
  misc_feature (584)..(584): n is a, c, g, or t
  modified_base (644)..(644): a, c, t, g, unknown or other
  misc_feature (644)..(644): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
  modified_base (655)..(655): a, c, t, g, unknown or other
  misc_feature (655)..(655): n is a, c, g, or t
  modified_base (658)..(659): a, c, t, g, unknown or other
  misc_feature (658)..(659): n is a, c, g, or t
  modified_base (664)..(664): a, c, t, g, unknown or other
  misc_feature (664)..(664): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgtttggcagttctgtattctatctccgtggtaaccaacaaccacccaggacaaaccgacccctaaactcaattaattatcgaacgtacaattcgttccgtccctacggtacgggtttactcgtatccgtcttcgtctcggtactacctaaactcgttacggaccaaccgaccgtccctaccgtacgacctactcgttcgtcgggtacctacggtactcggtacggacggacgtacggtcttaggttactttacgttcgttgttcgtcgttcgtcggtacctaacgttacgtcgggtttcggttttacggtcggtttacgggacgggtacgggtaccttaaggttcggtaccgtcgtaacggcgtaccggtaccgacggttccgtacccggtcccgttcggtacctaccgttccgtaccgttaccccttcccgttaccncgttccggtagtcgcctcgtacgcggtcggacgtgacgacgtcgcacgtagcagctagcncgtcngcngcncgnngctcntcg

SEQ ID NO: 283788 - DNA, 612 bp, Homo sapiens
  misc_feature: GYAE6OF02HBPDE.47.85.H08.1.454.CMB.1.raw
  modified_base (383)..(383): a, c, t, g, unknown or other
  misc_feature (383)..(383): n is a, c, g, or t
  modified_base (402)..(402): a, c, t, g, unknown or other
  misc_feature (402)..(402): n is a, c, g, or t
tcagagctcacgtacacgaccggtgctcgatttagtatcactcagtcgcgggggggggtctcaggaggcagcgctctcaggacatctccaccatggcctgggctctgctgatcctcaccctcctcactcaggcacagggtcctgggcccagtctcgccccgactcagcctgcctccgtgtctgggtctccgtggactattcgatccaccatcctcctgcacgtggaaccagtagtgacggttggactagttctgtattctatctcctggtaccaacaaccacccaggacaaacgccccaaactcaattaatttatcgacgtcaattcgttccgccccttcgtacgggtttctctatccgtcttctctcgctacctaattccgngacaacgccgcctccctanacctactctcgtcggctcgagtcgtagaggacgagtcgtagtacttcttcgtgtctactcgtgacctaacgttcgtggttcggtttgggttgttcgggacgggtacggtaccgtaggttccgaccgttaccggtcggtacctacggtacccgaaggtcccgtacccggtccccgttaccggtcctacccgttccttcccggttacccccg

SEQ ID NO: 283789 - DNA, 878 bp, Homo sapiens
  misc_feature: GYAE6OF02IBRBO.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttgggctgagtcttgggtttcctcgttgcttcttttaagaggtgtcctagtgtcaggtgcgtccgtgggtggagggtcggggggaggtcggtggtccgagcccgttgggaccgtccgtaggacgtactctcctggtgcctacgtcccgtcgtacggtccttacctacctttacaaatttaaacgttattcgtacttaagtggtaccgtagggttccggggtaccccgccggtaacggcccttccggaacgggtacggaacgggggtactagggtagggtgggggtcggtacggttactagttacggtccgtaccgtaggtacggaactacggttaccttcgtaaagtttcgtaccggacctaacgggtaccccgttcccggtaggggtaccggggtacccgttaacgtttaaccccgaaccgttaccgttacccgtaaccggtaacggtaaccgtaaacccgtaaacccgtttaaccccggaaacggttaaaccggttaacccgttacgttaacccgtccgttacgtaccccgtaacccgtacccggtaacccgtaacccgtacccgttaaagtaaacccggtaaccgttaaccgggtaacccgtaacccggttaccccggtttaacccttaacccggttaacccttaaacccggtttcgtaacccgggttaggtaaccggttaacggtacggttaaccgggttaacccgggtaacggtttaacggtacgtttaacggg

SEQ ID NO: 283790 - DNA, 739 bp, Homo sapiens
  misc_feature: GYAE6OF02IHWCN.47.85.H08.1.454.CMB.1.raw
  modified_base (139)..(139): a, c, t, g, unknown or other
  misc_feature (139)..(139): n is a, c, g, or t
  modified_base (181)..(181): a, c, t, g, unknown or other
  misc_feature (181)..(181): n is a, c, g, or t
  modified_base (536)..(536): a, c, t, g, unknown or other
  misc_feature (536)..(536): n is a, c, g, or t
tcagagctcacgtacacgaccggtgctcgatttagtatcactcagtcgcgggagagaggagcccagcactggaagtcgccggtgtttccattcggtgatcagcactgaacacagaggactcaccagtggagttggctgngctcgggttttcctgttgtctacgttttaaggaggtcgtccngtgtcgaggtgcgcgtggtggaggtcgggggagtcggtcggtccgagccgtgggtaccgtcccgtgacgtaccttcctccgttggtcgcgacgtccgttcgtacggtccttaccaacctttacgtaaaattaaacgttcgtacggtacttaacgtcgacgtaccggttccgggtacccttccgacggtccgttaccggacgggtaccggaagggtcctaaagggtcgggtgggtcgggtcggtaactagtaccgtcgtcgtaacggtgaaacttctactttacgaagttaccgtacgtcgaaacgtcccgtccggtagggcgggtactacttcccgaactcgtccacgagtaacncgtaacccgttcgaacgtaaaccggtcgtattaccgtgtaccgtcaccggttcgaaccgtcggaaccttagggaaacccttaacgtctaaaccggtcgttccccgttaacttaaccgtacgttaccgttaacgtcgggtacgacggtaaacgtacgggttaaccttcggaacgttcgttacgttaggtcggtaaccgttccgg

SEQ ID NO: 283791 - DNA, 695 bp, Homo sapiens
  misc_feature: GYAE6OF02IOKR0.47.85.H08.1.454.CMB.1.raw
tcagagctcacgtacacgaccggtgctcgatttagtatcactcagtcgcgggggctggggtctcaggaggcagcgctctcaggacatctccaccatggcctgggctctgctgctcctccaccctcctcactcgagggcacgagggtccgtcgggcccagtctcgcccccgactcgacgcctcgcctccgtgtcgtgggtactccgtggactagtcgactccaacctatcctcctgactacgtacggaacctaggtagtgtacggttggacgtggttactagtacttactactcctaccgtacggtaaccaaaccaaccacccgtaacggaaccaaacccgaccccctaaaactctaaattaacttagtacgaccgtacattccgtccgtacccgttagtacgggttctactacgtcgtccttctcgtcgacttaacctaagtccgtaagacctaaacgccgtccctaccgtacgtacctcgtctcggtcggtctacgacgtgacggacggtacgtacgtcgtagtacttacgtgttcgtcgtcgttcggtacgtactacgttacgttcgtttacgttcggttcggtcggtacgggtacggttaccgtaacggttccggtaaccgttaccggtacgtaccgacggttacccgtacggtacccgtcccggtaccccgtacttacccgtacttacccg

SEQ ID NO: 283792 - DNA, 903 bp, Homo sapiens
  misc_feature: GYAE6OF02IP8Z2.47.85.H08.1.454.CMB.1.raw
  modified_base (358)..(358): a, c, t, g, unknown or other
  misc_feature (358)..(358): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcagggcacgagggtcctgggcccagtctcgccccgatcagcctgcctcgtgtcgtgggtctcgtggacagtcgatccacctatcctcctgacctacgtacggaacctaggtaggtagtaccggttggcttaggttctggtacttctactccttccgtacggtaaccaaacaacctacccgaacggaccaaaaccggtaccccctaaactacgtaaactttaacgttttanacggtaacctacgtaacgtttccggttaccccgtccccgttacgggttaacggggttttcctacgttacttccgtcgtttccgtccggttacgggtaccccttaaccgtaaagttccgtacgggtaacctaaacccggtaccccggtccccgttaccccgtacgtaacccgtaccgtttcccgttcgggttaccggggtacccgttacgggttaaccgttcgggttacggggtaaaccgggtacgggtaccgggttacttaacggtttacgtttttaaccgtttcggttacggtttccgtcggttaccgggtttacgggtaaccttaaaccggtttcggtttacggggttttcgggtttcggggtttaccgggttccggggtaacgggtaccgggttaaccggttaacgggtttccggaacccggttttaccgggtcggtaacccggtacccggttaacccgggtaaccggttcccggtaccccggttccccggttaccggttaccccgttacccgtttcccgggttaccccgtttcccccccgg

SEQ ID NO: 283793 - DNA, 735 bp, Homo sapiens
  misc_feature: GYAE6OF02G47KJ.47.85.H08.1.454.CMB.1.raw
  modified_base (170)..(170): a, c, t, g, unknown or other
  misc_feature (170)..(170): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaagnggtgtccagtgtcaggtgcgcctggtggaggtcggggggagcgtggtccagccgtgggacgtccctgagactctcctgtgcagcctctggccttcaccttcaattaattatgctatgctaggtcggtccctccgaggcctccgaggcgaaggggctaggaggtggggtggcggtctagttacgtccgtaccgtaggtcgaactacttccgtttacgaagttacgttacgactaacgtacccgttcccgtagggacgggggtccctacgttacccacccgtacgttcccgtaccacggaacgtaacctaaacgtttacccgaacgtaaccgtaccggttacttacgtccgtacgtaccctaacccgttccgaaacccgtacgtacccgtacgggtaaaccgtaaaccggtacgtaacccggtaaccgttacccggttacccgttacccgtttaccgttaacccgtttaccggttcggttaaccggtaccgggtaacggttaacggttaacggtttaaccgggaacggttacggttaccgtttaaggtttacggtagttaacccggg

SEQ ID NO: 283794 - DNA, 721 bp, Homo sapiens
  misc_feature: GYAE6OF02JBE5U.47.85.H08.1.454.CMB.1.raw
  modified_base (125)..(125): a, c, t, g, unknown or other
  misc_feature (125)..(125): n is a, c, g, or t
  modified_base (203)..(203): a, c, t, g, unknown or other
  misc_feature (203)..(203): n is a, c, g, or t
  modified_base (327)..(327): a, c, t, g, unknown or other
  misc_feature (327)..(327): n is a, c, g, or t
  modified_base (346)..(346): a, c, t, g, unknown or other
  misc_feature (346)..(346): n is a, c, g, or t
tcagagctcacgtacacgaccggtgctcgatttagtatcactcagtcgcggggggggtctcaggaggcagcgctctcaggacatctccaccatggcctggctctgtctgctcctcaccctcctanactcgagggccacgagggtcctgggcccagtcctcgaccccgatcagcctgcctccgtgtctgggtcctccgtggacnggtcgatccacctatcctcctgccacgtacggaaccagtacgtcgacgttggctagttctggtattctactctcctcggtaccaacaccaccagaccaaaccgaccccaatacgaattaattancgtacgtcactcgttaccncccgtacgtacgggtttctactacgtcctcttctcgtcggtacctactaacgtcgtacggacctaacgtacccggtccctcccgtacgacctacgtcgtccgtacgggtcctacggtacgttcgtagggtacggacggacggccttacgtactttacgttcgtagttccgtacgttcggttacggacttaaccgttacgttcgggttaccggtttcggggttcggttaccggggtacgggtaaaccgggtaccggttaacggttccgggtaacccgttccggttaacggtcccgtaaccggtaaccccgtaaggtcccgtcccggtaccccgttccggttacccgtcccgttaccgttcccggtttaccccccgg

SEQ ID NO: 283795 - DNA, 779 bp, Homo sapiens
  misc_feature: GYAE6OF02I3FG2.47.85.H08.1.454.CMB.1.raw
  modified_base (115)..(115): a, c, t, g, unknown or other
  misc_feature (115)..(115): n is a, c, g, or t
tcagagctcacgtacacgaccggtgctcgatttagtatcactcagtcggcgggggggggtctcaggaggcagcgctctcaggacatctccaccatggcctgggctctgctgctcncacctctcactcagggcacgagggtcctcggggccctaggtcctcgccccgtactcacgtcctcgcctccggtagtcgttcgggtcctaccgtggacagtcgtaatccgaccattcctcctgacctacgtcggaacctagtacggtgtacggttggctaggttctagtacttacgtacttccgtccgtacggtaaccaactaaccgaccgaagaccaaaaccgacccctaaacttacctaagttaactttaactacggtaacccgttactaacgtttcccgttacccgtaccccggttaggtacggggttttcctactacgttaccggttacttcgtacctcggtacctacgtaaagtcctacggacctaacgtccgtaccctcccggtaacaccgtactaccgtcgtcgggtctacggtacgtcgtagggaacggtacggacgtcggtaacttaagttaccttacgttagttcgtacttccggttagggtacctaacgttcggtcggtttaacgggtttccggtaaggtttccgggacggtaccggttaacggtaaggtccgtaccgggttacgttaacggacggtaccgtaacccggtaacgtacccggttacccgtaccccgtcgggtaacccttacccggtaccgttcccttacccccgg

SEQ ID NO: 283796 - DNA, 799 bp, Homo sapiens
  misc_feature: GYAE6OF02FXR6E.47.85.H08.1.454.CMB.1.raw
tcagagctcacgtacacgaccggtgctcgatttagtatcactcagtcgcggggagctctgggagaggagcccagcactggaagtcgccggtgtttccattcggtgatcagcactgaacacagaggactcaccatggagtttggctgagcgttgggttttcctcgttgcttcttttaagaggtgtccagtgtcaggtcgcgcctggtggaggtcggggggaggcgtggtccagcctgggaccgtccctgagactctcctgtcgcacgcctcgtcggcttactacctttacaaattaagttatgtactagtacgctacgggtcgggtaccgccgaggtcctacggacggacggaagggactaagggtacgggttggggtcggggtacggtacgacgttacgtacccggttacctaacggtacgggaacttaaccgtttactttaccgaaaggtttaactttaacccggactaacggtaacccccgtccccggttaagggtacccgggggtaccctaaccgtttacccaaaccccgttacctccgtaacccgaaaggtaacccgtaaaccctaaaccgttaacccccgtaaacggaaacccgttaacccgggttaacttaccgttaccgttacgtaacccctaccgttaacccggaacccgtaacggtacccgtaaggaacctaaacggtacgaacccgtaaccggtaccgttacctacccgtttaacttaccgtaaccgttacgggtaccgagggaacgttaccggtacgttaacgggaaccgttacgttacgttaaccgg

SEQ ID NO: 283797 - DNA, 812 bp, Homo sapiens
  misc_feature: GYAE6OF02GMVJF.47.85.H08.1.454.CMB.1.raw
  modified_base (356)..(356): a, c, t, g, unknown or other
  misc_feature (356)..(356): n is a, c, g, or t
tcagagctcacgtacacgaccggtgctcgatttagtatcactcagtcgcggggtctgggagaggagcccagcactggaagtcgcggtgtttccattcggtgatcagcactgaacacagaggactcaccatggagttgggctgagctgggttttcctcgtgcttcttttaagaggtgtccagtgtcaggtgcgccgtggtcggaggtcggggggagcgtggtccaggtccgtgggacttcccgtggacgacctaccgttccgtgtcgcgtacgtcccttgtcggtcctttaccacccgtttcaaacgttaaactttattccggactttagtcggacgtacggttcgggggtaccccnccggtaagggtcccgggttaccgggggggaagggccggttaggggaacgggtttcggggtacgggtccggtacctagttaccgtccgtaaccggtaggttcggaccgttaacgtttccgttaacgttaaggttaacgttacccggctaaacggttacccgttaccccggtagggggaccgggggttaaccctaacgtttaccgtaacccgtaacttaccctacccgggggggggtactaacggtaaccgtaaccttacccgaaccgtaaccggaaccgttaccgtaccgttctacgtacctaccgtacgaccgtaccgtacgttacggaacgtaacgtacggtaaccgtaaccgtaccgttacgttccttaccttacgtacgttcgtcggtaaccggtacgtaacggtacggttaacggtacggtacgtacgttacgtacggttacgtagtaccgg

SEQ ID NO: 283798 - DNA, 929 bp, Homo sapiens
  misc_feature: GYAE6OF02FW6BC.47.85.H08.1.454.CMB.1.raw
tcagagctcacgtacacgaccggtgctcgatttagtatcactcagtcgcggggtcgtgggagaggagcccagcactggaagtcgccggtgtttccattcggtgatcagcactgaacacagaggactcaccatggagttgggctgagctgggttttcctcgttgctcttttaagaggtgtccagtgtcgaggtgcgtcctgggtggagggtcgggggggacggtcggtcgggtccacggccggttggggaccgtaccccgttggaacgtaccttccgttccgtggtcgaccacggcccgttgtacggtccttactaaccctttacgtaaagttaacttattcggtacttaattcggtacgtacgggttcggggtacccggtccggaacgggtccttaacccggagggtaaccggaaacggggtcttacggtaggggttacggggtcgggtaccggtacaaggtacgttccggtacgtaacgggttggaaccgttaactttccttagaacggttacttaaccgacttaaccggtaacccgttccgtaacgggggtaaccgggggtacccgtaacgtttacccgaaacccgttacgttacccgtaacccgtaaacgggttaaccgtaaaccgttaaaccccggttacccgaaaaccggttaacccgggtaaaccccggttaccgtttaacgttaacccgttaccggtacccgtaacccggttaaccggaaccccgtaccggtaccgttaacggtaaaccgggtaaccggttaccgaaacccggaacccgttaaaccgtccccttaaccgttaaaccgtaaccccggttttacgggttaaacgggttcccggtaaccgggtaaaacggtttaacggtaacccgggtttaaggaaccccgggtttagttaacccggttagtttacggttaccgg

SEQ ID NO: 283799 - DNA, 619 bp, Homo sapiens
  misc_feature: GYAE6OF02GOBQ6.47.85.H08.1.454.CMB.1.raw
  modified_base (211)..(211): a, c, t, g, unknown or other
  misc_feature (211)..(211): n is a, c, g, or t
  modified_base (533)..(533): a, c, t, g, unknown or other
  misc_feature (533)..(533): n is a, c, g, or t
  modified_base (570)..(570): a, c, t, g, unknown or other
  misc_feature (570)..(570): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaggtctcgccccgactcacgcctgccctccgtgtctcgggtctcctggacagtcgatcaacntctctgcactagacctgtagtcgacgtttggctagttctgtattcgtatctctgtaccacaactaccaggtaccaacgccctaaactctaattacttaactcgacgtataacgttcgtcccacccttaggtcgggtttctacgacttcggtacttcgcgttagcctacgaatcgtacgtaccaaccgccgtccgtaccctacgaacctcgtccgtacgtcggaccgtgtacgtcgttagggaccggtacggtgtcttaggtaactttgttcgtgttctacgttcgtcggactaacgttcgttggttcggttggtacgtcggnggtacggactagtcggcccgttacgtacggtccgacnccgtacggtcctacccgtccgttccgtactctacccgttcttacccccg

SEQ ID NO: 283800 - DNA, 877 bp, Homo sapiens
  misc_feature: GYAE6OF02HXNB6.47.85.H08.1.454.CMB.1.raw
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (624)..(624): a, c, t, g, unknown or other
  misc_feature (624)..(624): n is a, c, g, or t
tcagagctcacgtacacgaccggtgctcgatttagtatcactcagtcgcgggggggtcgtcaggaggcagcgctctcaggacatctccaccatggcctgggctctgctgctcctcaccctcctcactcagggcacgacgggtcctgggccctagtctcgccccgactcagtccngtcctccgtgtcgtcggtctccgtggactaggtacnctaccacctagtcctaccgtcgacctacgtacgggaaaccctaaggttaggttcggtaaccggtttgggaaccttgtttactcggtattttacctaacttccttacccggttacggtaaaccctaaaccgaacccaaccccgtacggaacccgtaaacccgaaaccccctaaacgtactaaagttaaattttacgaggtaccgttaactaacgtttccggttcccgtacccccggttacggttaaacggggttttcctactaacgttcccggttcttacccgttcgtccggtacccttaacccgaaagtttcccgtagggaacctaaccgtaccccggtacccgtttccccaacgtacccgtacttccgttaccggtcgggtaacctcggtactcggtacggacggtaaccggnggtaccttacggttaacttttacgtttaccgtggtttacgtccgtttacgggttcggtaaaccgttactttacgggtttcggtttacgggtttaccggggttcggtttaacccggggacgggtttaaaccgggtacgttaacgggttcggttaacccgttcgggtaacggtacccgtaacggacccgttacggtccgttaccccggtcccgtttaccggaccgtttcccgttacccgttcccggttacccccg

SEQ ID NO: 283801 - DNA, 826 bp, Homo sapiens
  misc_feature: GYAE6OF02GCLNA.47.85.H08.1.454.CMB.1.raw
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
tcagagctcacgtacacgaccggtgctcgatttagtatcactcagtcgcggggagctctgggagaggagcccagcactggaagtcgccggtgtttccattcggtgatcagcactgaacacagaggactcaccagtggagtttgggctgagtcgttgggttttcctcgttgtcgttactttttaaaggaggttcgtaccgtagttcgtacgaggtgccggccgtgggtgggaggggtcgggggggaggtcggttcgggtcccacggtcccgtcggggtacccgtcccgtggacgtccttcctcgtgtgcacgtcctcgtggtccttaccgtaccttanaaatttaactagtctacttagngtcggtagggtccggggtcccgaccggtacggtccgtaccggaacgggtaccggaaagggggtcttaacggggtagggttcggggggtccgggtaccgggttactaaagtttaccgttccgggtaacccgtaagggttacgggtaacccttacggttttccgtttacgttaacgtttaacggttaaccggacgttaaccggtacccgtttccccggtagggggtaacccgggtaccgtttaacccgttacccgaacccttaccgttccctaccgaaggtaaaccgaccttaaccgttacccgaaacgtaccgttaaccgttccgtaactcccgtacgtacctacccgtcggaccgtaccgtcgtaacgaacgtaacgacgaaaccgtcgtaccttacctaccgttaaccttaacgtaggtcgtacgacggtaaggtacggttacggtacgtacggacgttcgtaagg

SEQ ID NO: 283802 - DNA, 686 bp, Homo sapiens
  misc_feature: GYAE6OF02F4A8D.47.85.H08.1.454.CMB.1.raw
  modified_base (127)..(127): a, c, t, g, unknown or other
  misc_feature (127)..(127): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (253)..(253): a, c, t, g, unknown or other
  misc_feature (253)..(253): n is a, c, g, or t
tcagagctcacgtacacgaccggtgctcgatttagtatcactcagtcggcggggggggtctcaggaggcagcgctctcaggacatctccaccatcggcctgggctctgctgcctcctcaccctcctnactcagggcacgacgggtcctgggcccaggtctcgccccgatcacgcctgcctcgtgtctgggtctccgtgacngtcgatcacatctcngctacgtggaaccaggtagtgacgttggctagtttcngtatctatctctgtaccaacaacacagccaacgccccaatcataattatcgactcaatcgtaccgtccctagtaacgggtttctactatcgtactttctctcggcctaactaagtcgtaggacaacgtacccggtcccttacctacgacctaactcccgtaacgtcgggtaccttcggtacgtcgttaggacgggtacgaacggtccgtaggtttaactccgttttacgtgtttacgtcgtttacggttaccggtaacaaaccgtttcgttacggtttcgggtttcgggttgggttaccggtacggggtaacgggttaaccttacggggttactaacccgggttacggtcgttacccgacggaaccccgttaagggtcccgtaccggtccccgttacggtaccctacggttaccgttccccgttaccccccgg

SEQ ID NO: 283803 - DNA, 837 bp, Homo sapiens
  misc_feature: GYAE6OF02FQZ4C.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagtcttgggttttcctcgttgcttcttttaagaggtgtccagtgtcaggtgcgccgtggtgggaggtcggggggacggcggtggtccaggccgtgggaccgtcccctggacgactctcctgtacgcacgcctgtggtccttacgtaccttacaaagttaatttatacgcttaagtcggtactacgggttcggggtcccgccgtacgggtccttaccgaacgggtaccggtaagggggaccgttaagggtaggggttacggggggttccgggtacggttaccgtaagttaccgttaccggtacccgtaacggttcgggaacttagtttcctttaccggtaagttacgttaccgactaccgtacccgttccgtaacgggggaccggggtacccgttaacgtttcccgaacccgttacttacccggtaaccgtaacggtaaacccggtaaaccttaacccggtaaccccggtaaaacggttaaacccggtaccggtttaccgttaaccgttaccgtaacggtacccaccggttaccggtaaacccgacgttaaccggttaccggaaaccggttaaccgaccggtaaaccgtaaccgttccgttaccttaccggttacctaccggttacgtaccggttaggacccggaaggtaccggtacgttaccggaagttaccgttagtacggttacggtacgg

SEQ ID NO: 283804 - DNA, 883 bp, Homo sapiens
  misc_feature: GYAE6OF02JF87H.47.85.H08.1.454.CMB.1.raw
  modified_base (157)..(157): a, c, t, g, unknown or other
  misc_feature (157)..(157): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagttggctgagcttgggttttccncgttgcttcgttttaagaggttgtccagtgtcaggtgcgtcgtgggtggaggtcggggggagcggttggtaccaggtccgtggggaccttcccgtaggacgaccttcctccgtggtcgaccacgtcccgttcgtcggtacctttcctaacctttctaaaacttaattacgtcggtacttaacgtcggaccgttaagggttcggggttacccgacccggtacggggtacccttcccgggaacggaccggggtaaaccggggggtaccgttaaggggtacggggtttcggggggtacgggttaccggggttaccctaaaagttccggttaacccgttaccggaggttacgggtaaccaaggttttccttaaccgtaaggtttaaccgttaaccggactaaccgggaaccccgtttccccgtagggggtaacccggggtacccgtttaaacgtttacccgaacccgttaactttcccggaccccgttaaagggaccgtaaaccttaacccgtttaccgaaacggttaaaacccgtccggtttaaattaccgtacctacggtaaccctacggttaccgaacccgtacgtccgttaacgaacggttaaccgtaccgggtaacctaccgttaaccggtccctttacgtacccgttaaccgtttcggtggtacgggaccgttaagggaccgtttacggttacgtaccgttaggttccttaagttccgggtacg

SEQ ID NO: 283805 - DNA, 744 bp, Homo sapiens
  misc_feature: GYAE6OF02H7AWA.47.85.H08.1.454.CMB.1.raw
  modified_base (124)..(124): a, c, t, g, unknown or other
  misc_feature (124)..(124): n is a, c, g, or t
  modified_base (178)..(178): a, c, t, g, unknown or other
  misc_feature (178)..(178): n is a, c, g, or t
  modified_base (221)..(221): a, c, t, g, unknown or other
  misc_feature (221)..(221): n is a, c, g, or t
  modified_base (319)..(319): a, c, t, g, unknown or other
  misc_feature (319)..(319): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctnactcgaggcacagggtcctgggcccagtctcgccccgatcagcctgcctccgtntctgggtctcgtggaccaggtcgatccaccattctcctgaccnctggaacctaggtagtgacgttggcagttctgacttctatctcctggtaaccaacaaccaccacggacaaaaccgtaccccaaatctaattaattacncgacgttacaagttcgttccgccccgtagtacgggtttctcaacttcgtcctttacctcgtcgtctaaccaaatcgtaggacctaaccgtcccggtcccttaccctacgaacccctgttaccgtcggtacggtccgtaccggtagtcctaggaacgggtacggtcggtacttcgggttaacttttaccggttactttcggttcgtcgtaccggtttcgggaacctttaaaccggttccggttacggttttcgggtttaacggggtttcgggtttaaccgggggtcgggaaaccgggttaccgtttaacggtccgggtttaacccggttacgttaccgggtacccaccgggtacccgtacgggttccctacccggttcccccggttacggttacccgttaccgtttcccgtcccggttaacccccc

SEQ ID NO: 283806 - DNA, 745 bp, Homo sapiens
  misc_feature: GYAE6OF02HL02S.47.85.H08.1.454.CMB.1.raw
  modified_base (218)..(218): a, c, t, g, unknown or other
  misc_feature (218)..(218): n is a, c, g, or t
tcagagctcacgtacacgaccggtgctcgatttagtatcactcagtcgcgggggggggtctcaggaggcagcgctctcaggacatctccaccatggcctgggctctgctgctcctccaccctcctacactcgagggcacgacgggtccgtcgggcccaggtcctcgaccccgatcgacgcctcgcctccgtgtcgtgggtctccgtggactagtcganccgacctatcctccgtagaccaccgtaaggaaacctaggtaacggtcggtacggttggacctagtttcgtagtaacttctacgtcctcgtacggtaaccaaacctaaccgaccgacggaacctaaaacccgaccccctaatactaacttaaacgttagaccgtaacgtactaacgttccgtacccgtcccgttgggttacggttctacaccttcgtcctttcgtacgtccggtaactaacctaacgtcgaacgtacgaaaccgtcccgtacctaccgactccgtactcgtcgtcggtacgtacgtcgtcgaggtacggacgtacggtcttacggttactttacgttcgttcgcgttccttaacgggtccgtaacgtttaacgttcgtttcgggttcgggttacggttacgggggtccggacgggtaacggtaaccttgggttaccgaccgttcgtaacggcgacccgtaccgttacgaccccgttccggacccgttcgtaccttcgttacccgttccggtaaccccc

SEQ ID NO: 283807 - DNA, 812 bp, Homo sapiens
  misc_feature: GYAE6OF02FWKDT.47.85.H08.1.454.CMB.1.raw
  modified_base (211)..(211): a, c, t, g, unknown or other
  misc_feature (211)..(211): n is a, c, g, or t
tcagagctcacgtacacgaccggtgctcgatttagtatcactcagtcgcggggggggtctcaggaggcagcgctctcaggacatcgtccaccatggcctgggctctgctgctcctcaccctcctcactcgaggccacgagggtcctggcccagtctcgcccgactcacgcctcgcctccgtgtctcgggtctccgtgacagtcgatcaccntcgtcctgtcacgtcgaaccagtagtgacgttggactacgttctgtacttctacgtctccgtagtaaccaacgaccaccgaagacctaaaccgacccctaaactacgtaacttaattactacggacctaacgtaacgttccgttcccgtaccccgtacggttacggggttaccctccgtaactcccggttaccctttccgtcgtacggtcccttaacctaacgtccggtcggaactaaacccgcccggtcccttaaccgtaccgaaccgtcttcccgttaccgtacgggttaccgtaggtaccgtttcgaacgggacccgggttaagacccggggttatttaccggttaacttttacccgtttggttccggtttccggtacggttttacccggtgggttaacccttaaaccgttcggtttcgggttttacgggtttacggggttccggttaacggggtacggtaaccgggttaacgtaccgggttaccggtacccggttaaccggttcgggtaacccggtacgtaccccggttaaggccccgttacccgggcccccgttaagggtcccctaaccgggttccccttaccccgttaccccccg

SEQ ID NO: 283808 - DNA, 733 bp, Homo sapiens
  misc_feature: GYAE6OF02GBN5O.47.85.H08.1.454.CMB.1.raw
tcagagctcacgtacacgaccggtgctcgatttagtatcactcagtcgcggggagagaggagcccagcactggaagtcgccggtgtttccattcggtgatcagcactgaacacagaggactcaccagtggagtttgggctgagcttgggttttcctcgttgcttcttttaagaggtgtccagtgtcgaggtgccgccgtgggtggagggtcggggggaggcggtggtccgacgccgtgggaccgtcccgtagacgacctcctcctgtgaccacgccctcgtcggtccttcctaccttactaaattaattacgtcgtacttaagtcgcgtacggtcgggtcccgacccggtacggccctaccggaacggacggaacggggtacgtagggtacgggttggggtacgggtccggttaccgaagttaccgtccgttaccggaggtacggactaacgttcgttacgtaagttaacttacggaccgtaacgtaccgtcccggtacgggtaccgggaccgtacttaccacctctacccgtacgaagaacctaaccgtaactacccgaagtaaccgtacgttacctatccgcgtacctaccgaccgaccgtacaccgtacgaactaccgtaacgaaccaccgtacgtacctaccttactacgttaccgtaacggtcgaaacgggtacgtaacggttaccgggtagtaaccgggttacgtagttacggttacggaggttccg

SEQ ID NO: 283809 - DNA, 834 bp, Homo sapiens
  misc_feature: GYAE6OF02HIW4K.47.85.H08.1.454.CMB.1.raw
  modified_base (120)..(120): a, c, t, g, unknown or other
  misc_feature (120)..(120): n is a, c, g, or t
tcagagctcacgtacacgaccggtgctcgatttagtatcactcagtcgcgggggggtctcaggaggcagcgctctcaggacatctccacatggcctggctctgctgctcctcacctcctnactcaggcacgagggtcctgggcccagtctgcccgatcagcctgcctcgtgtctgggtactcgtaggactagtcgatccaccgtatcgtacctggaccaacgtggaaccgtagtggtacgtaccggtttggcctaaggtttctagtactttctaacttccttccgttaggtaaccaaacctaaccgaaccccgagggacctaaaacccgccccctaaaacgtccttaattaaacttttacgacggtaccgtacctaagttccgttcccgtaaccccgttcggtaacggggttttccacgttattccgtacctttgtccgttaggtaccttaacccgaaaacttcgttaccgggaacctaaccggtaaccccgggttccccgttacccctaaccggtacccttaaccgttaccctccgggttcgggtacccctaccgggttacgtacgtacgggtaaccgggtaaccgggtcgtaccggttaactttaaacgttttaccgttacgttaccggttcgttccggtttaccggttagggtaacccttaacgttcggttacggtttcgggttttaacggtcgggttaccggtccgggtaggtaacccgtcgggttaccgaccggttaccgttcgggtacccaacgggttaccccggtaaggtccccgtacccggttaccccgtaggtaccccttacgttcccggtacctttaccccccg

SEQ ID NO: 283810 - DNA, 726 bp, Homo sapiens
  misc_feature: GYAE6OF02GSA4D.47.85.H08.1.454.CMB.1.raw
  modified_base (526)..(526): a, c, t, g, unknown or other
  misc_feature (526)..(526): n is a, c, g, or t
tcagagctcacgtacacgaccggtgctcgatttagtatcactcagtcgcggggtctgggagaggagcccagcactggaagtcggccggtgtttccattcggtgatcagcactgaacacagaggactcaccatgggagtttgggctgagcgttgggtttttcctcgttgccttacgtttttaaggaggtgtccagtgtcgaggtgcgccgtggtggaggtcgggggagcggtggtccacggccgtgggaccgtcccgtagacgtaccgtcttccgtggtcgaccgacgtcccgttcgtacgggtcctttaccgtaaccctttacgtaaactttaattagtcgtaccttatacggtacgtaacgggttacggggtcccgaccgtcggtccgtaccggagggaccggaaagggttcgtaaggtcgggtggggtcggtcggtacacgttacgtaccgtacgacggtgactcgtttactacgtagttacgtacgcgtaacgtccgtaccggtgggaccgggtcctataccncgtactccgacagtacgactacgtccaagacctagtactgtctcgacctccgacaaccgacgtaccgaagtaaccgtaaccgacggtacccgaacgttaccctaccgtttaccgtaaccttaacggttccgtacggtcggtaaccggaaggttaacggttacgggtataccgggtatttccgttaaggtttcgtaaccgg

SEQ ID NO: 283811 - DNA, 925 bp, Homo sapiens
  misc_feature: GYAE6OF02GJYQW.47.85.H08.1.454.CMB.1.raw
tcagagctcacgtacacgaccggtgctcgatttagtatcactcagtcggcggggggggtctcaggaggcagcgctctcaggacatctccaccatggcctgggctctgctgctcctcaccctcctcacctcgagggcacgagggtcctgggcccagtctcgccccgactcagcctgcctccgtgtcgtgggtctccgtggacagtcatcacctatcctcctgccagtcggaaacctagtagtcgacggttgctagttctgtattctactctcgtcggtaaccaacctaaaccacccgaacggaccgaaaaccgacccccctaaaacctacctaattaaactttaacgttacggtaaccgtactaacgttcggttccgaccccgttacggttacgggtttcctacgtacctcgttccttacgttcgtacggtacctaaccgtaaacgtccgttacggaccgtaaccgtaccccgtacccgttaccccgttaccgaacccttaccgttacccgtaccggttaccgggtccgttaccgggttacggttaccgtacggggtaaaccgggtaccgggtaacgggtacccgttacgggtttaaacttttacccgttttaccgggtttacggttttacccggttccggttttaccgggtttacggggttaaacccgttaaccggtttaaccggttttccggggttttaccggggtttttcgggggtttacccggggtttaccggggtaccgggggttaacgggttaaccgggttaaacccgggtttaccgggtacccgggtttacccgggttaacgggtttacccggaacccggggttacccccggtaacgggttccccggttaaccccggttccccccggtttaccgggttacccctaccggtttacccgttcccccggtttaacccccccg

SEQ ID NO: 283812 - DNA, 760 bp, Homo sapiens
  misc_feature: GYAE6OF02JXM26.47.85.H08.1.454.CMB.1.raw
  modified_base (547)..(547): a, c, t, g, unknown or other
  misc_feature (547)..(547): n is a, c, g, or t
tcagagctcacgtacacgaccggtgctcgatttagtatcactcagtcggcggggggggtctcaggaggcagcgctctcaggacatctccaccatggcctgggctctgctgctcctcacctcctcactcgagggcaacgtcgggtccgtcggcccagtctcgaccccgtctcgactccgtcgcctccgtgtcgtcgggtcctccgtacggacctacgtcgtaactccaacctcttcgtcctcgaccgtactacggtaaaccgaggttcgtacggtcggttaggccttacgtttactgtacttctactccgtcgtacgtaaccaacaccaccgacgaaccgaaaccctaccccaatacctaattaacgttaactacgtacgtactaacgttccgttacccggtacccgtccggttaacgggtttacctacgttaccttccgttcttccgttcgttcggtactaaaccgtattaccggacgtacctaaccgtaccgtccctacctacgtccccgtagtttccgtcggttacggcctacgggtacgttacncggttaacgggacgtaaccgtcgttactttaccgttagtttcgttcgttacggtctacggtttcggtacctaacgttcgtttacggtttggttacgggttccggcggttaccggacgtacgttacggttctacggttaccgtacgtacgttacggaacccgtggtacccgtcggtacccgttccgtactacccgtcccgtttaccggtccccg

SEQ ID NO: 283813 - DNA, 978 bp, Homo sapiens
  misc_feature: GYAE6OF02ILI1U.47.85.H08.1.454.CMB.1.raw
tcagagctcacgtacacgaccggtgctcgatttagtatcactcagtcggcgggggggggtctcaggaggcagcgctctcaggacatctccaccatggcctgggctcgtgctgctcctcaccctcctcactcgagggcacgacggggtccgtggggcccaggtctccggccccgtaccgtcacggtcccttcgtcccttccggttcggttccgttcgggggttccttccgttacgggaaccgacggttacggtaacttaccgaacctaacttccttacccgttcggacctacgttaccgggaaaccgtaacggttaacgggttaccggttaacgggttcggggtaccgtttaggtttacgttacggttaacttttacttaaccggtttaccctttacccgggttaacggttaaaaccccctaaaaaacccgtaaaaccccgaaccccggtaaacgggtaacccgaaaaaccccggtaacccccctaaaaccttaaccggttaaaaacttttaaaaccgtttttacgtaaaccggttaaccggtttaaaccgttaacggtttaccgtttcccgtacccccggtttaagggtttaaccggggttttacctaccgttaaccgttccggttcctttaccgttacgttaccgggtaccttaacctaaacggttacggttaccggtaaccaacggtacccggtaccctttacccgtaaccgttaaccctacgtttaccgtcgggtacgttaccgtacggtaccgttacggtacgggacgggtacggtaacggtcgttaagttacgttttacgttactttcggttcgtacgtttcgtacggtacctaacgttcggttcggtttacggggtttcggtacgggttacgggtcgtaacgggttacgtacggttccgtacggttacgtcggtccaacggcgtacggaccgttcccgcccggttagtccgtacgtttcctaccgtaccccg

SEQ ID NO: 283814 - DNA, 666 bp, Homo sapiens
  misc_feature: GYAE6OF02JDJ8U.47.85.H08.1.454.CMB.1.raw
  modified_base (181)..(181): a, c, t, g, unknown or other
  misc_feature (181)..(181): n is a, c, g, or t
  modified_base (273)..(273): a, c, t, g, unknown or other
  misc_feature (273)..(273): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
tcagagctcacgtacacgaccggtgctcgatttagtatcactcagtcgcggggagagaggagcccagcactggaagtcgccggtgtttccattcggtgatcagcactgaacacagaggactcaccatggagtttgggctgagctgggttttcctcgttgctcttttaagaggtgtccagtntcgaggtgcgctggtggaggtcggggggagcggtggtccagcctgggacctcccgtgagactctccgtgtgcagcctcgtggcttcaccttnaatattangctatgntagttcggggtccnccgacggtcctaccgaggtaccgaaggggtctaagggtaggtaggggtcggccggtacattacgtaccggtccgtaggtccggactatttcgtaccgaagtttacgttaacgcaacggtaccctcccggttagggacggggtccctagtccctaccactccttccgaaggtacgaacctaaacttcccccgaaaggtaccgaccggttattacgtctaccggcctacgtccgaccgtacacccgtagtaacgggacctaacggccgaaactacccgttacgttcctacccgttaactcccggtaaggttccgaggtaaccgtagtaggttacgaacggtcttacggtaggttacgaggttaacg

SEQ ID NO: 283815 - DNA, 658 bp, Homo sapiens
  misc_feature: GYAE6OF02JIY4Y.47.85.H08.1.454.CMB.1.raw
  modified_base (213)..(213): a, c, t, g, unknown or other
  misc_feature (213)..(213): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgactcagcctgccctccgtgtcgtgggtctccgtggacagtcgatcaacctntctcctgcacgtggaaccctggtagtcggacgtttggactagttctagtattcgtatctccgttcggtaccaaccaaccacccgagtaccaaacgacccccaacgtacaagttaacttagtacgaccttacaactttcgttcccgccccttagtacggggttcctacgactccgtcttcgtactcgccttaccaatctcgacaccgacgtcccctccgtcgacctacttcgcgtccggtctacgtagtctaggaacggacgacggtctagtacgtttcttactggttactctcggttacggtactactacgtttcggttcggtttacgggttcgttcgggtacggtacgggtacctaggttccgtaccggtacgtcgggttccacggtcccgtagtcccgtcccgttaacccgtccgttcctaccgttccgttcccgtacccccg

SEQ ID NO: 283816 - DNA, 749 bp, Homo sapiens
  misc_feature: GYAE6OF02I72FZ.47.85.H08.1.454.CMB.1.raw
tcagagctcacgtacacgaccggtgctcgatttagtatcactcagtcgcggggtctgggagaggagcccagcactggaagtcgccggtgtttccattcggtgatcagcactgaacacagaggactcacatggagtttgggctgagcttgggttttcctcgttgcttcttttaagaggtgtccagtgtcaggtgcgcgtggtggaggtcggggggagcgtggtccagccgtgggacctccgtgacgacctcctcctgtcgcacgtcctctgccttcaccttacaattaattgtcgtactagtcgacgtaggtcgggtacccgcgacggtcctaccggagggacggaacggggtctaagggtgggtacgggggtcggtacggttacagttacgtccgtaccgagggtacggactagttaccttacgtaagttacgtacgacaacggtacctcccgggttagggaccggggtaccgttacttacccgtaacctaccgttcccgacgaaggtaacgtaaacccttaaccgtaccccgaaacggtaaccgtacccggttactaccgtaacctcgtaccctaccgtacgtacccgtacgtacccgaagggttaacgaccgttaacggaaccccgtaaccgttaccgggttcccttaccgtttacccgttaacgttacccggttacggacccggtaaggtaacggtaaggtaccggttaacgtaacgggttacttacggttaagtttggtaaccgg

SEQ ID NO: 283817 - DNA, 741 bp, Homo sapiens
  misc_feature: GYAE6OF02HI5NS.47.85.H08.1.454.CMB.1.raw
  modified_base (228)..(228): a, c, t, g, unknown or other
  misc_feature (228)..(228): n is a, c, g, or t
tcagagctcacgtacacgaccggtgctcgatttagtatcactcagtcggcgggggggggtctcaggaggcagcgctctcaggacatctccaccatggcctgggctctgctgctcctcaccctcctcactgagggcacgagggtcctgggcccagtctcgccccgactcagcctgccctcggtgtcgtcgggtcctccgtggactaggtcgactccacctactctaccncgacctacgtcggaaacctagtaggtggtacggttggctacgttctagttattcctatcctccgttaggtaacccaaacaacccgtaacccgaaggaccctaaaacccgaacccccgtaaactctaaattaagtttaacgcgtaactactaagttcccgttccgtccctaggttcgggtttcactctcgtaccttctcgtcgtacctaacctaactcgtacgaccaaccgtcccgcctccgtacgtacctgttcccgtaggtccggtccgtactaggtcccgtaggaacggtacggtacggtaccttagttactttacgttcgtttacgtcgttcggttaccggtcgaaccgttaacgttcggtcggttttcggggttcggttcgggtccgggacggtacgtaccgttacggtcccgttacccgttaggtaccggtaccgccggtacccgaaccgttcccgtaacccgggtcccgttccgtacccgtaccctttccgtacccccgttaccccg

SEQ ID NO: 283818 - DNA, 661 bp, Homo sapiens
  misc_feature: GYAE6OF02HYJW8.47.85.H08.1.454.CMB.1.raw
  modified_base (215)..(215): a, c, t, g, unknown or other
  misc_feature (215)..(215): n is a, c, g, or t
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (629)..(629): a, c, t, g, unknown or other
  misc_feature (629)..(629): n is a, c, g, or t
  modified_base (637)..(637): a, c, t, g, unknown or other
  misc_feature (637)..(637): n is a, c, g, or t
  modified_base (647)..(647): a, c, t, g, unknown or other
  misc_feature (647)..(647): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (655)..(655): a, c, t, g, unknown or other
  misc_feature (655)..(655): n is a, c, g, or t
  modified_base (659)..(661): a, c, t, g, unknown or other
  misc_feature (659)..(661): n is a, c, g, or t
tcagagctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgtattctatctcctggtaccaacaaccaccgaggacaacgccccaactcataattangacgtnaatcgtccnccctgtacgggttctactagtaccgtcttcctccgtcggtacctaaccgtaactcgtacggactaaacccgaccggtcccctaccccgtacgaccctaacgttcctccggtcggtactaccggtaccgtagtacgggaggtaccggacggtcgttacgttaacttaccgttcggtgttcgtctcggttcggactacgttacgttcggttggtttcgggtcgtacgggcggacggtacgtacggttcgaccggttacgtacggtccaacgcccgtaacggtcctcccggtcccgttaccggtccctcgtccgttcccgtccccgtcccttcttaccgtcgtcgactcgtacgtgggccgtccgggtgtaccgggactacggaccgtgtaacgagtcgtanccgcgtancgatcgtacnctcnanancgtnnn

SEQ ID NO: 283819 - DNA, 757 bp, Homo sapiens
  misc_feature: GYAE6OF02HG0J8.47.85.H08.1.454.CMB.1.raw
  modified_base (145)..(145): a, c, t, g, unknown or other
  misc_feature (145)..(145): n is a, c, g, or t
  modified_base (242)..(242): a, c, t, g, unknown or other
  misc_feature (242)..(242): n is a, c, g, or t
tcagagctcacgtacacgaccggtgctcgatttagtatcactcagtcggcgggggggtctcgaggaggcagcgctctcaggacatctccaccatcggctgggctctgctgctcctccacctcctcactcgaggcacgtgggtccncgggcctagtcctcgccccgtatcgcgccgtcgcctcggtgtccgtggtcctcgtggacaggtcgatccaactgtcctctcgcctagtacgaaccgngttacgtcggtacggttgactagttcgtagtacttctacgttctacgtacgaacctaaccaaccgtaacccgacgaaccaaacccgaaccctacgttaactacttaacgttacgtacgtaacgtactaacggttcgttcccaccggttcgttaccgggttcacgtccttacgtaccgtttcgccgtacgtactaccgtaagtcgtacgtaacacggttacccggcccttaccggacctaccgttacgttccgttacggtacggtaccgttccgtaccggtttaggaccgggttaacgggaccggtcggtactacggttactttacttcgttacgtcgtacgttacgacggttacctaacgtttcgtcgggttttaggttcgggtaccgggttacggtcgggacgtaccgtttaggtaccggttaaccggtcgttaccggaccgtaaccggtacctaccgggtcccttcccggtcccgtaccggttaccctcggttaccccgttcccgttaacccc

SEQ ID NO: 283820 - DNA, 605 bp, Homo sapiens
  misc_feature: GYAE6OF02HAANY.47.85.H08.1.454.CMB.1.raw
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (429)..(429): a, c, t, g, unknown or other
  misc_feature (429)..(429): n is a, c, g, or t
  modified_base (583)..(583): a, c, t, g, unknown or other
  misc_feature (583)..(583): n is a, c, g, or t
tcagagctcacgtacacgaccggtgctcgatttagtatcactcagtcggcgggggggggtctcaggaggcagcgctctcaggacatctccaccatggcctgggctctgctgcctcctcaccctcctcactcagggcacgacgggtccgtcgggccctagtctccgccccgactcacgcctcgcctccgtgtcgtggtctcgngacngtcatcacntctccagcacgtcgacagtgngtacgtgctntcngtatctatctctacgtacaacaccacgacgaccaacaccctaactctattaattcgacgtacactatccgtcgcccttaggtcggttcctactcgtccgtcttacctgtacgaccttacgaacgttcgtacgaccgtaaccgccgttaccgtcctacgtaccttctcgtcgtaccgggtntacgcgtcggaggacggtaggtcgtctatcgtttcttcgtacgtcctcgttacgtcgtactacgttgtacggtttggttcggtagtcggtcggagttactacggggtctacgtacgtcgacgacccgacgcggtaccgtcccgtcccgtaccgngtacccttccgtacccgtcccc

SEQ ID NO: 283821 - DNA, 756 bp, Homo sapiens
  misc_feature: GYAE6OF02FZKW8.47.85.H08.1.454.CMB.1.raw
  modified_base (510)..(510): a, c, t, g, unknown or other
  misc_feature (510)..(510): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcagggcacgagggtcctgggcccagtctcgccccgactcacgcctgcctccggtgtctgggtctccgtggacagtcgactcacctatcctctcgacacgtacggaaccagtacgtagacggttgactacgttctagtacttactatcctaccgtacggtaaccaacgaaacctaccgaaggacctaaaaccgaccccctaaaacgtccaaattaaactttaacgtacgtacctactaaagttccggttccgaccccgttcggtaacggggtttcctacaacgttccgtacctttcgtcgtacggtccttaacgtaaacttccgtaacggactaacccgtaccggttccctaccgtacgaaccacgtttacgtcgtacggtcncggtagtacgtaggtacggtaacggacggcttagtaacttacgttcgttcgtcgtaccgttacggtcggtaccaacgtttacggttcgttacgggttttggggttacgtcgggtaccggtacggggtaaccgtacggtttacggacccgttacggtaacggtcctaaccgggaacccggtacggtcccgttacccggtccccgttaccggttaccgtaccggtttcccgttcccggttccccccgg

SEQ ID NO: 283822 - DNA, 768 bp, Homo sapiens
  misc_feature: GYAE6OF02HAKI9.47.85.H08.1.454.CMB.1.raw
  modified_base (197)..(197): a, c, t, g, unknown or other
  misc_feature (197)..(197): n is a, c, g, or t
tcagagctcacgtacacgaccggtgctcgatttagtatcactcagtcgcgggggggggtctcaggaggcagcgctctcaggacatctccaccatggcctgggctctgctgctcctcaccctcctcactcagggcacagggtcctcgggcccagtctcgccccgactcagcctgcctccgtgtctgggtctctggacngtcatccaccatctctgcacgagaaccagtagtgtacggttggctaggttctagtactttactactccgtccgttacggtaaccaaaccaaccaacccgaacggaacccaaaacccgtaacccccaaaacctactaaacttaaactttacgtacgtacgtactaacgttcgttacccgtccccgttacggttaacgggtttcctactacgttccgtccttcgtcgttcggtacctacctaaacgttccgtcggaaccctaaccgtcccggtaccctcccgtacgtaaccctacttccgtacggtccgggtaccttcggtacggtacggtagggacgggtacgtacggtacgttagttactttacgttcgttggttacgtccgtttacggtacggaaccttacgtttaccggtttcggggttttccgggtttacggggtttcggttaccggggacgggtaacggtaacccggttagttaccgggaccgttacggtacggttaccgtacggacccgtacggtaccgtcccgttacccggtcgttacgtcccgttacgttccccgttacccccg

SEQ ID NO: 283823 - DNA, 731 bp, Homo sapiens
  misc_feature: GYAE6OF02HIA9M.47.85.H08.1.454.CMB.1.raw
  modified_base (173)..(173): a, c, t, g, unknown or other
  misc_feature (173)..(173): n is a, c, g, or t
tcagagctcacgtacacgaccggtgctcgatttagtatcactcagtcgcggggctgggagaggagcccagcactggaagtcgccggtgtttccattcggtgatcagcactgaacacagagactcaccatggagtttgggctgagcttgggttttcctcgttgctcttttaagnggtgtccagtgtcaggtgcgcgtggtggaggtcgggggaggcgtggtccagccgtgggaccgtccctggacgtactcctccgtgtgcacgcctcgtcggtccttcctaaccgtttacaaattaaattactgtacttagtcggaccgtaaggttccggggtaccccgccgtaacgggtcctacccggaggggtaccggaagggggaccttagggtagggttcgggggtcgggtccgggttacgaagttacgtaccggtacgaacggttcggaaccttacgtttacttacgtaacgttaacgttaccgacgtaacgtacccgtcccgtagggaccggggtacccttacgttacccgaaccgttaacgtcccgttaaccgaaacgtaccgaaaccttaacccttaacccgaacggtaaaccgtaccggttaactactaccgtcgaccgtaccgtcgaccacgtctacggaacgtacgtacgacaaccgtacgttacctactacgttacgtacgtacgtacgtaacggacgaggttagtacgacgtgtacgttagtgtaacg

SEQ ID NO: 283824 - DNA, 694 bp, Homo sapiens
  misc_feature: GYAE6OF02F622F.47.85.H08.1.454.CMB.1.raw
  modified_base (232)..(232): a, c, t, g, unknown or other
  misc_feature (232)..(232): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagagctcacgtacacgaccggtgctcgatttagtatcactcagtcggcggggggggtctcaggaggcagcgctctcaggacatctccaccatggcctggctctgctgctcctcaccctctcactcgaggcacagggtcctgggcccagtctcgcccgactcacgcctgcctccgtgtcgtgggtcctccgtggactagtcgactcaccgatcctctgcacgtcggaaccngtagtgacgttggctagttctgtattctagtcctccgtaggtaccaacactacccaggacaaacgaccccaactcaattatttacgtgtacgtacaactgttaccgccctgtacgggtttcacgtacttcncgtttcctacgtcgtctaccaattcgtacggacctaaccncggtacccttacccgtcgaaccctctaccgttcgtacgggtccgttacgtagtaccgtacggaacgggacggtacgggccttacggttaacttttacggttctttacggttcgtacgtttccgttagggtaacctaacgttacgttacggtttacgggttttcgggttcgggttacggtacggggaaccgttaccggtaacggtccgttacggtaccggttacggtacgaccgtaccgtaacgccgttcccgtccccgtacggtccctaccggtcgttacccgtacccccg

SEQ ID NO: 283825 - DNA, 851 bp, Homo sapiens
  misc_feature: GYAE6OF02H6P0L.47.85.H08.1.454.CMB.1.raw
  modified_base (132)..(132): a, c, t, g, unknown or other
  misc_feature (132)..(132): n is a, c, g, or t
  modified_base (228)..(228): a, c, t, g, unknown or other
  misc_feature (228)..(228): n is a, c, g, or t
  modified_base (278)..(278): a, c, t, g, unknown or other
  misc_feature (278)..(278): n is a, c, g, or t
  modified_base (520)..(520): a, c, t, g, unknown or other
  misc_feature (520)..(520): n is a, c, g, or t
tcagagctcacgtacacgaccggtgctcgatttagtatcactcagtcgcggggctgggtctcaggaggcagcgtctctcaggacatcgtccaaccatcggcctagggctctgcctgctcctccacctccacncctcacgtgtgcgtagggttctcgggaccctagtctgtcacgtgaactcaccgaccctaccctacgacgtcgtccgttacccggggacccccggtnaacggtaccgtaccaaccgtcttaccgtttcttcggtttaccgaggaacncgtacgtacctacgaattaacggtacgaagttagtaataagttacgtagttaacgtacgtacgtacgaacaccgtaacccgtaccggaaccggtaacccccgaaccctaacctaccttacgtacgtaccgtagtaacggtaaattaacctccggaccggtccgtacccgtccggttaccggtaccgtccgtaaccgttacgttcgtaccggtctaccgtacgtaacgtccgtaaccgtaccnccgtaacccgtcccgttcccgtacccgtacgtacccgtaagttccggtacgggtcccggttacccgggtacccggtagggaccgttacggtacggtaacgtaccgtttacgttaacgtttacgtccggttagtacccgtaggtaacgtcgtaacggtaggaacgttacgtaccgtacccggtacgtttccggtaacccggttaggtttccggtacgggtttccgggttaaccgggtccgggttaaccgggtaaccggttaacccggtacttacccgggttaaccggtaacccggttaccggtaccggttacccggaccgttaaccccgggg

SEQ ID NO: 283826 - DNA, 639 bp, Homo sapiens
  misc_feature: GYAE6OF02I1Q9K.47.85.H08.1.454.CMB.1.raw
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
tcagagctcacgtacacgaccggtgctcgatttagtatcactcagtcgcggggtctgggagaggagcccagcactggaagtcgccggtgtttccattcggtgatcagcactgaacacagaggactcaccatggagtttgggctgagcgtcggtttcgcgtaggcgtctttaagaggtgtccagtgtcaggtncgcctggtgagtcgggggagcgtggtccagcctgggactcccgtgagacctctcctgtgcagcctctggcttcaccttacaataattntgactatgacgngtcgggtccnccgtaggctaccgaggcgaaggggcctaggacggtgggtcggtcggtactagtacgtcgtaccgaggtcgacagttcttacgtagtaacttacgctacggtacctacccgtggtaacggggcctaacgttccaacgtacgttccaccgagtaacgaacgtaacttaccccgaaacgtaacgtacggtaccgtaacgttcgtactaccctacgtcgtaacctacggtacctacgggtaactaccgttacgaacgaccgtaccgtcttaccctacgtacttaacgtcgtagtaccgaaggtaccgtagtacggaaccggtatacgttacggttgtacgg

SEQ ID NO: 283827 - DNA, 791 bp, Homo sapiens
  misc_feature: GYAE6OF02GCHVQ.47.85.H08.1.454.CMB.1.raw
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
tcagagctcacgtacacgaccggtgctcgatttagtatcactcagtcggcgggggggggtctcaggaggcagcgctctcaggacatctccaccatggcctgggctctgctgctcctcaccctcctcactcgacgggcacgacgggtcctcggggcccaggttcctcggcccccgactccgacgtcctcgcccgtcggtgtcgtcgggtcctccgtggacaggtcgatcacctntcctaccgngacacgtacggaaacctaggttaggtacggtacggttggacttaggtttctgtacttctacgttccgttccgtacggtaaccaaccaacccacccgaggaaccaaaccgaccccctaaatctaattaacgttactcgacgtactaacgttccggtacccgtcccgtcgttacgggtttctacgtcgtccgttacttccgtacgtcgtacctaaccgtaacgtcgtacggaccctaaccgtacccggttcccgttacccgtaccgtaacccgttcgtcccgttcgggtaccggtaccttacggtaccggttcggtaacggacgggaccggtagtcgttagttacgtttaccgttgttaccggttcgtcgtttaccggtacgggttaacctaccggtttacggtttacgggttttcgggtttcgggttaccggttacggggtacggtaacggtacgtacgggttccgtaccggttacggtccggtcgaccggtaaccgtacgttcccgtacccgtcccgtaccgtcctcccgttccgtcccgttaaccccg

SEQ ID NO: 283828 - DNA, 779 bp, Homo sapiens
  misc_feature: GYAE6OF02JAYES.47.85.H08.1.454.CMB.1.raw
  modified_base (116)..(116): a, c, t, g, unknown or other
  misc_feature (116)..(116): n is a, c, g, or t
  modified_base (136)..(136): a, c, t, g, unknown or other
  misc_feature (136)..(136): n is a, c, g, or t
  modified_base (210)..(210): a, c, t, g, unknown or other
  misc_feature (210)..(210): n is a, c, g, or t
  modified_base (721)..(721): a, c, t, g, unknown or other
  misc_feature (721)..(721): n is a, c, g, or t
tcagagctcacgtacacgaccggtgctcgatttagtatcactcagtcgcggggggggtctcaggaggcagcgctctcaggacatctccaccatggcctgggctctgctgctcctcnccctctcactcgaggcacgngggtcctcgggcccagtctcgccccgactcgacgcctcgtccgttccgtgtccgttcgggtcctccgtggtacngtcgtatccacctacttcctctcgaccgtaccgtacggaaacctaggtacgttcggtaacggtttcgggacttagttttcgacgttactttcgtacttcctccgttaacggaaccaaacgtaaccgtacccgaagtaccaaacccgtaacccctaaactacttaactttaaagttacttacgtaacgtaaccgttaacgttccgtacccgttaccccgttacggttacgggttttcccaccgtacgttccgttcttcgttccgtacgtactaccttaacgtcgtacgtaacctaaccgtccgtcccttacccacgtacccgtaccgttaccgtcggtaccggtcgttacggtcgtaccgtaggtacgggtaaccgcggtactttacgttccgttttacgttccgttggttaccgttccgtcgggtttacgaaccttcgtttacgttacgggtttcggttcggttcggtccggaacggtacgttactaggtcgttaccgcgttacggtaccnccggtctaccggtccgtcccgtccgttaccgtcgtacccgttccggtcccgttccccg

SEQ ID NO: 283829 - DNA, 705 bp, Homo sapiens
  misc_feature: GYAE6OF02HNO6H.47.85.H08.1.454.CMB.1.raw
  modified_base (297)..(297): a, c, t, g, unknown or other
  misc_feature (297)..(297): n is a, c, g, or t
tcagagctcacgtacacgaccggtgctcgatttagtatcactcagtcgcggggggggtctcaggaggcagcgctctcaggacatctccaccatggcctgggctctgctgctcctcaccctcctcactcagggcacgagggtcctgggcccagtctcgccccgatcagcctgcctcgtgtctggtctcctggacagtcgatcaccatctcctgctactggaaccagtagtgacgttgctagttctgattctatctctgtaccaacacaccaggacaacgccccaatcattaacttagngtactactaagtcgttccgcccttcgtacgggtttctactactcgtacttctcgtcggcctaccaaactcgtagtacaaccgtaccgcccttacccgtcgtaccctacttacgtccggtacgggtccgttaccggtacgttcgtagggacgggaacggtacggtacgtagttaacgtttacgttacgttgttacgtcgtccgttagggaaccttaacgttaccgttcggtttcggtttaccggggttagttacccgggggtacggtaaccgggtaaaccgttacgggtttccgtaacccggttaccgtaacgggttacccgtaacggtacccccgtaaacggtcccgttacccggtccccccggttaggtccccttaacggtttcccgttacccgtttaacccccccg

SEQ ID NO: 283830 - DNA, 730 bp, Homo sapiens
  misc_feature: GYAE6OF02FRKV0.47.85.H08.1.454.CMB.1.raw
  modified_base (723)..(723): a, c, t, g, unknown or other
  misc_feature (723)..(723): n is a, c, g, or t
tcagagctcacgtacacgaccggtgctcgatttagtatcactcagtcgcagggtcctgggcccagtctgccccgactcagcctgcctccgtgtctgggtctcctggacagtcgatcaccatctcctgcactcggaaccagtagtgacgttggcagttctgattctatctcctcgtaaccgaacaacacccaggacaaaccgaccccctaaactcattaatttagtacgacgtactaagtcgttacccgcccctacgtacgggtttcctactactcgtcttcgtcgtcggtacctacctaaagtccgtacggaccgaacgacccgggtccctccccgtacgacctacgtaccttcggtacgggtcctacggtaccttcggtacggaacggaccggtacgtacggttacgttaacgtttacgtttcgtttgttacggtccttaccggttacgggtacctaaccgttacgttcgggtttacgggttttaacgggtcgggttacggtacgggtacggtacctaacggttcgtacccgtcggtacgtaccgacgacccggacggtccgtcccgtacccggtccggtacctccgttcccgttccgttcccgtcccttccgtaccgtacgtcgaacgttctacggtagccggtacggtcgtaccgggtacgtacggacggtaacgtaggtacgactcgacgtcgtagcgtagctagatcggactggaccnggtccag

SEQ ID NO: 283831 - DNA, 541 bp, Homo sapiens
  misc_feature: GYAE6OF01AGDS4.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatcgacaaccggccctacaaacattcagagagattttcacctcaggacacaaatacagcctctctgaccattactggtctccagcctagacgacgagctgactactactgctcacgcctgggaccaccgacgccctcgctgcgttcggtctttcgggcggtaggacccgaggtccgtcggcccgttccgtgggtacctacggaccccaagggccctccggcccccgttacggg

SEQ ID NO: 283832 - DNA, 364 bp, Homo sapiens
  misc_feature: GYAE6OF01EYPHX.19.85.H08.1.454.CMB.1.raw
  modified_base (358)..(364): a, c, t, g, unknown or other
  misc_feature (358)..(364): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnn

SEQ ID NO: 283833 - DNA, 371 bp, Homo sapiens
  misc_feature: GYAE6OF01CX2W9.19.85.H08.1.454.CMB.1.raw
  modified_base (189)..(189): a, c, t, g, unknown or other
  misc_feature (189)..(189): n is a, c, g, or t
  modified_base (366)..(371): a, c, t, g, unknown or other
  misc_feature (366)..(371): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagaggggggcactggctggtcgggtcgatcttttgatttgngggccaaggatcaagcgtctccgtctcttcagcctccaccgaaggcccatccggtccttccccctggccaccctcctccaagacgcacctcgtcggggcacagccggccctgggcctgccctggtcaaggactacttcccacgagagtactgacgcgggctgggcaaggcgcatagnnnnnn

SEQ ID NO: 283834 - DNA, 358 bp, Homo sapiens
  misc_feature: GYAE6OF01CKU1E.19.85.H08.1.454.CMB.1.raw
  modified_base (354)..(358): a, c, t, g, unknown or other
  misc_feature (354)..(358): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaaggcccatcggtcttccccctggccaccctcctcaagagcacctctggggcacagcggccctggctgcctggtcaaggctacttcccacgagagtactgagcgggctggcaaggcgcatagnnnnn

SEQ ID NO: 283835 - DNA, 564 bp, Homo sapiens
  misc_feature: GYAE6OF01DH5FS.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaacattcagagagtatttcacctcaggacaacaaaatcagcctctctagacctattactggtctccagcctgacgacgacgctgactactactgctcacgtccgtcggaccaccgacgtcctcgctgtccgttggtccgttttcgggcgggtacgggaccgtaaggtcgtacggtacccggttccgtacggggtaccgacggtaccccgaagggccctccggtccccccgttaccggg

SEQ ID NO: 283836 - DNA, 576 bp, Homo sapiens
  misc_feature: GYAE6OF01CN5XH.19.85.H08.1.454.CMB.1.raw
  modified_base (262)..(262): a, c, t, g, unknown or other
  misc_feature (262)..(262): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtcgtccgggggcctggggacaggccgccacagtcacctgcaccgggaacaccaacaatgtccggcgaccagggagccgnttggctgcagcaacgccagggcccaccctcccaaactcctgtccgtacaggaatcgaacaacccggccctacaaactacttcagagagtattttccacctcaagacaacaaaatacacgtcctctctacgacctattacctggtacctacctacgtcccgtagacgaacgacggctacggacttaactactcgtctacacgtccgtcggaccaccgacgtccgtccgtctacgtcgttcggtccgtttcggcggacggaccgaggcgtcggcccgtccgtgggtccacggaccacggcctcccgccccgtccgg

SEQ ID NO: 283837 - DNA, 370 bp, Homo sapiens
  misc_feature: GYAE6OF01DDYJM.19.85.H08.1.454.CMB.1.raw
  modified_base (254)..(254): a, c, t, g, unknown or other
  misc_feature (254)..(254): n is a, c, g, or t
  modified_base (361)..(370): a, c, t, g, unknown or other
  misc_feature (361)..(370): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttatactgtgtgagagaggggggcactggctggtcgggtcgattcttttgatttggtggggccaagggatcaaggcgtctccgtctcttcagcctcaccaaggcccatcggtcttccccnggccaccctctccaagacgcacctcgtggggcacgagccggcctggggctgccctggtcaagggactactcccagagagtactgagcggctggcaaggcgacatagnnnnnnnnnn

SEQ ID NO: 283838 - DNA, 363 bp, Homo sapiens
  misc_feature: GYAE6OF01BCP8C.19.85.H08.1.454.CMB.1.raw
  modified_base (358)..(363): a, c, t, g, unknown or other
  misc_feature (358)..(363): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggcaccctcctccaagagcacctctggggcacagcggccctgggctgcctggtcaaggactacttcccacgagagtactgagcgggctgggcaaggcgcatagnnnnnn

SEQ ID NO: 283839 - DNA, 548 bp, Homo sapiens
  misc_feature: GYAE6OF01AVE6W.19.85.H08.1.454.CMB.1.raw
  modified_base (423)..(423): a, c, t, g, unknown or other
  misc_feature (423)..(423): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctccaaactcctgtcgtacaggaatgaccaaccggccctacaaactattcaagagagattttcacctcaggacacaaaatacacgcctctactacgaccattactggtctccagcctgacgacgagctgactactacngctcacgccgtcggacaccacgcctcgctcgtcttcggtccgtttcgggcggacggaccgtagtcgtcggacccgttccgtacgggtacctacggaccccgaaggtcctccggtcccccgtcggg

SEQ ID NO: 283840 - DNA, 363 bp, Homo sapiens
  misc_feature: GYAE6OF01DCHZX.19.85.H08.1.454.CMB.1.raw
  modified_base (359)..(363): a, c, t, g, unknown or other
  misc_feature (359)..(363): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggccaccctcctccaagagcacctctgggggcacagcggccctgggctgcctggtcaaggactacttcccacgagagtactgagcgggctgggcaaggcgcatagnnnnn

SEQ ID NO: 283841 - DNA, 605 bp, Homo sapiens
  misc_feature: GYAE6OF01BF0ET.19.85.H08.1.454.CMB.1.raw
  modified_base (298)..(298): a, c, t, g, unknown or other
  misc_feature (298)..(298): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagcccaccctcggtgtccgggggcctgggacaggccgccacagtcacctgccaccgggaacaccaacaatgtcggcgaccagggagccgcttggctgcagcaacgccagggccaccctccaaactccngtcgtacagatcgacaaccggcctacaaactattcagtacgagtacttttctacctccaaggaacaacaaaattaccgaagcccttactctacgaacctaactttactcggtcctaccacgtcccttagaccgaacgtacggaccgtcgaaccttaacctactcgtacctccgacgcccgtacgggacccaccgacgcccgttcgctacgtcctcggtccgtttcggacgggacggtaccgacggtcctcggtacccgtccgtcgggtaccgtacgacccgaacggccctccggcccccgtacccgg

SEQ ID NO: 283842 - DNA, 548 bp, Homo sapiens
  misc_feature: GYAE6OF01DLG83.19.85.H08.1.454.CMB.1.raw
  modified_base (395)..(395): a, c, t, g, unknown or other
  misc_feature (395)..(395): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccacgggccacccctcccaaactcctgtcgtacaggaactgaaccaaccggccctacaaaccattcagagagattctctgcatccaaggtcaaggaaacacagccctcctgaccctatttcnggactacccacgcctagaccgacgacggctagtacttacttactgttcagtcgtgggacacgcacgcctcgcgtgtcgttggtcggttcggcgggacgggaccaggccgtcgacccgtcgtcgggtaccacggcccgaaggtccgtaccccgg

SEQ ID NO: 283843 - DNA, 541 bp, Homo sapiens
  misc_feature: GYAE6OF01BMWKQ.19.85.H08.1.454.CMB.1.raw
  modified_base (450)..(450): a, c, t, g, unknown or other
  misc_feature (450)..(450): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggacgccgcttggctgcagcaacgccagggcccaccctccaaactcctgtcgtacaggaactcgaccaaccggccctacaaactattacagagagtactttcacctacaggacaacaaatacacgcctctctgacctattactggtcctcacgccctagacgacgaggctagactactactgctcacgcctggaccaccncgtcccgtcgctcgcgttcggtcgtttcggcggaggaccgagtctacggccgtccgtcgggacacgcccgaacggctcccgccccgtccgg

SEQ ID NO: 283844 - DNA, 838 bp, Homo sapiens
  misc_feature: GYAE6OF01CS5FW.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctctcactcactctgcagtgtcagtggtccaggcaggactgactcagccacctcggtgtccggggcctgggacaggccgccacagtcacctgcaccgggaacaccaacaatgtcggcgaccgagggacgccgcttggctgcagacaacgcccgacgggcccaacccctacccaaaacctcctacgtaccgtaacgaaggaacacgaaccaaacccggccctaacaaaactagtttaccaagaacgtaagtaacttttacctaacccgttaccgaacggaaccaaactaaaaactaacgacgtaccttacctactacgtaacctaactttaacgtcggttacctacccgaacgtacccgtacggaacggaaccggtaacgggtacctacggtaaaccttaaccgttaaccgtacggtacccgtttaccgaaccggtcccggttaaccgggggaaacccaacccccggtaaccgtacccccgttcccggtacccgtttaccgggttccggtttttaccggggtttaccccggtttttttacccggggggacccgggggttaaacccgggggaaaccccggtaaaacgggtaccccgtttaccggggaaccccccgggtttacccgggttaccgggggttaaccccgaaacccggggtaccccggtaaaacccggggtccccgttcccccgggtaccccccccggtttaccccgggg

SEQ ID NO: 283845 - DNA, 609 bp, Homo sapiens
  misc_feature: GYAE6OF01CLLNC.19.85.H08.1.454.CMB.1.raw
  modified_base (254)..(254): a, c, t, g, unknown or other
  misc_feature (254)..(254): n is a, c, g, or t
  modified_base (317)..(317): a, c, t, g, unknown or other
  misc_feature (317)..(317): n is a, c, g, or t
  modified_base (458)..(458): a, c, t, g, unknown or other
  misc_feature (458)..(458): n is a, c, g, or t
  modified_base (472)..(472): a, c, t, g, unknown or other
  misc_feature (472)..(472): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggacnccgcttggctgcagcaacgccagtcgacccaccctaccaactcctcgtacgtaacgaagtaanaccgaaccgaaccccggtccctaacaaactacttacgaagaagaagttactttaccacctacgaacgaacaaacaaaactacacgcctctactacgaacctattacgtcgtccacgacgtctagaaccgaggacgtcgtanaaccgtactactcnctacgacgtcgaccggaccaccacgtcctcgtacgtcgtcgttcggttccgttcgggacgggtacggaaccgtaagtccgtacggccccggttggtcggtaccgaccgtacccgacggtcccgtacccgtcccccgg

SEQ ID NO: 283846 - DNA, 550 bp, Homo sapiens
  misc_feature: GYAE6OF01AZFCJ.19.85.H08.1.454.CMB.1.raw
  modified_base (251)..(251): a, c, t, g, unknown or other
  misc_feature (251)..(251): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtgtccgggggcctgggacaggccgcacagtcactgcaccggaacacaacaatgtcggcgaccaggganccgcttggctgcagcaacgccagggcccaccctcccaaactcctgtcgtacaggaatgaaccaaccggccctacaaacatttcagagagtatttcacctcgagacaacgaaaatacagcctactactcgaactattacgtcggtctaccacgacctcgaacgacgaggactacgactactactgactcagctaggactacgacgtcctcgactgacttggtcctttcggccggaaggaccgaagcgtacggtaccgtccgtcgggtaccacggccccgaagcctaccgccccgtaccgg

SEQ ID NO: 283847 - DNA, 813 bp, Homo sapiens
  misc_feature: GYAE6OF01CZ2J3.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtgtccaggcaggactgactcacgcccacccgtcgggtcggtcccgggggcctcgggacacgggcccgccacgcgtccaccgtgaccgaaccgggaacaccaacaacgtcggtaccggaccgaaccgacggggacgtcccggcgtttcgggccgttggaccgacggaccgaaaaccggcccggaaccggggtaccccctaaacccccgtaccccctaaaaccgttccccgttacggtacccggtaaccgaaggtaaacgtaccggaaaccccgtaaaccccgggtacccctaaccgaaaaaccgttacttttaaccggaacgtaacggtaacgtttaacctttttacccgaaccccttaccgtaaacggtaacctaaaacctaaaaacgtacctaaccgtacccgttaccttaccgtaacgttaacccgttaacgtttaccgttaccggttaccttacccgtaccgtacccgtacggtaaccggaaccggtacggtaccgtacgtaaccttacgtactacgtaccgtacgacgtaccgtacggacctaccgtaccgtccgtccgtacgttcgtccgttcggtccggtttacggacggtacggaccgtacgtccgtacggtccgtcgtacggcgacgacccgacgtccgtcccgtcccgtacccgg

SEQ ID NO: 283848 - DNA, 443 bp, Homo sapiens
  misc_feature: GYAE6OF01CPWVJ.19.85.H08.1.454.CMB.1.raw
  modified_base (420)..(443): a, c, t, g, unknown or other
  misc_feature (420)..(443): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagaggaggggggcacgtggctggtcgggtcgatcttttgatttggtggggccaaggatcaagcgtctccgtctcttcagcctcaccgaacggccatccggtcctcccctggccaccctcctacaagacgccaccgtcggtcgggggaccacgacggccggcccgttggggcctcggcccgttagggtaccaaacgggtacccttaccgttccccaacgggtagtacgtaccgtggacggccggggcctagggaccaagggccgacaagtacgnnnnnnnnnnnnnnnnnnnnnnnn

SEQ ID NO: 283849 - DNA, 837 bp, Homo sapiens
  misc_feature: GYAE6OF01DAPJI.19.85.H08.1.454.CMB.1.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctctcactcactctgcagtgtcagtggtccagcaggactgactcagcccacccgtcggtggtcccgggggcctgggacacggccgaccacagtcacctgaccgaccggaacaccaacatggcgcgaccagganccgntggntgcancacgccgaggtcccaccctaccaaactcctagtccacaggaatacgaaccgaacccggcctaacaaactacgttacgaagagtaacgttacttttaccaaccgtaccgaaacgtaacaaacctaaaagtaccacgtacccctacttaccacggtaaccctaagtttaccgtaggttaccctacgaaccgtacctacggaaacgacggacggtactaccggtaacttaccgtacgtacgtaccgtacgtaccgggtacccgttaccggggaaaccctaaccccggaccgttaaccccggtacggtacccggttttaccgggttaccccgtttcggggtttaccccggggtttttacccggggaaacccccggggggtttaaaccgggggaaaacccgtaaaccccggggttacccggtttaaacccggggtaaccccccggggtttacccccggggttaacgggggttaacccccgtaaaaccccggggtacccccgggtttaaaacggggtcccccccgtttcccccgggggtttaacccccccccccggttttaaacccccggggg

SEQ ID NO: 283850 - DNA, 744 bp, Homo sapiens
  misc_feature: GYAE6OF01ECNB8.19.85.H08.1.454.CMB.1.raw
tcagtactctcgtgcacgaccggtgctcgatttagtatcactcagtcagtcgcggggttcaaacagagcttcagcaagcatagtgggaatctgcaccatgccctgggctctgctcctcctgaccctcctcactcactctgcagtgtcagtggtccaggcaggactgactcacgccacccgtcggtcggtccgggggctgggacacggccgccacgacgtccacctgccgaaccgggaacaccaacaagtcggtccggacgaccgagggacgccgcttggctgcagcaacgccacggcccacccgtacccaaacctcctacgtccgtaacgaggtaactcgaaccgaacccggtaccctaacgaaaactactttacgaagtaacgtacgttaacttttaccaacccgttaccgaacggtaaaccaaacgtaaaaactacccgacgtaccccttacctaccgtacgaccttaactttaccgttaccggttcctaccgtacgtaccccgttacggaaccgtaacgacggtacctacgtaaccttaaccgtaccgtcgtcctacgaccgtaccggtacgggacccacccgacgtcccgtaccgtcgttccggttaccggtttcggttccgttttccggggaccgggtaaccgggtacccgtaaaccggtccgtacggtccccggttacccggtacgggtaccgacccggtaccccgacgggtcccgtcccggtcccccggttacccgg

SEQ ID NO: 283851 - DNA, 858 bp, Homo sapiens
  misc_feature: GYAE6OF01EA2DB.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcacgccaccgtcggtcgtccggggcctgggacacggccgccacagtcaccgtgccaccgggaacaccaacaatgtcggcgaccgagggacgccgcttggcctgcagcaacgccacggcccacccgtaccaaactccgtacgtccgtaacgacggactacgacccgaaccggccctacgaaaactacgtttaccgaagtaacggtagttacttttacccaaccctaccgtaacggaacctaaaccaaaaattacccgaacgtaccccttacttacccgtaacggtaacccttaacgttttaacccgttaccggttacccgttaaccccgtaaccggtaccccgttaacggaaaccccggtaccggggtaaaaccggttcccggttaacggttaaacccttaaacccggttaacccgtttccggtacccgtttacccgaaccgggtaccccgggttaaccggggtaaacccctaacccccggtaaaccggtccccgtttaaccgcccggtttaacccggttccggtttccgggttaccggttttccgggggaacccggggtaaccgggaaacccggtacggtacccgttcccgggtaaaccccggtttcccgggtaccggggttacccgaaccgggttaacccccggaacgggttcccctaaccccgggttccccccgggttaaccccggg

SEQ ID NO: 283852 - DNA, 608 bp, Homo sapiens
  misc_feature: GYAE6OF01DS4V3.19.85.H08.1.454.CMB.1.raw
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (330)..(330): a, c, t, g, unknown or other
  misc_feature (330)..(330): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtccgggggcctgggacaggccgccacagtcacctgcaccgggaacaccaanaatgtccggacgaccagggagccgnttggctgcagcaacgccaggccaccctcccaaactcctgtctacaggatcgaacaccgcctacaaacnttacagagtagtactttactacctcaaggacaacaaactacacgcctactctacgactacttactgtacctcacgtcctgaacgacgacgtctcgacctactactcgtctcacgcgtaacgggaccaacccgacgtacccgtcgtctcggtacgtttcgggttccggttttaccgggccgggtaacgggaacccgtaagccggttacggacccggttccggttccggggtaccgaccggaccccggtaaggcccgtacccggtcccccgttacccggg

SEQ ID NO: 283853 - DNA, 368 bp, Homo sapiens
  misc_feature: GYAE6OF01BEOIL.19.85.H08.1.454.CMB.1.raw
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (322)..(322): a, c, t, g, unknown or other
  misc_feature (322)..(322): n is a, c, g, or t
  modified_base (351)..(368): a, c, t, g, unknown or other
  misc_feature (351)..(368): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagaggaggggggcactggctggtcgggtcgatcttttgatttggtggggccaaggatcaagcgtctccgtctcttcagcctccacaagggcccatcggtcttccccngccacctcncagagcacctcngggacacagcgccctggctgcctggtcaaggacctacttcccagagngtactgagcgggctggcaaggcgcatagnnnnnnnnnnnnnnnnnn

SEQ ID NO: 283854 - DNA, 400 bp, Homo sapiens
  misc_feature: GYAE6OF01CXJLM.19.85.H08.1.454.CMB.1.raw
  modified_base (390)..(400): a, c, t, g, unknown or other
  misc_feature (390)..(400): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagaggaggggggcacgtggctggtcgggtcgattcttttgatttggtggggccaaggatcaagcgtctccgtctcttcagcctccaccaagggcccatcggtccttcccccgtggccacccctcctccaagacgccacctcgtggggcacaggccggcctgggctcgcccgtggtacaacggtacctaccttcccgacgagacgtactgacggccgggactgggacaacgggccgacaatggnnnnnnnnnnn

SEQ ID NO: 283855 - DNA, 630 bp, Homo sapiens
  misc_feature: GYAE6OF01DIZUU.19.85.H08.1.454.CMB.1.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
  modified_base (269)..(269): a, c, t, g, unknown or other
  misc_feature (269)..(269): n is a, c, g, or t
  modified_base (352)..(352): a, c, t, g, unknown or other
  misc_feature (352)..(352): n is a, c, g, or t
tcagtactctcgtgcacgaccggtgctcgatttagtatcactcagtacgacgtcgcggggtccaaacagacgccttcagcaagcatagtgggaatctgcaccagtgccctggctctgctcctcctgaccctctcactcactctgcagtgtcagtgtccagcaggactgactcagccaccgtcggtgtccgggggcctgggacacggccgccacngtcaccgtgaccaccgggaacaccaacaagtcgccggacgaccgagggacnccgnttggctgcacgcaacgccgacggcccaccctaccaaactccgtacgtcgtaacagaatcgaaccaacccggcctacgaaactnttacagagagtactttaccacctcgaaaggacaaactaaaactacacgtaccttactacgtacgtacctaattacgtcggtacctaccgtacgacccgttacgaaccgtaacggtacggactacgtaaccttaaccgtactacgtacctacacgtaccgtacggaccaaccgacgtcctacgcgttacgtcgttcggttcgttacggcggtaacggacctacgtcgtacgccggttcgtacgacgtaaccgaccgaggtcccgtccgtcccgttccgg

SEQ ID NO: 283856 - DNA, 804 bp, Homo sapiens
  misc_feature: GYAE6OF01CAPSU.19.85.H08.1.454.CMB.1.raw
tcagtactctcgtgcacgaccggtgctcgatttagtatcactcagtcagtcgcggggtccaaacagagcttcagcaagcatagtggaatctgcaccatgccctgggctctgctcctcctgaccctcctcactcactctgcagtgtcagtggtccaggcaggactgactcacgccaccgtcggtcggtccgggggcctgggaccacggcccgccacagtccaccgtggacgaccgggaacaccaacgaagtcggtccggacgaccgagggtacgccgtcgttggctcggacagaccgaaaccggccgaacgggaccccaaccccgtacctaaaaccttcccgtgttaccggtacaagggtaactacggaaccgaaccccgggtaccctaacgaaaacttacgtttacgaaggtacgtaacgttaactttttacccgaccctacgaaacggtaaccaaacgtaaaactacgacgtacctactaccgacgtaacctacgtttaccgtcgtacctaccgacgtccgttacgaaccgaacggtacggtaccgtacgtaaccgttaaccgttaaccgtacgtaccgttaccgtaacggtacccgttaacggaaccctacccgtaaccggtacccgttccgtacgttaccgtccggtttccgggttacccggttttccggggaccgggtaaccgggtaacccggtaaccgtacccgggttaccgttaccccgggttacccgtacgggtaccccgttaacccgggacccgtaaccgggttccccgttcccgggtcccccccggtttacccgg

SEQ ID NO: 283857 - DNA, 761 bp, Homo sapiens
  misc_feature: GYAE6OF01DSK3E.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctggggaccacggccgccacagtccaaccgtgccgaaccgggaacaccaaacaagtcggtaccgggacgaaccgagggaacgcccggtcgttcggcttcgaccaacggaccgaaccggcccgaccggggtccccaacccctaccccgaaaacgttcccgtaggtacccgtaacgaacgggtaataccggaaacccgaaaccccgggcccctaacgaaaaccttacttttaccgaaaggtaacgtaacgttaactttttaccgaacccttaccgaaacggtaaaccaaactaaaaactaccaacgtacccttacgttacctacgtaaccctaacgtttaaccgttcggtaccttaccgaacgtacccgttacgaaccggtaacggacgtacgtacgtaaccttaacgtactcgtactacgacgtcgacggaccaccgacgtcctacgtcgtacgtcgttacggttccgtttacgggacggtacggaccgtaacgtcgtacggtacccggtccgtacgggtaccgacggtaacccgtacggtacccgtcccggtccccgttaccgg

SEQ ID NO: 283858 - DNA, 595 bp, Homo sapiens
  misc_feature: GYAE6OF01C2IRG.19.85.H08.1.454.CMB.1.raw
  modified_base (544)..(544): a, c, t, g, unknown or other
  misc_feature (544)..(544): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtgtccgggggcctgggacaggccgccacagtcacctgcgaccgggaacaccaacaatgtcggcaccgagggagccgcttggctgcagcaacgccacgggcccacccctcccaagcctcctcgtaccctacgaacggaactaaccccaacccggcccctacgaacgggactctacgagaagagtattctcgtgtacacgtcccgagggttacaaacggaaacaccacgtccctcccgtacgaaccctatttccgacggtaccctccaacgtcctacgacgtacgacggtctagactattactcgttacgaggtcgtacgggactagcgacgccgtcgctggtgttcgggttcgttaccgggnggacggaccgaagcctcgacccgtcgtacgggtcacggtccgaaggtcccg

SEQ ID NO: 283859 - DNA, 543 bp, Homo sapiens
  misc_feature: GYAE6OF01BJWQ0.19.85.H08.1.454.CMB.1.raw
  modified_base (246)..(246): a, c, t, g, unknown or other
  misc_feature (246)..(246): n is a, c, g, or t
  modified_base (453)..(453): a, c, t, g, unknown or other
  misc_feature (453)..(453): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccggacacacatgcgcgacaggganccgcttggctgcagcaacgccagggcccaccctccaactcctgtcgtacaggaactcgaccaaccggccctacaaactatttcagacgagtacttttctacctccaggaacaacaaaactacacgcctactactacgacctattactcggtctccacgccctagacgacgacgctagactacgtactcgtctacacgccgtggaccnccgacgtcctcgctgtcgttcggtcgttcggcggacgggacacgtgtacggccgttccgtcggcacgcccgaggcctccgccccgtccgg

SEQ ID NO: 283860 - DNA, 804 bp, Homo sapiens
  misc_feature: GYAE6OF01DH265.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctggctctgctcctcctgaccctcctcactcactctgcagtgtcagtcggtccaggcaggactgactcacgccaccgtcgggtcggtccgggggcgtgggaccgacggcccgaccgacgacgtccaccgtcgaccgaaccgggaaaccaaccgaaactaacgtcggtaccgggaccggaaccggaacggggacgtcccggtcgtttacgggccgtcggaccgacggaccgaaaccggcccggaaccggggtaccccctaaccccgtacccgaaaaccgttcccgtacggttaccgaacgaaacggtaacctaccggaacccgaaccccggtaccctaaaccgtaaaaccttactttacgaacgtaacggttaacgttaacttttaccctaacccgttaaccgaaacggtaaaccaaacgtaaaactacgaaccgtaccctactaccgtactaaccttaagttaccgtcggttaccaccgtacgtacccgtacggaaccggacgtacgtcgtaccgtaactaaccgtctccgtactacgtacggaccgtcggaacccaccgaccggtccgtcgtcgttcgtacggtttccgttacggttaccgggaccggtaaccggtaaccgtacgggtcccgtacgggtacccggtccggttacggacctaccgggtaccgacggttccccgtcccggtaccccgttccgg

SEQ ID NO: 283861 - DNA, 528 bp, Homo sapiens
  misc_feature: GYAE6OF01D1VBQ.19.85.H08.1.454.CMB.1.raw
  modified_base (455)..(455): a, c, t, g, unknown or other
  misc_feature (455)..(455): n is a, c, g, or t
  modified_base (458)..(459): a, c, t, g, unknown or other
  misc_feature (458)..(459): n is a, c, g, or t
  modified_base (463)..(463): a, c, t, g, unknown or other
  misc_feature (463)..(463): n is a, c, g, or t
  modified_base (472)..(472): a, c, t, g, unknown or other
  misc_feature (472)..(472): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
  modified_base (482)..(528): a, c, t, g, unknown or other
  misc_feature (482)..(528): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagaggaggggggcactgggctgggtcgggtcgattcttttgatttggtggggccaaggatcaagcgtctccgtctcttcacgcctccaccgaacggcccagttccggtccttccccccgtggccctaccccgtcctaccgaaagcgcctacccgtcggtggggggacccacgacggccggcccccgtggggccttcggcccgttggggaccaaacgggtaccttaccctttaccccgaacggaaggtacgtaaccgtgggaacggccggggtctagggaccgtaaacggggcgaccgaagttaacggcngtnnacancatgagctnanagtncgannnnnnnnnnnnnnnnnnnnnnnnnnnnnnnnnnnnnnnnnnnnnnn

SEQ ID NO: 283862 - DNA, 730 bp, Homo sapiens
  misc_feature: GYAE6OF01EYFEZ.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcgggtggtccgggggcctggggacacggccgccacagtcaccgtgccgaaccgggaacaccaacaagtcgtacggacgaccgagggacgccgcttggctgcacgacaacgccacgggcccaccctacccgaaacttccgtcgtccgtaacgaaggaactcgaaccaacccggccctaacgaaacctatttaccgaaggtaacgtaacgttacttttacctaaccctaccgaacggaaacctaaactaaaaataccgacgtaccctactcctacgaaccctacttaccgttacgtacctaccctacggtaccctacggaaccgtacggacggtaccgtacgtaaccttacctacgtcgacctaccgacgtaccgtacgggaaccacccgacggtccctccgtacgttcggtaccgtttcgggttaccggttttcccgggaccgggtaaccgggtaccgtaacggtcccggttacggtacccggttacccggtacgggtacccgaaccggtaccccgaaccgggtcccgtcccggtcccccggttacccggg

SEQ ID NO: 283863 - DNA, 684 bp, Homo sapiens
  misc_feature: GYAE6OF01BHFTL.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtggtccgggggcctgggacaggccgccacagtcacctgcgaccggaacaccaacatgtcggcgacagggacgccgcgttggctgcagacaacgccgacggcccacccctcccaaacctcctcgtacgtacaaggtaatacgaccaaccggccctacaaactacttacagtacgacgtattttaccacctaccgacggaaccaacgtaaaatacacgtacctctactacgaacctacttacgtacgtcgtaccgtacgtacctaggaaccgacggacggtcctacggtaaccttacctacgtcgaccgtcacgtccgtacgggacctacccgaacgtcccgttcgaccgttcgtacccgttcgggtccgttttacggggccgggtaacggggtacccgtaacgggtacccgttccggtaaccccgggttccggtaccggggtaccctaaccgggaccccggtaaaccgggtccccgttccccggtcccccccggttacccggg

SEQ ID NO: 283864 - DNA, 822 bp, Homo sapiens
  misc_feature: GYAE6OF01D8CJ5.19.85.H08.1.454.CMB.1.raw
  modified_base (469)..(469): a, c, t, g, unknown or other
  misc_feature (469)..(469): n is a, c, g, or t
tcagtactctcgtgcacgaccggtgctcgatttagtatcactcagtcagtcggcggggtccaaacagagcttcagcaagcatagtgggaatctgcaccatgccctgggctctgctcctcctgaccctctcactcacttctgcagtgtcgagtcgtccgaggcaggactagacctcgaccgcccacccgttcgggtccgggtccgggggcctggggaccaccgggcccgccacgacgtccaccgtacgaccggaaccggaaccaaccaaacgacgtcggaccggacgaccgtagggacgccgtacggttcggactcggacaacgaccgaaccggccgaccggcccccaaccgtaacccaacgttccgtacgtaccgtaacgacggtacgacaacccggtaaccccgaccttaacgaaactagttacgaacgtaacggttacttaaccttttaccccacgtaaccgggaanaaaaccccttaaagaaaacgtttaccgaccgtacttaaccgttactaccggtaaccttacgtttccgtccgtaacttccgacgttaccgtacgaaccggtacgtaccgtactaacgtaacctaccgttaccgtcgtcgttaacccgacggttaccgtaaccggaaccctaccggtacgtaccgttaccgttcgttaccggttacccggtttggttaaccccggtccggggaaaccggggtaccggaaaccgggtaccgttccgggtacccccgtccggggtttaccggtaccgggtaccccaccgggttacccgggaacgttccccccggtcccgggtaccccgttacccggg

SEQ ID NO: 283865 - DNA, 386 bp, Homo sapiens
  misc_feature: GYAE6OF01BVA6H.19.85.H08.1.454.CMB.1.raw
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (372)..(386): a, c, t, g, unknown or other
  misc_feature (372)..(386): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagaggggggcactggctggtcggtcgatctttgatttgtgggccaaggatcaagcgtctccgtctcttcagcctccaccaagggcccatccggtccttccccctggccacccctcctccaacgagccacctctgggggcacgagccggccgtgggctcgcctggtaccaaggactaccttcccacggagagtacgngacgcgggctggcgaaggcganatagcnnnnnnnnnnnnnnn

SEQ ID NO: 283866 - DNA, 485 bp, Homo sapiens
  misc_feature: GYAE6OF01BQ3BF.19.85.H08.1.454.CMB.1.raw
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (434)..(485): a, c, t, g, unknown or other
  misc_feature (434)..(485): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagaggaggggggcactggctggtcgggtcgattcttttgagtttggtgggccaaggatcaagtcgtctccgtctcttcagccctccaaccgaacgggccccagtccggtccttcccccgtggcccacccctcctaccaagcgccaccgtcgtcggggcacgacggccggcccgtgggcctacggcccgtggtaccgaacgggtacctacccgttacccgaacggacgtacggtaccgtggacgggtccgggtacgtcggaaccggaaaggcccggtanaagtagcngnnnnnnnnnnnnnnnnnnnnnnnnnnnnnnnnnnnnnnnnnnnnnnnnnnnn

SEQ ID NO: 283867 - DNA, 626 bp, Homo sapiens
  misc_feature: GYAE6OF01BRRQ9.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctctcactcactctgcagtgtcagtgtccaggcaggactgactcacgccaccgtggtcggtcccggggctggggacacggccgccacgagtcaccgtgaccgaaccggaacacaacagtggtaccggcgaaccgagggacgccgtcgttggcctgcacgcgaacgccgacgggcccaaccctccgaaactccgtagtacgtacaggaatcgaccaaccggcctaacaatacttcgaagtacgagtactttaccacctacgaacggaaccaaacgtaaaactaccgacgtccttacgtacgtacgtacctacttacgttcgtacctaccgtaacgtcctacgacggacgacgtacgtacgtaaccgtactacgtcgctaccacgtccgtacggaccaaccgaccgtccgtcgtacgtcgtacgtcggtcgtttacggcggtaacggacgacgtcgtacggccggtaccgcgaccgtccgaacgtcgccgtcccgtcgtacccg

SEQ ID NO: 283868 - DNA, 876 bp, Homo sapiens
  misc_feature: GYAE6OF01AVAQX.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctggctctgctcctcctgaccctcctcactcactctgcagtcgtcgagtcggtccgaggcgaggactgactcgacgcccacccgtcggtcgggtcccggggccgtacggggacacggcccgaccacgtacgtccgacctggaccgaacccgggaacaccgaacgaagtcggtccgggaccgaccggagggacgccgtacgttcggctcgcgacgaccgaaccggccgaccgggaccccacccctacccgtaaccgtcccgtacggtaccgtaacgaacggtacgtaccgaaccgtaaccccggacccttaacctaaaccgtacgtttacgaacggtacgttaacgttttacctttaaccgttaaccccgtaccgaaacggtaaaccctaaacgtaaaaactaccgtaaccgacccgtttaccctaccgttaaccggtaaccctacgtttaacccggttaccgtacctacccggtacccgttacggtaccgaaccggttaacggacggttacccgtacggtaacccgtttaaacgtccgttaccgtaccgtacgtccgggttaaccggttaccgggaacccctacccggttaccgtccccgttacggttccgttaacccgggtttcgtttaccgggttacccggtttacggggaccggggtaaccggtaaccgggttaccggtacccggttacccggttcccggttccgggtacccggttaccgacccgggtacccggtacggttaccccccgtcccgggtacccgttaccccgg

SEQ ID NO: 283869 - DNA, 794 bp, Homo sapiens
  misc_feature: GYAE6OF01AYZD2.19.85.H08.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
tcagtactctcgtgcacgaccggtgctcgatttagtatcactcagtcagtcgcggggtccaaacagagcttcagcaagcatagtgggaatctgcaccatgccctggctctgctcctcctgaccctctcactcactctgcagtgtcagtcggtccgaggcaggactgactcacgcccaccgtcggtcggtccggggctgggacacgggccncacacgtaccacgtcgaccgaccggaacaccaanaagtcggacggaccgacgaacgggacgccgtcgtcgcgtcgacgacgaccgaaccggccgaaccggcccctaaccccgtacccgaaaccttccgtacgtaccggtaacgaacggtaactacggaacccacccggtaccctaacgtaaactcgtttaacaaggtaacgttaacggttacttttacccgaacccgttacgaaaccggaaacctaaacgtaaaaaccgtccgtaaccgttacccttaccgttacgacccgttaacgttaaaccctttcggttaccgttaccccgtacgacccggtacgtaccggtaacggaccggtaacggccttacgtaaccgtaccttacggtaccgcttaccgggtaccgaccggttaccggaacccgtccgaccggttccccgtagtcccgttacggttccgtttacgggttcccggttaaccggggtacgggacccgtaaacggtcgtaccggttaacccggttccggtaccggcggtcccgaaccgggtacccgtaaccggtcccgttccggtcccccgttacccgg

SEQ ID NO: 283870 - DNA, 696 bp, Homo sapiens
  misc_feature: GYAE6OF01AH13B.19.85.H08.1.454.CMB.1.raw
  modified_base (366)..(366): a, c, t, g, unknown or other
  misc_feature (366)..(366): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcacgccacccgtcggtcggtccgggggcctgggacagggcccgccacagtcacctgaccgaccgggaacaccaacaagtcggtcggacgaccgagggacgccgcttaggctcgcgagacaacgccgacggcccacccgtacccaaactcctagtacgtacgaaggtaactcgaaccaacccggccctaacgaaactnttacaagacgtagtacttttacacccgtaccgaaggaaccaactaaaactcacgtacctcgtactacgaacctacttacgtcggtacctaccgacgtccctagaaccgacggagtacctacgtaaccttaccgtactcgtaccgttaccgacggtacccgtacgggaaccctaccgtaaccgtccgttaccgtcgttacgttccgttcggttccgtttccgggacggaaccgggtacccgtaacggtacccgtacggtacccggtccggttacgggacccgtaccggtaaccccgtaacgggcccttaccccggcccccgtttacccggg

SEQ ID NO: 283871 - DNA, 624 bp, Homo sapiens
  misc_feature: GYAE6OF01B6GQI.19.85.H08.1.454.CMB.1.raw
  modified_base (201)..(201): a, c, t, g, unknown or other
  misc_feature (201)..(201): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
tcagtactctcgtgcacgaccggtgctcgatttagtatcactcagtcagtcgcgggtccaaacagagcttcagcaagcatagtgggaatctgcaccatgccctgggctctgctcctcctgaccctctcactcactctgcagtgtcagtggtccaggcaggactgactcagccacccgtcggtgtcccgggggcctgggacncggccgccacagtccacctgaccacctggaacaccaacaatcgtacggcgaaccagggagccgcgttggcctgcagcaaccgccgaaggcccacccgtacccaaactcctgtcgacaggaatgaccgaccgccctanaaactattcaganagtactttctactcagtaacacaaactcagcctctacacaaccctattaccgtacggtcttacccgacgaccttacgaaccggacgacgggtacctaggtaacctactacgtacgtctcgacgtaccgtacgggaccaacccgtacggtcctccggcttacggtcctttcgggttaccttttccgggacgggtacggaccgtaacggtcgtaccggtacccggtccgtacgggttaccacggaccccgtaacggtcccgtccggtccccccgg

SEQ ID NO: 283872 - DNA, 640 bp, Homo sapiens
  misc_feature: GYAE6OF01DAHWG.19.85.H08.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagtactctcgtgcacgaccggtgctcgatttagtatcactcagtcagtcgcgggtccaaacagagcttcagcaagcatagtgggaatctgcaccatgccctgggctctgctcctcctgaccctcctcactcactctgcagtgtcagtgtccaggcaggactgactcacgccaccgtcggtgtccggggcctgggacaggccgcacagtcactgcacggacactaacangtcgcgaacgnggacgccgcttgctgcagcacgcacggccaccgaccaaactccgtgtactacgaggaatcgaaccgaccgacctacgaaaactcgttcaagagtactagtttctaccgcaaggacaactaaacgtacagacctctactcgtaactacttaacgtcggtcctaccgagtccccgtgaacggacggcggtaccgtagtaaccttactacgcgtaacgcgaacgtccggtacgggaccaacccggtcgtaccctccggtacgttcggtaccgtttcggttcccggttttacgggcgggtaaccggtaaaccgtaacgggccctttccggggaaacccgtttcccgtaggttacccgacccggtacccgaaccgggttccctccgggtcccccctttaccggg

SEQ ID NO: 283873 - DNA, 718 bp, Homo sapiens
  misc_feature: GYAE6OF01EUFT9.19.85.H08.1.454.CMB.1.raw
tcagtactctcgtgcacgaccggtgctcgattttagtatcactcagtcagtcgcggggtccaaacagagcttcagcaagcaatagtgggaatctgcaccatgccctgggctctgctcctcctgaccctcctcactcactctgcagtgtcagtgtccaggcaggactgactcagccacccgtcggtggtccgggggcctggggaccacgggccgaccacacgtccacctgccaaccggggaacaccaacaagtgtccggacgaccgaggacgccgcgttggctgcgagccgaacgccgacgggcccacccgtacccaaacgtccgtcggtacgtacaaggactcgaaccaaccggtccctacgaaactatttccgagacgagttactttcctacccgtacaaggaaccaaccaaaatccgacgtacctctacgtacgtaacctacgttacgttacggtcctacctacgtacccgttaacgaccgtaacggtacggtccgtaacgtaaccgttaaaccttacgtcgtactaccgtaaccgtccggtacgggaacccaccggtaccgtaccgtacgtccgttcggttaccgttccggtccgtttccgggaacgggtaaccggtaaccggtaacgttcgggtaacccggtacccggttccggtaacgggttacccgaacccggtacccgtaaacggtccccgtccggtccccggttacccgg

SEQ ID NO: 283874 - DNA, 694 bp, Homo sapiens
  misc_feature: GYAE6OF01AXEWY.19.85.H08.1.454.CMB.1.raw
  modified_base (152)..(152): a, c, t, g, unknown or other
  misc_feature (152)..(152): n is a, c, g, or t
  modified_base (508)..(508): a, c, t, g, unknown or other
  misc_feature (508)..(508): n is a, c, g, or t
  modified_base (629)..(629): a, c, t, g, unknown or other
  misc_feature (629)..(629): n is a, c, g, or t
tcagtactctcgtgcacgaccggtgctcgatttagtatcactcagtcagtcgcggggtccaaacagagcttcagcaagcataggtgggaatctgcaccatgccctgggctctgctcctcctcgaccctcctcactcactctgctagtgtacnggtcggtccgaggcgaggactgactcgacgtccctaccggtcgggtcggggtccgggggaccgtcggggaccgacggccgacccacgacgttccgaccgtcggaacccggaacccgggaaaccaacctaacgtaacgtcggaccggaccgaccggacggggctccggtcgttaggctcgaccacgaccgaccgcccggacggtcccaccctaacccaactccgtacggtacggtacgaaggacctacggaaccccgacgtccaataactacttcgaagacgtacttacttaccacaccgtaagaacaactaaacgtcctcgtactaccgtatacgtaacttacgtcgttacgtccncgtaacgcgaggtaccagtgccacgtactacgtcgagtcctcggaccgtaccggcgtaacccgactcgtaccgtcttcggtacgttccgttcgggttacccgtgggaccggaggtacccgngtcccggtacggtcgtccgtacggaccgtaccaccggtaccggcccgttcccgtcccggttaccg

SEQ ID NO: 283875 - DNA, 887 bp, Homo sapiens
  misc_feature: GYAE6OF01AE79R.19.85.H08.1.454.CMB.1.raw
tcagtactctcgtgcacgaccggtgctcgatttagtatcactcagtcagtcgcggggtccaaaacagagcttcagcaagcatagtgggaatctgcaccatgccctgggctctgcctcctcctgaccctcctcactcactctgctagtgtcgagtcggtccgaggcaggtactgactcacgcctaccgtcgggtcggtccgggggcctgggaccgacgggtcccgacgaacgacgtaccaccgtacggaccgaacccgggaaacaccgtaaacgtacggttcggaccggtaccggaacccggacgggtaccgtccggtcgttacgggtcctacggaccgaacggaccccggtaaaccgggccgaacccggggacccccctaaacccccgttaaccccgtaaaccgttcccggttaccggtttaaccggaaccggtaacgggtaaaccgtacccgggaaacccgtaaccccggtaacccttaaacgtaaaccgttaacgtttacggaacggtaaacggttaccgtttaaccgttttacccgtaaaccgtaacgaaacggtaaaccctaaactaaaaccgttaccgaccgttccgttaaccttacctaccgtaaccttacgtttacccgtacggttacctaaccgtacgtacgtacggaaccgggacgttaccggtactaccgttaacccgtagttccgtcgtacccgttacggacccggtttacgaaccggtaaccgacccgaccgttccgtaccgtcgttcggttccggttaggtttacccggtgggaacccggacggtacctacgggttacccgaccggtccgggttaccgtaccgggtaccgacccggtacccggtaccggtaccctccgggttccccctaccggg

SEQ ID NO: 283876 - DNA, 747 bp, Homo sapiens
  misc_feature: GYAE6OF01BRY0H.19.85.H08.1.454.CMB.1.raw
tcagtactctcgtgcacgaccggtgctcgatttagtatcactcagtcagtcgcggggtccaaacagagcttcagcaagcatagtgggaatctgcaccatcgccctgggctctgctcctctgaccctctcactcactctgctagtgtcgaggtcgtccaggtcaggactgactcgacgcctacccgtcgggtcggtccgggggcctagggaccgaggcccgaccacgtacgtccaaccgtcgaccgaacccggaactaaccgaacgtaagtcggtaccggaccgaccgagggccgtaccgtacggttcggcgtacgcgtaacgaccgaccgaccgaccgggaccccaccccgtaacccgaccttcgtcggtaccgtaacggaagtactacggaaccacccggtaccctacaaacgtacttacgagtaacgtacgttactttacaccctacgacggtaaacaacgtaaaactcgacgtaccttacgtaccgtacgtaccgttacgttacgttacggtacctaccgtacgtaccctacgggaccgtacggtaccgtacgtaccgtaacgttacgtaccgtaggtaccctacgtaccggtcgtaacggacctaccgaccgttccgtacgtccgttcgtacggttcggttcccgtacgggtacgggacgtaaccgtcggtccgtacggttccgggtaccgtcgggtacgacccggtacccgtacggttcctccccgggttaccctaccgggg

SEQ ID NO: 283877 - DNA, 782 bp, Homo sapiens
  misc_feature: GYAE6OF01AC3XZ.19.85.H08.1.454.CMB.1.raw
  modified_base (615)..(615): a, c, t, g, unknown or other
  misc_feature (615)..(615): n is a, c, g, or t
tcagtactctcgtgcacgaccggtgctcgatttagtatcactcagtcagtcgcggggtccaaacagagcttcagcaagcatagtgggaatctgcaccatgcccgtggctctgctcctcgtcgaccctcctcactcactctgcagtgtcgaggtcgtccaggcacggactgactcgacgtcccaccggtcgggtacggtccgggggcctgggaccgacggccgccaacgacgttccgacctcggaccggaacccgggaaaccaccctaaacgacgttcgggtaccggaccggaaccggtacgggacgtccggtcgttcggccgtacggaccacggaccgaacccggaccggaccgggtaccccaccccgtaacccgtaaaccgttcctaccggtaccgtaacggacggtaacgtcgaaccgaaccccgccgtaactaacgtacgttacgagacgttattacctttccgaaccgtcgtaaaccgaaccaaacgtaaaccgtacgaccgtacctacggttacctacgtaccttaacggttaccgacggttcccaccgtacgaccccgtaggaaccggaacgtacggtcccgtaacttaccgtaacgtactacccgtanacccgtccggtacgtaccggactaccgacgtccgtacgcgttacgttacgttcgggtaccgtcggaaccgggaccgtaaccgtcgttaaccgtcccggggtaaccgttccgggaacggttacccgacccggttacggacctttccccggaccgggttccctaccggg

SEQ ID NO: 283878 - DNA, 837 bp, Homo sapiens
  misc_feature: GYAE6OF01B2H48.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcacgcccaccgtcggtcggtccgggggccgtggggacacggcccgccacgacgtccacctcggaccgaacccggggaaccaaccaacaacgtcggtccggaccggaccgaggggacgcccgtcgttcggccgtcgccaacggaccgaaacccggccggaaccggggaccccaacccccgtaccccgtaaaacccttcccgttacggtaccggtaaccgaacgggtaactaccggaacccgtaaccccgggtcccctaaccgtaaacctaacgttttaccgaaacggtacggtaacgttaactttttacccgtaaccccttacccggaaacgggtaaaccctaaaaccgtaaaaactaccgtaacccgtacccttaccttaccgttaccggtaacccttaacgtttaccggttcgggttaccttacccggaaccgtacccgttaccggtaaccggaaccggtacggtaccgttaacgtaacctaccgttaccacgtcctaccgtacggaccgtacgggaaccacccgacgtacccgtccgtacgttcggtccgttcgggttccgtttccgggacgggtacgggtaaccgtacggtccgtaccggtcccggtaccgttacgggcccgtaccggtacccgacgggtcccgtcccggtccccggttacccgg

SEQ ID NO: 283879 - DNA, 714 bp, Homo sapiens
  misc_feature: GYAE6OF01BP2TQ.19.85.H08.1.454.CMB.1.raw
  modified_base (384)..(384): a, c, t, g, unknown or other
  misc_feature (384)..(384): n is a, c, g, or t
  modified_base (470)..(470): a, c, t, g, unknown or other
  misc_feature (470)..(470): n is a, c, g, or t
tcagtactctcgtgcacgaccggtgctcgatttagtatcactcagtcagtcgcggggtccaaaacagagcttcagcaagcatagtgggaatctgcaccatgccctgggctctgctcctcctgaccctcctcactcactctgcagtgtcaggtcggtccaggcaggactgactcgacgcccacccgtcgggtcgggtcccgggggccgtgggaccacgggcccgccaacgagtccaacccgtcgacctaccgtaggaaaccaaccctaaagaagtcggtaccggaccggaaccgaggggacgccgtgttcggctggcaggaccgaacggtcccgacgggaccccacccctaacccgtaaactcctggtacccgagaacggtaacncgaaccgaccccggtcctaaactaaacgtcttagaacgtacgtacgtttaactttccgacctaccgaagtaacctaaactaaaacncgaccgtcctactaccgtagtaacccttagttacctacgtcctacgaccgccgtacggtacgacggtacgtaccgtacgtaaccttctacgaccgtctaccgcggtccggtacgaaccctcgtaaccgtccgtactcgtacggttcgttacgggtttcggttccgggaacgggtacggaaccgtagtccggtaccgtaccgtcggttcggaccgaccggaccgtacggcccgttaccgccccgg

SEQ ID NO: 283880 - DNA, 746 bp, Homo sapiens
  misc_feature: GYAE6OF01DP1LE.19.85.H08.1.454.CMB.1.raw
  modified_base (267)..(267): a, c, t, g, unknown or other
  misc_feature (267)..(267): n is a, c, g, or t
  modified_base (377)..(377): a, c, t, g, unknown or other
  misc_feature (377)..(377): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcacgccaccctcgggtcgtccgggggcctggggacacggccgccacagtcacctgcgaccgggtaacaccaacaagtcggtccggacaccgagggacnccggcttggctgcagaccgaacgccgacgggcccaacccctaccctaaaactcctacgtccgtaacgaaggactcgaaccgtaaccgaccctacaaaactcttacgaganacgtactttaccacctacgagaacaactaaatcacgtcctactcacgtacctacgtttacgtcggtccttaaccgacgtcccgtaacggtaccgaacggtacggtactacgtaacccttaacgtaaccgtcggtaaccttccgaacccgggtccgttaaccgggaaccctaaccggtaccggtcccgttcggtaccgttccggtttccgggtttacgggttcccggtttttaccggggacccggggtaacgggtaacccgtaaccgggtcgttaccgggtaacccccgttccggggtaacggggttacccgtaacccggtaaccccggtaaccgggtcccggtccccgggttccccccggttaacccgg

SEQ ID NO: 283881 - DNA, 407 bp, Homo sapiens
  misc_feature: GYAE6OF01B91T8.19.85.H08.1.454.CMB.1.raw
  modified_base (276)..(276): a, c, t, g, unknown or other
  misc_feature (276)..(276): n is a, c, g, or t
  modified_base (386)..(386): a, c, t, g, unknown or other
  misc_feature (386)..(386): n is a, c, g, or t
  modified_base (392)..(407): a, c, t, g, unknown or other
  misc_feature (392)..(407): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagaggaggggggcactggctgggtcgggtcgattcttttgatttgtggggaccaaggatcaagcgtctccgtctcttcagcctccaccagggcccatccggtcctcccctggcaccctcctaccaagcncaccgtcgtcggggcacgaggccggccctgggctcggccgtggtacgaacggaccttaccttaccccgacggaggtacgtaactggaggcgggactggacgaaggccganagtagnnnnnnnnnnnnnnnn

SEQ ID NO: 283882 - DNA, 721 bp, Homo sapiens
  misc_feature: GYAE6OF01DOMB8.19.85.H08.1.454.CMB.1.raw
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
tcagtactctcgtgcacgaccggtgctcgatttagtatcactcagtcagtcgcgggtccaaacagagcttcagcaagcatagtggaatctgcaccatgcctggctctgctcctcctgaccctctcactcactctgctagtgtcagtgccaggcaggactgactcagtccaccctggtcggtccggggctgggacnggcccaccactacgtcaaccgtgaccgaaccggaacaccaaacgtaagtcggccggacgaaccgagggacgccgtnttcggcctgacgagaccgaacgcccgacgggtaccccaaccctcccgtaaaactccgtcgtacgaacgagactacgaacgaccgacctacgaaactgttcaaggagtactaacttttaccgactaccgtaagaaccaaactaaaacgtccgaactaccttacttacgaacgtacctaacgttttaccgacggttccttaaccccgacgtaccggttaacggaaaccgggtaacgaccgggtaacgttacgtaaaccttaccggttaacaaccgggttcctaagaccgttccgggtaaacgggaccctaaaccggtacccgtacccgttacgtaccgttacggttccggtttcgggtaacccgttttcggggaccgggaacggttaccgaacgtaccgttcgaaccgtcgttacggacgtacgtaccggacgtacgcccgtccggtacccg

SEQ ID NO: 283883 - DNA, 783 bp, Homo sapiens
  misc_feature: GYAE6OF01AJ0EG.19.85.H08.1.454.CMB.1.raw
  modified_base (608)..(608): a, c, t, g, unknown or other
  misc_feature (608)..(608): n is a, c, g, or t
tcagtactctcgtgcacgaccggtgctcgatttagtatcactcagtcagtcgcgggggtccaaaacagagcttcagcaagcatagtgggaatctgcaccatcgccctgggctctgctccctcctcgaccctcctcacctcacctctgcagtgtcgtacggtcggtccaggacgaggactcgactcacgccctacccggtcgggtcgggtcccggggtcgtcgggaccgacgggcccgaccactcgtccaccgtcgaccggaaccggaaccaccaacgacgtcggtaccggacggaccgaagggccgccgtacgttcggctacgccgacgacgaaccggaccggaccggacccctaaccccgtaacccaaccttccgtcgtacgtaacgacggtaacgaccgaacccgaaccccggtccctaaacgaaccttacgttaacgaacgtaacgtaacgtttaccttttaacccgtaacccgtacgtaaccgaaacctaaactaaaaccgtaccgaccggttacccttacgtaccgttacccgaaccttaaccgttcgttacgtccctaccgacggtccgtaacggaccggaccgacggtctacaacgttacncgtaccgctacgacggtccgtacgggaccctacggcgtacccgtccgtacgttccgttcggttacggtttcccggtgggaacccgggtacgtaccgtccgggtaccgttaccggtccggttacgtaccggccggtaaccggccgtaccgggtcccctcccgggtcccgtacccgg

SEQ ID NO: 283884 - DNA, 877 bp, Homo sapiens
  misc_feature: GYAE6OF01AR86M.19.85.H08.1.454.CMB.1.raw
tcagtactctcgtgcacgaccggtgctcgatttagtatcactcagtcagtcgcggggtccaaacagagcttcagcaagcatagtgggaatctgcaccatcgcccgtgggcctctcgcctccctacctcgaccccttcctcactccacttctcgccgtagttgtaccgtaggtcggtaccgacgggcagggtactggaaccgtccaaccggccccgtcccgtcgggttccggggtcccgggggtccgtaggggaccgtacgggccccgaccacgtacgtcccgtaccgtccggacccggaaacccgggaaaccaacccgtaaacaacggttcggtacccgggaccggaaccggaacgggaccggacccggtccgttcggaccgtcgaccgaacggaccgaaccggcccggaaccggacccccaacccccttaacccgtaaccctccgttaccggtaccgtaaccggaacggtaacctaaccggaaccccggtaacccggtaccccgtaaacttaaaaccgttcgtttaaccgaggtaaaccggttacctttacccgtttttaacccacccgttacccgaaacggtaaaccaaacctaaaacgtaccgtacgttcccctaccgtaccgtaacctaaccttaccgtttacgtaccgttacccgtaccgaccgttacgacggtacgaccgtcggtacctagaccttctacgtcgtactcgacgtccaggaccacgtaccgtcgccgtcgttacggtcgttccgggttacgtccgggaacgggtaccgtaccgtaacggttcccgtaccgggttacccgtaccgggtcggtaaccgtacccggtacggaccccggttcgttcccccccgggttccgtccccg

SEQ ID NO: 283885 - DNA, 823 bp, Homo sapiens
  misc_feature: GYAE6OF01BTTS6.19.85.H08.1.454.CMB.1.raw
tcagtactctcgtgcacgaccggtgctcgatttagtatcactcagtcagtcgcggggtccaaacagagcttcagcaagcataggtgggaatctgcaccatcgcccgtgggctctgcctcctcctcgaccctcctcactcactcgtcgctagtcgtcgtaggtcggtccgaggacacggactgactcaccgccacccggttcgggtcgggtaccgggggcctacggggacgcgggcccaccgacgccgtacgaccgtacgcccggaaccgggaaccaaccgaacgaagcggtcggaccgacggaacgggcgccgtcgttggctcgacgacgtaccgaaccgccggaccggtaccccgaacccctaacccgaaccgtcccttaggtaccgtaacgaacggaactacccggaacccgtaaccccggtaccctaaactaaacgttacgttacggaacgtaaggtaacgtttaccgtttacccaccgtaaacgtaacggtaaaccaaaactaaaccgttaaccgaccgttaccttaccgtacgtaccctaaaccgtttaacgttacccgttacgtcctaccgtaacggtaccgtaccgggaaccggtaacggaccgttcgtaccggttaaacctacgttaccgtcgttaacgtccctaacgggtcccggaccgacccgttaaccgcccggttacgtccgttccggttcggttaccgttccgggttaccggttaccggggaaccggtacggaaccgtaccggtccgtaccgggtacccgttcggacggtacccgacggcccgtacggcccgtcccggtcccgttacccg

SEQ ID NO: 283886 - DNA, 752 bp, Homo sapiens
  misc_feature: GYAE6OF01BQNZ6.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcacgccacccgtcgggtcggtcccgggggccgtgggaccacggcccgccacgacgtccaccgtcggaccgaacccggaacaccaacgtacgtcggtcggcgaccggaggacgccgtcgttcggcgtcgcgacgaccgaaccgccggaccggaccctaccccgtaccgaaccgtccgttacgtaccgtaacgaacggtaacgtaccgaacccgaacccggtacctaactaaacgtacgtttacgaggtaacgttaacgttactttacccgtaacccgtaccgtaaacgaacctaaacgaaacgtaccgtacgtccttacgtacctacgtaaccttacgttaccgttacgtccaaccgtcgtaccgtaacggacgaacggtacgtaccgtaccgtaccgttaccgtctaccgtaccgtacgaccgtacgtaccggacccgtaccgtaccgtccgtcgttactcggttccggttaccggttccggttccgggaacgggtaacccggtaccgtacggtacccgtccggttccgtccggttaccggtaccgacccgttaccggaccgtccgtacccgtcccgttaccg

SEQ ID NO: 283887 - DNA, 366 bp, Homo sapiens
  misc_feature: GYAE6OF02ISWQE.19.85.H08.1.454.CMB.1.raw
  modified_base (359)..(366): a, c, t, g, unknown or other
  misc_feature (359)..(366): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcgttcagcctccaccaagggcccatcggtcttccccctggccaccctcctccaagagcacctctgggggcacagcggcctgggctgcctggtcaaggctacttcccacgagagtactgagcgggctggcaaggcggcatagnnnnnnnn

SEQ ID NO: 283888 - DNA, 360 bp, Homo sapiens
  misc_feature: GYAE6OF02I0ZXA.19.85.H08.1.454.CMB.1.raw
  modified_base (356)..(360): a, c, t, g, unknown or other
  misc_feature (356)..(360): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagaggggggcactggctggtcgggtcgatcttttgatttgtgggccaaggatcaagcgtctccgtctcttcagcctccaccaagggcccatcggtcttccccctggccaccctcctccaagagcacctctgggggcacagcggccctgggctgcctggtcaaggctacttcccacgagagtactgagcgggctggcaaggcgcatagnnnnn

SEQ ID NO: 283889 - DNA, 515 bp, Homo sapiens
  misc_feature: GYAE6OF02JEIU8.19.85.H08.1.454.CMB.1.raw
tcagtactctcgtgcacgaccggtgctcgatttagtatcactcagtcagtcgcggggtccgaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacacccaacaatgtcggcgaccagggagccgcttggcctgcagcaacgccagggccacccgtccaaactcctgtcgtacaggaatgacaaccggccctcaaacatttcagagagattttcacctcaggacacaaaatacagcctctctgacccattactggtctccagcctgacgacgacgctgactactactcgctcagcctgggaccaccgagcctcgctgcttggctttcggcggaggaccaaggcctgaccgtctgggtcacgcccgaggcctgccccctcgg

SEQ ID NO: 283890 - DNA, 510 bp, Homo sapiens
  misc_feature: GYAE6OF02HM54O.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactccctgtccgtacaggaactgacaaccggccctcaaacattcagagagatttcacctccagacacaaaatacagcctctctgaccattactggtctccagcctgacgacgaggctgactactactgctcagcctggacaccacgcctcgctcgcttgctttcggcgaggaccaagcctgaccgtccgtcggtcacgccgacggctcgcccctccgg

SEQ ID NO: 283891 - DNA, 549 bp, Homo sapiens
  misc_feature: GYAE6OF02I6OYV.19.85.H08.1.454.CMB.1.raw
  modified_base (423)..(423): a, c, t, g, unknown or other
  misc_feature (423)..(423): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacattcagagagattttcacctccagacacaaaatcagcctctctagacctattactggtctccagcctgacgacgaggctagactactactgcctnacgcctagggaccaccgacgcctcgcctgcctttgggccttttcgggcggtacgggacccaaggtcctcggtacccgtccgtggggtccacggccccgaagggtccctaccggcccccgttccggg

SEQ ID NO: 283892 - DNA, 579 bp, Homo sapiens
  misc_feature: GYAE6OF02HLC0Q.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtcggtccgggggcctgggacagggccgccacagtccacctgcaccgggaacaccaacaatgtcggcgaccgagggagccgcttggctgcagcaacgccacgggccaccctacccaaacctcctcgtccgtacaggaatcgaaccaacccggccctacaaacgtacttacagaagagtattttccaccttccaggacaactaaaataccagccctactctacgacctacttacttggtcctccacgcctagacgacggacgctagactactacgtgctcacgccgtggaccaccgacgccgtcgcctgtcgttcgtccgtttcgggcggacggaccgtaggcctcggtaccgttccgtgggtccacggtacccgacggtcctccggccccgttccgg

SEQ ID NO: 283893 - DNA, 537 bp, Homo sapiens
  misc_feature: GYAE6OF02ISAKR.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgcacagtcacctgcaccgggaacaccaacaatgtcgcgaccagggagccgcttggctgcagcaacgccagggccaccctcccaaactcctgtcgtacaggaatgacaaccggcctacaaacattcagagagattttcacctcagacacaaaatacagcctctctgaccattactgtctccagcctgacgacgagctgactactactgctcacgcctgggaccaccgacgcctcgctcgcttggtccttttcgggcggtacggaccgaaggtcctacggacccgttccgtgggtaccacggtcccgtaacggaccgtccggcccccgtccggg

SEQ ID NO: 283894 - DNA, 363 bp, Homo sapiens
  misc_feature: GYAE6OF02FOZEK.19.85.H08.1.454.CMB.1.raw
  modified_base (358)..(363): a, c, t, g, unknown or other
  misc_feature (358)..(363): n is a, c, g, or t
tcagtactctcgtgcacgaccggtgctcgatttagtatcactcagtcgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnn

SEQ ID NO: 283895 - DNA, 510 bp, Homo sapiens
  misc_feature: GYAE6OF02GRF7C.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacattcagagagattttctacctccaggacacaaaatacagcctctctgaccattactggtctccagcctgacgacgaggctgactactactgctcagcctgggacaccgagcctcgctgtcttgctttcggcggaggaccaagctgaccgtcgtcggtcacggcccgaggctcgcccctccgg

SEQ ID NO: 283896 - DNA, 559 bp, Homo sapiens
  misc_feature: GYAE6OF02HRFY9.19.85.H08.1.454.CMB.1.raw
  modified_base (328)..(328): a, c, t, g, unknown or other
  misc_feature (328)..(328): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccaggccaccctcccaaactcctgtcgtacaggaatgacaaccggccctcaaacntttacagagagtattttccacctccaaggacaacaaaatacaacgcctctactgaaccattactggtctccacgctgacgacgacggctgactactactcgctcacgcctagggacaccgacgcctcgctcgcttcggtcttttcgggcggtaggacccgaaggtcctacggacccgttccgtacggggtccgacggtccccgaagggccgttccggcccccgttaccggg

SEQ ID NO: 283897 - DNA, 407 bp, Homo sapiens
  misc_feature: GYAE6OF02IOKVH.19.85.H08.1.454.CMB.1.raw
  modified_base (202)..(202): a, c, t, g, unknown or other
  misc_feature (202)..(202): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
  modified_base (329)..(329): a, c, t, g, unknown or other
  misc_feature (329)..(329): n is a, c, g, or t
  modified_base (364)..(399): a, c, t, g, unknown or other
  misc_feature (364)..(399): n is a, c, g, or t
  modified_base (401)..(407): a, c, t, g, unknown or other
  misc_feature (401)..(407): n is a, c, g, or t
tcagtactctcgtgcacgaccggtgctcgatttagtatcactcaggtcgcggggccggtttacccatctccagagacaatgccaagaagacgctctttctgcaattggacggcctgagagtcgaagacacggctatttattactgtgtgagagaggggggcactggctggtcgggtcgatcttttgatttgtgggccaaggntcaagcgtctccgtctcttcagcctccaccaggcccatcggtcttcccctgccaccctccncaagancacctctgggggcacagcggccctggggctcgcctggtcaaggacctacttcccacgagngtactgagcgggctggcaaggcgcattacgacgannnnnnnnnnnnnnnnnnnnnnnnnnnnnnnnnnnngnnnnnnn

SEQ ID NO: 283898 - DNA, 565 bp, Homo sapiens
  misc_feature: GYAE6OF02IAS34.19.85.H08.1.454.CMB.1.raw
  modified_base (296)..(296): a, c, t, g, unknown or other
  misc_feature (296)..(296): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggctgggacaggccgccacagtcacctgcacctggaacaccaacaatgtcggcgaccagggagccgcttggctgcagcaacgccaggcccaaccctccaaactccngtcgtacaggaatgacaaccggccctcaaacatttcagagagtactttctacctcaggaacacaaaatacacgtacctctctagacctatttactcggtcctccagtcctgaccgacgacggctacgtactactactgctacagccgtagggaccaccgacgtccctacgtcctgtccttcggtcctttcgggacggtacgggacctaacggccgtcggtacccggtccgtcgggtaccacggacccgaagggtccctcgtccccccgg

SEQ ID NO: 283899 - DNA, 562 bp, Homo sapiens
  misc_feature: GYAE6OF02GMJ4S.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtccgtacaggaatcgaccaaccggccctacaaacattcacgagagtattttcacctcctaacggacaacaaaaatcaacgcctactctagaacctattacctggtcctacctacgccctagaccgaacggacggctacggacctacgtacgtgcctcacgccgtcgggaccacccgagcccgtcgctcgcttcggtctttccggcggacggaccgaacgctcggaccgtccgtggtcacgacccgaggccgtcgccccgtcgg

SEQ ID NO: 283900 - DNA, 517 bp, Homo sapiens
  misc_feature: GYAE6OF02HKWEM.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttcacctccaggacacaaaatacagcctctctgaccattactggtctccagcctgacgacgaggctgactactactgctcacgcctgggaccaccgacgccctcgctcgcttggctttcggcggtaggaccgaagctcggaccgtccgtggtcacgcccaaggctcgcccctcgg

SEQ ID NO: 283901 - DNA, 546 bp, Homo sapiens
  misc_feature: GYAE6OF02HJ8K7.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggaccggccgccacagtcacctgcaccgggaacaccaacaatgtcggcgaccagggagccgcttggctgcagcaacgccagggcccaccctcccaaactcctgtcgtacaggaatgacaaccggccctacaaacatttcagagagatttcacctccaggacacaaatacagcctctctgacctatactggtctccagcctgacgacgaggctgactactactcgctcacgcctgggaccaccgacgcctcgctcgtcgttcggcgttttcggcggtacggaccgacggtcgtcggacccgtccgttcgggtccgtacggcccgaggccgtccggtccccgtcggtacccg

SEQ ID NO: 283902 - DNA, 557 bp, Homo sapiens
  misc_feature: GYAE6OF02FKI8D.19.85.H08.1.454.CMB.1.raw
  modified_base (332)..(332): a, c, t, g, unknown or other
  misc_feature (332)..(332): n is a, c, g, or t
tcagtactctcgtgcacgaccggtgctcgatttagtatcactcagtcagtcgcggggtccaaacagagcttcagcaagcatagtgggaatctgcaccatgccctggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggcccaccctcccaaactcctgtcgtacaggaatgaccaaccggccctacaaactntttcagagagtacttttctacccttcaggtacaacaaaatacacgcctctcagaccctattactcgtctcacgacctgacgacgaggctgactactactgctcagcctcggacaccacgcctcgctcgtcttcgtcgttttccggcgggtacgggaccgaacgccgtacggacccgttccgtcgggtacctacggcccgtaaggcctaccggcccccgttcccgg

SEQ ID NO: 283903 - DNA, 581 bp, Homo sapiens
  misc_feature: GYAE6OF02GY8GM.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggacgccgcttggctgcagcaacgccagggcccaccctcccaaactcctgtcgtacaggaatcgaaccaacccggcctacaaacatttcagagagtacttttcacctccagacaacaaaatacacgcctctctacgacctattactcggtcctccacgtcctagacgacgacgctacgactactactgctcacgccgtgggaccaccgacgtcctcgctcgtcgttggtccgtttcgggcggtacgggtaccgaacggtccgtacggtacccgttccggtacgggtacgaccggtacccgtaacgggtccgttaccggtccccgtaccggg

SEQ ID NO: 283904 - DNA, 600 bp, Homo sapiens
  misc_feature: GYAE6OF02JETCT.19.85.H08.1.454.CMB.1.raw
  modified_base (471)..(471): a, c, t, g, unknown or other
  misc_feature (471)..(471): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccggggcctgggacaggccgccacacgtcacctgccgaccgggaacaccaacaatgtccggcgaccgagggacgccgcttggctgcagcaacgccgacgggcccacccgtacccaaacctcctcgtccgtacaggaactcgaaccgaacccggccctacaaacctactttacgaagacgagtacttttctacccttccaggaacaacaaaactacaacgtcctctactcgacctattacctgtcctaccacgtcctacgacgtacgacgtctacgactactacgtcnctacacgtccgtcggtaccaccgacgcctcgtctgtaccttcgtccgtttcggcggtacggacctaacggctacggtaccgtccgtcgggtactacggacccgtaacggcctcccggtacccgttccgg

SEQ ID NO: 283905 - DNA, 569 bp, Homo sapiens
  misc_feature: GYAE6OF02HK3NA.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtccacctgcaccgggaacaccaacaatgtcggcgaccagggagccgcttggctgcagcaacgccagggccacccctcccaaactcctgtcgtacaggaactgacaacccggcctacaaactattcagagatacttttctacctacaggaacacaaaatacacgcctctacctgaccctattactggtcctaccagtccctagacgacgacggtctagacttactactcgtctcacgcctcgggaccaccgacgcctcgctcgtcgttcggtccgtttcgggcggtacgggaccgtaacggcctacggtacccgttccgtcgggtcacggacccgtaggccgtccgcccccgttccgg

SEQ ID NO: 283906 - DNA, 571 bp, Homo sapiens
  misc_feature: GYAE6OF02JF2M7.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctggggacaggccgccacagtcacctgcaccgggaacaccaacaatgtcggcgaccagggacgccgcttggctgcagcaacgccagggccaccctcccaaactcctgtccgtacaggaatgaccaaccggccctcaaacatttcagagagattttctacctcaggacaacaaaactacagccctactctcgaccattactggtctccagtcctgacgacgacggctgactactactgctcacgccgtcgggaccaccgacgccctcgccttgcctttgggtccgttttccgggcggtacgggacccgtaaggtccgtcggacccgttccgtacgggtaccacggccccgaacggccgtcccggtcccccgttaccggg

SEQ ID NO: 283907 - DNA, 548 bp, Homo sapiens
  misc_feature: GYAE6OF02FTMO0.19.85.H08.1.454.CMB.1.raw
  modified_base (434)..(434): a, c, t, g, unknown or other
  misc_feature (434)..(434): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtcggtccgggggcctgggacagggccgccacagtcacctgccgaccgggaacaccaacaatgtcggcgaccagggagccgcttggctgcagcaacgccgacgggccacccctcccaaactcctgtccgtacaggaatgaccaaccggccctacaaactattcagagagtattttcacctccaggaacaacaaaatacacgcctctctagaccattactgtctccagcctgacgacgagctgactactactcnctcacgcctcgggacaccgacgcctcgctcgtcgttgtccgttttcggcggacgggaccgagctcggaccgtccgtgggtccacggcccgaaggtcctccggccccgtacccgg

SEQ ID NO: 283908 - DNA, 520 bp, Homo sapiens
  misc_feature: GYAE6OF02HDG0G.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaacattcagagagtatttcacctccaggacaacaaaatacacgcctctctagaccattactggtctccacgcctgacgacgagctagactactactgctcacgcctggacaccacgcctcgctgcttggtcgtttcggcggacggaccgagctcgaccgtccgtggtccacgcccgaggccgtcgccccgtcgg

SEQ ID NO: 283909 - DNA, 589 bp, Homo sapiens
  misc_feature: GYAE6OF02ITSTH.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtggtcccgggggcctgggacaggccgccacagtcacctgcaccgggaacaccaacaatgtcggcgaccgaggacgccgcttggctgcagcaacgccagggccaccctcccaactcctgtcgtacaggaactgaccaacccggcctacaaactacttcagagagtactttctacctaccaggacaacaaaatacacgcctactctacgacctacttacgtcgtctccagcctgacgacgacgctagactactactcgctcacgccgtacgggaccaccgacgccgtcgccgtgtaccgtttcggtccgttttccgggcgggtacgggtaccgaaggtcctacggtacccgtccggttgggtaccgacggtaccccggtaacgggccttcccggtcccccgtacccgg

SEQ ID NO: 283910 - DNA, 375 bp, Homo sapiens
  misc_feature: GYAE6OF02G62OV.19.85.H08.1.454.CMB.1.raw
  modified_base (364)..(375): a, c, t, g, unknown or other
  misc_feature (364)..(375): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagaggaggggggcactggctggtcgggtcgatcttttgatttgtggggccaaggatcaagcgtctccgtctcttcagccctccaccaagggcccatcggtccttccccctggccaccctcctccaagacgcacctctgggggcacagcggccctgggctgcctggtcaaggactaccttcccacgagacgtactgagcgggctggcaaggcgcatagnnnnnnnnnnnn

SEQ ID NO: 283911 - DNA, 590 bp, Homo sapiens
  misc_feature: GYAE6OF02HS1UA.19.85.H08.1.454.CMB.1.raw
  modified_base (252)..(252): a, c, t, g, unknown or other
  misc_feature (252)..(252): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacctcggtgtccgggggcctgggacaggccgccacagtcacctgcaccgggaacaccaacaatgtcggcgaccagggngaccgcttggctgcagcaacgccagggccaccctccaaactcctgtctacaggatgacaccggcctcaaacatttccagagagtattttctaacctccagaacaacaaaatacaagccctactctagaccattacctggtactacacgtctacgaccgacgaggcttagaaccttactacgtcgtctcacgtcgtacgggaccaccgaacggtccctacggtctcggtcgttacggtccgtttttcggacgggtaacgggacccaaaggtcccgtaggtacccggtacccgtgggtcccgtacggacccgtaacggcgtacccgcccccgttaccggg

SEQ ID NO: 283912 - DNA, 349 bp, Homo sapiens
  misc_feature: GYAE6OF02ITI2Y.19.85.H08.1.454.CMB.1.raw
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (338)..(349): a, c, t, g, unknown or other
  misc_feature (338)..(349): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagagaggggggcactggctggtcgggtcgatcttttgatttgtggggccaaggatcaagcgtctccgtctcttcagcctcaccaaggcccatcgtctccccngcacctcnccagngcacntggggcacagcgcctggctgcctggcaaggctactcccagagagtctgagcgggctggcaaggcgcaatagnnnnnnnnnnnn

SEQ ID NO: 283913 - DNA, 608 bp, Homo sapiens
  misc_feature: GYAE6OF02HW3V4.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtccacctgcaccgggaacaccaacaatgtcggcgaccgagggagccgcttggctgcagcaacgccagggccaccctccaaactcctgtccgtacaggaatgaccaaccggccctacaaacattacagagagttactttctacctcgagaacaaactaaatacacactctgtacactatacgtgtcctacacgtctacgacgacgacggtctacgtaactactacgtctctacgaccgtcggacggaaccaccgacgtccgtacgtcgtcggtcgttcggtttccggtttaccgggacgggtaaccgggtaaccgaacggtcccggtacggtacccggttccggtacgggtcacccggaaccggtaacggtcccgtaccccggtccccggttaccgg

SEQ ID NO: 283914 - DNA, 969 bp, Homo sapiens
  misc_feature: GYAE6OF02HO8KM.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtcggtccgggggcctggggaccacgggcccgccgaacgacggttccaacccgttggaccgaacccggggaaaccaacccgaaacaaacgttcggtaccgggaccgaacccgaagggggacgtcccggtacgtttcgggccttaggaccgaaggacccgaaaccggccccggaaacggggcccctaaccccccgtacccccgtaaaaaccgtccccgttacggtacccggttaaccgaaacggggtaaacttaccgggaaacccgaaaccccggggtacccccttaacctaaaaaacccgtacgtttttaaccgaaaggtaacgtaaacggttaactttttttacccgtaaaccccgttaccgaaacgggtaaacctaaaaccgtaaaaaacttaaccgaaaccggttccccttaccgttaccgtaaccgtaaaccccgttaacgtttaacccgttacgggttaccccttacccgtaaccggtacccgtacgggtaacccggaaccggtaaccgggtacccgttacggtaaaccctttaaccgttaacccgttaccggtaccttaccggtaaccgttacccggtaccggggaaccctaccccggtaacgtccccgttaacccggtccgttacggttcccggtttaccgggttccgttttaccgggaccggggtaaccgggtaacccggtaacggtaccggttaccggtacccggttcccggttacggggtcctaacccgggtacccggtaaccgggtcccgttacccggtacccccccgttacccggg

SEQ ID NO: 283915 - DNA, 567 bp, Homo sapiens
  misc_feature: GYAE6OF02FLHZ0.19.85.H08.1.454.CMB.1.raw
  modified_base (447)..(447): a, c, t, g, unknown or other
  misc_feature (447)..(447): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgccaccgggaacaccgaacaatgtccggcgaccagggacgccgcttggctgcagcaacgccagggcccaccctcccaaactcctgtccgtacaggaatacgacaacccggccctacaaactatttccaagagacgtattttcctacctaccaggacaacaaaatacagcctctactcgacctacttacgtcgtctccacgctcgacgtacgagctgtactactacgtcnctcacgccgtacggaccaccacgcctcgcctgtcgttcggtctttacgggcggacggaccgacgtctcggtacccgtcggtcggtccgacgacccgaacggccgtccggccccgttccgg

SEQ ID NO: 283916 - DNA, 644 bp, Homo sapiens
  misc_feature: GYAE6OF02IDQYI.19.85.H08.1.454.CMB.1.raw
  modified_base (140)..(140): a, c, t, g, unknown or other
  misc_feature (140)..(140): n is a, c, g, or t
  modified_base (211)..(211): a, c, t, g, unknown or other
  misc_feature (211)..(211): n is a, c, g, or t
  modified_base (240)..(240): a, c, t, g, unknown or other
  misc_feature (240)..(240): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctncagtgtcagtgtccaggcaggactgactcagccacctcggtcggtccggggcctgggacacggccgccacngtaccacctgaccgaccgggaacaccaanaacgtgtaccggcgtaaccgagggacgccgcttaggcgtgacagcaaccgccagggacccaccctaccgaaactccgtcgtcgtaccaggaatcggaccaacccggtccacaactattccgagaacgagtattttaccacccttacgaacggaaccaactaaaacgtacacgtacctctacacgtaacctacttacgtcgtcctacgacgtcgtacgacggaacgtacggctagtacttactacacgtctacgaccggtctaacggtaccaccgacgtccgtacgacgtcgtacgttcgggttaccgtttacgggcggaaccggtaccgaaccggtctaccggtacccggtccggtacggtaccgacggtacccggaaccgtccgtacccgtccccggtaccgg

SEQ ID NO: 283917 - DNA, 839 bp, Homo sapiens
  misc_feature: GYAE6OF02IYAYH.19.85.H08.1.454.CMB.1.raw
tcagtactctcgtgcacgaccggtgctcgatttagtatcactcagtcagtcgcggggtccaaacagagcttcagcaagcatagtgggaatctgcaccatgcctggctctgctcctcctgaccctctcactcactctgcagtgtcagtggtccaggcaggactgactcagccacctcggtcgtccgggggcctagggacacgggcccgccaacacggttccacctggaccgaaccggggaaacaccgaaactaagtcggtaccggaccggaacccgagggggaacgcccggcgtttcgggccgttacggcccgaaggtaccgaaaaccggccccgaaacgggggtcccccaaaccccgttacccccaaaaaccggttccccttacggttacccggttaaaccaaacggggaaacgttccggtaaaaccgtaaacccccggggacccccttaacctaaaaaaaccgtcgtttttaaccgaaaggtaaacggtaacggttaacgttttttttaaccaacccgtttacccgtaaacgggaacctaaaacgtaaaaaactttaaccgaaccggtacccgttaccgttaccttacgaacccttaaacgtttaacccgttcggtacccttaccgacgtcccgttagaaccggtacgtaacggcttacggaacttactacgtcgtactcaacgccgtacgggaccaccgacgtcccgtcgtctcgtcgtttacggtcgttttacccgggacgggtaacggtacccgtaaggtccgtaccggtaacccggttccggtacggttcccgaacggacccgtaacgggtccttacccggtccccttcccggg

SEQ ID NO: 283918 - DNA, 465 bp, Homo sapiens
  misc_feature: GYAE6OF02I9B7X.19.85.H08.1.454.CMB.1.raw
  modified_base (425)..(465): a, c, t, g, unknown or other
  misc_feature (425)..(465): n is a, c, g, or t
tcagtactctcgtgcacgaccggtgctcgatttagtatcactcagtgcggtgccggtttaccatctccagagacaatgccaagaagacgctctttctgcaattggacggcctgagagtcgaagacacggctatttattactgtgtgagaggagggggggcactggctggtcgggtcgatcttttgatttgtggggccaaggatcaagcgtctccgtctcttcagcctccaccaacggcccatcggtccttccccctggccaccctcctaccaagacgccaccctcggtgggggccaacgacggccgggccccgtggggcctcggcccgttgggtaccaaagggtacccttaccgtttccccgaacggaacggtacgtacctgggacggtccggggctcgggaccaaacgggcggaacactaaggnnnnnnnnnnnnnnnnnnnnnnnnnnnnnnnnnnnnnnnnn

SEQ ID NO: 283919 - DNA, 742 bp, Homo sapiens
  misc_feature: GYAE6OF02G6D5A.19.85.H08.1.454.CMB.1.raw
  modified_base (269)..(269): a, c, t, g, unknown or other
  misc_feature (269)..(269): n is a, c, g, or t
tcagtactctcgtgcacgaccggtgctcgatttagtatcactcagtcagtcgcggggtccaaacagagcttcagcaagcatagtgggaatctgcaccatgccctggctctgctcctcctgaccctctcactcactctgcagtgtcagtggtccaggcacggactgactcacgccaccgtcggtcggtccggggcctgggacacggcccgcacagtccacctgaccgaccggaacaccaacgaatcgtcggaccgaccgagggagccgtnttcgggctcgacgagaccgaaccggccgaacgggcccctaaccccgtcccctaaaaccgttcccgtacggtaccgtaaccgacggaacgtacggaaaccccgaacccgggtacccctaccgtaaaaccaacgttttacgaacgtaacgtaacgttacctttttacctacccgtaccgtaacgggaaccctaaactaaaaccggtaccacggtaccctacgttaccgacgtaaccctagtttaccgttcggtacctaccgaccgtccgttacggaccgtaaccggaggtacctacggtaacttaccgttactcgtacctacgacggttccgtaacgggtacccaaccgtaccgccctacgtccgtcggtctttcggtccgttttaccgggacgggtacggaccgacgtccgtaccgtaccgttcccggtgtaccaccggtacccgacggtcccgtcccggacccgttaccccgg

SEQ ID NO: 283920 - DNA, 413 bp, Homo sapiens
  misc_feature: GYAE6OF02H4FKR.19.85.H08.1.454.CMB.1.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (290)..(290): a, c, t, g, unknown or other
  misc_feature (290)..(290): n is a, c, g, or t
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (384)..(413): a, c, t, g, unknown or other
  misc_feature (384)..(413): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctattttattactgtgtgagagaggggggcactggctggtcgggtcgatcttttgatttgtggggccaaggatcaagcgtctccgtctcttcagcctccaccgaagggcccatccggtcttcaccctgccacctccncaagngccacctcgtggggcacgngcggcacgtgggctcgccgtggtacaacggtcctacttcccgaacgagtacgtacnggcggcggcgtaggcaaagggccncaagtagctncgannnnnnnnnnnnnnnnnnnnnnnnnnnnnn

SEQ ID NO: 283921 - DNA, 595 bp, Homo sapiens
  misc_feature: GYAE6OF02HX3A5.19.85.H08.1.454.CMB.1.raw
  modified_base (424)..(424): a, c, t, g, unknown or other
  misc_feature (424)..(424): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctctcactcactctgcagtgtcagtggtccaggcaggactgactcagccacctcggtgtccggggcctgggacaggccgccacagtcacctgcaccgggaacacaacaatgtcggcgaccagggcgccgcttggctgcagcgaacgccagggacccaccctacccaaaccgtcctcgtaccgtaacgacggaactacgaccaacccggcctacgaaactactttcagagagtacttttcacctcaggaacaacaaatacgacgacctctactacgtacctattacgtcggtactccgacncgtgacgacgacgctacgactactactcgactccgacgtccgtagggaccaccgtacgcccgtcgcttcgcgtttcgggtccgtttcgggacggtacggaccgtaggtccgtacggtaccgtccgtcggtaccgccggacccgacgggtcccttaccggccccgttaccgg

SEQ ID NO: 283922 - DNA, 833 bp, Homo sapiens
  misc_feature: GYAE6OF02GTQZQ.19.85.H08.1.454.CMB.1.raw
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
tcagtactctcgtgcacgaccggtgctcgatttagtatcactcagtcagtcgcggggtccaaacagagcttcagcaagcatagtagggaatctgcaccatcgccgtgggctctgctcctcctcgaccctcctcactcactctgacgngtgtcnggtcggtaccgaggcgaggactgactcgacgcccacccgtcggtcgggtccggggtccgtacgggacgacggcccgaccgacgacgtccgaccgcgaccggaaccgggaaccaacccgaaacgtaacgttcggaccgggaccgaaccggagggaccggtccggtcgttcggcgtcgacgacgaccgaaccggcccggaaccggaccccaccccgtaacccctaaaccgtccgttaccgtaccgtaaccggaaagtacgtacgaacccgaacccggtaccctaactaacgtagttacgaagaacgtagttactttacctacctaccgaacgaacaaactaaactacgactccttacgtctaacgtactaacgttacgttcgtaccttcccgacgtaccgtacgaaccggtaacgacggtacgtaaccgttacttaaccgtacgtaccgtacgtacggtaccgttaccggaccgggtaaacccaccgtaaccgtcccggtaccgtccgtaccggttccggtttaccggtttaccgggtttaccggggaccgggtaaccgggtaacccggttaaccggtacccgttaccgggttaccccgggttacccggtacgggttaacccgttacccggaacccgggtaacccggtccccgggtaccccggttcccccgttaaccccggg

SEQ ID NO: 283923 - DNA, 704 bp, Homo sapiens
  misc_feature: GYAE6OF02JKPUK.19.85.H08.1.454.CMB.1.raw
  modified_base (593)..(593): a, c, t, g, unknown or other
  misc_feature (593)..(593): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcaggtggtccaggcaggactggactcacgccacccgtcggtcgggtcccgggggccgtggggaccgacgggcccgaccactacgtccaccgtcggaccgacccgggaaccaccgaacaaagtcggtccggacgaccgaggggacgccgcgttaggccgtgcacgcaaccgccgacggggaccccaacccgtccccaaacttccgtcgtcgtacgaggaagtcgaaccgaacccggcctaaccgaactacttacgacggacgaagttacttttacctaccctacgtaacggtaacaacgtaaaaacgtaccaacgtcccttactaccgtcacctaacttaccgtaggtcctaccgagcccgtacgacgacggtacggtacctacggtaacttaccctacgtacgaccgtcacgtccgtacgggtaaccacccgtacgactccggtccncggtcgtttcggtcgtttacggtccgggtaccggacggaaccgtcgtaccggtccggtaccggttcgggtaccgacggtacccgaacggcccgtcggtcccccgttaccgg

SEQ ID NO: 283924 - DNA, 752 bp, Homo sapiens
  misc_feature: GYAE6OF02HEVN4.19.85.H08.1.454.CMB.1.raw
tcagtactctcgtgcacgaccggtgctcgatttagtatcactcagtcagtcgcggggtccaaacagagcttcagcaaacatagtgggaatctgcaccatgccctgggctctgctcctcctcgaccctcctcactcactctgcagtgtcagtcggtccaggcaggactgactcacgccacccgtcgggtcggtccgggggccgtcggggacgacgggcccgccacgacgtccacccgtcggaccgaacccggggaaaccaacccgaacaagtcgggtaccggggaccgaggggacgaccgcgttggactcgcgagacgaaccgccgacgggccctacccctacccaaacctccgtacgtccgtaacgacggaactcgaaccaacccggtccctacaaacctacttcgaagtaagacgttactttaccacctcgacgaaccaactaaaactcgaacgtccctaccttcgtacgtaacctactttaccgtcgttccgtaccacgtcctacggaccggacggtaacggtccgtacgtaaccgtacgttactcgtactccgtacgtaccgttaccgggaccaaccgtacgcccgtcgccgttcggttaccgtttcggttaccggtttcgggaccgggtaaccgggtaccgtacggtacccggtccggtacccgggttccggttacgggttaccgaacggtacccgtaaacgggtcccgtacccggttacccccggtaccgggttacccttaccccgg

SEQ ID NO: 283925 - DNA, 869 bp, Homo sapiens
  misc_feature: GYAE6OF02HM1XH.19.85.H08.1.454.CMB.1.raw
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcagtggtccaggcaggactgactcagccacccgtcggtcggtccgggggacctgggacacggcccgccacgagtccaccgtcggaccgaacccgggaaaccaacccaaacgaacttcgggtaccggaccggaacccgaaggggaccgcccggtcgtttagggcctggaccagaccctaaaccggccctacggggacccctacccccgtaccccgaaaaccttccccgtacggtaacccgttacggaacgggtaaacgtaccggaacccgtaaaccccggggacccccttaacgaaaaccttaccgttttacgaaacggtaacggtacgttaactttttacccgaaccttacccgtaaaggtaacccaaaccgtaaaacttaaccgtaaccgtacccttaccgttacctaaccggtaaaccttaaccgtttaaccggttacggtttaccctacccgtaccggtaccgtaaccggtaaccggaaccggtaccggtacgttaaccgttaaccttaaccgttaaccgttccgacccttacggacccgtccggttaacggggtaacccacccgtaaccgtcccctacggtaccttcccgggttacgttcgggtttaccggtttcccgggagggtaacccgggtaccggtaacggtccggtaccggtaccggttaccggtcggtaccgaccggtacccgtaacggcccgtacccggccccgttaccggg

SEQ ID NO: 283926 - DNA, 816 bp, Homo sapiens
  misc_feature: GYAE6OF02HSL4P.19.85.H08.1.454.CMB.1.raw
  modified_base (315)..(315): a, c, t, g, unknown or other
  misc_feature (315)..(315): n is a, c, g, or t
tcagtactctcgtgcacgaccggtgctcgatttagtatcactcagtcagtcgcggggtccaaacagagcttcagcaagcatagtgggaatctgcaccatgccctgggctctgctcctcctgaccctcctcactcactctgcagtgtcgagtcggtccaggcaggactgactcacgccaccgtcgggtcggtccgggggccgtgggaccgacgggccccgaccacgacgtccaccgtacggaccggaaacccgggaaccaaccgaaacgtaacgtcggtaccggaccgaaccgaaggggccgcccgtacgttggcncgcgacgaccgaccggccgaccgggcccacccctacccgaaacgttccgttagtaccgtacgaacggaacgtaccgaacccgaacccggtaccctaacctaaaacgtacttacgaaggtaacgtacgtttaacttttcccaaccttaccggaaacgaacctaaaaactaaactaccgtaccgttaccctaccgttaccgtaccgtaaaccttaacgtttacccggtaccggtttacctacccgtacgtaccggtaacggtaaccggtaacgtacgggtactaccggtaaccttacgttacgttaccgacgttacgacccgttcgggaccggtaaccaccggaccgtcccgtacgccgtttacggttcgggtttccggttaccggtttaccgggaccgggtaacggtaccggtaacggcccgttaaccgggtccgttaccgggtacggtaccggaacccggttacccgaaccgggtccctccccgggtaccccgttaccggg

SEQ ID NO: 283927 - DNA, 748 bp, Homo sapiens
  misc_feature: GYAE6OF02I7IUK.19.85.H08.1.454.CMB.1.raw
  modified_base (663)..(663): a, c, t, g, unknown or other
  misc_feature (663)..(663): n is a, c, g, or t
tcagtactctcgtgcacgaccggtgctcgatttagtatcactcagtcagtcgcggggtccaaacagagcttcagcaagcatagtgggaatctgcaccatgccctggctctgctctcctgaccctctcactcactctgcagtgtcgagtggtccaggcaggactgactcacgccaccgtcggtcggtccggggccgtacgggacgacggccgccacgacgtaccaccgtcgaccggaaccgggaacctaaccgaaacgtaagtcggtaccggaccgaaccggacgggaccgccggtcgttcgggctcggacgacggaccgaaaccggcccgaccggggtaccccaccccttaaaccccgtaaaccgtcccggttaacgtacccggttaaacgacgggtaaaccgttaccggaaaccggtaaccccgggtaccctaaccgtaaaaccttacgtttaaaccgaacggtaacggttaacgttaaccgttttaccgttaaacccgtaaccggtaacgaaaaccgtaaactaaaacgtaaccgtaaccgggtacccttaccgttacgtaacggtaaacccttacgttaaccgttccggtcctaccacgtccgtaacggacgaccggtaacgacgttactaacttaacgtctcgacctacgaccgtacgngaaacctcacgctacgctgtcgtgttctcggcggacgacgagcctcgtacgtcgtaggcaccgtacggacgtcgtccgaccgtcg

SEQ ID NO: 283928 - DNA, 660 bp, Homo sapiens
  misc_feature: GYAE6OF02FS57J.19.85.H08.1.454.CMB.1.raw
  modified_base (405)..(405): a, c, t, g, unknown or other
  misc_feature (405)..(405): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
  modified_base (532)..(532): a, c, t, g, unknown or other
  misc_feature (532)..(532): n is a, c, g, or t
tcagtactctcgtgcacgaccggtgctcgatttagtatcactcagtcgcggggccggtttaccatctccagagacaatgccaagaagacgctctttctgcaattggacggcctgagcgtcgaagacacggctatttattactgtgtgagagaggggggcacgtggctggtcggtcgatcttttgatttgtgggccaaggatcaagcgtctccgtctcttcacgcctccgaccgaacgggcccacgtccggttccttcccccgtggcccaccccttcctaccgaagaccgccacccttccggtgggggtccacgtacggcccggtcccgtaggggcccttggaccgttgggtaccaaacggtccctttaacccgttaccccgaacggtaacggacggtttaaccgnggtaaccgggccgggtacgtacggggccgtaaaacggggtcctaccgtaaaggttcggactcgagtaccgagcgtncgtcgngcggaactcggncgtacncgtacgcgtcacgngtacgtacgtcgngcgtacgtgtacgtacgtagcgacgtacgtacgtacgtacgcgtacgacgtcgtacactcgtacgtacgtacgacgtacgtacgtacgtacgtacgtacgtacgtacgacgtacgtacgcgactgtcg

SEQ ID NO: 283929 - DNA, 421 bp, Homo sapiens
  misc_feature: GYAE6OF02G9HY4.19.85.H08.1.454.CMB.1.raw
  modified_base (393)..(421): a, c, t, g, unknown or other
  misc_feature (393)..(421): n is a, c, g, or t
tcagtactctcgtgcacgaccggtgctcgatttagtatcactcagtgcggggccggtttaccatctccagagacaatgccaagaagacgctctttctgcaattggacggcctgagagtcgaagacacggctatttattactgtgtgagaggagggggggcactggctggtcgggtcgatcttttgatttgtggggccaaggatcaaggcgtctccgtctcttcagcctccaccaagggcccagtccggtccttcccccctggccacccctcctcccaagcgcaccctcgtgggggcacgaggcggccctgggactgcctgggtcaaggacttaccgttacccgacggtacgacgtacctggacggcggggcgtaggcgaacggcgcagtacgnnnnnnnnnnnnnnnnnnnnnnnnnnnnn

SEQ ID NO: 283930 - DNA, 662 bp, Homo sapiens
  misc_feature: GYAE6OF02IS3M0.19.85.H08.1.454.CMB.1.raw
  modified_base (215)..(215): a, c, t, g, unknown or other
  misc_feature (215)..(215): n is a, c, g, or t
  modified_base (365)..(365): a, c, t, g, unknown or other
  misc_feature (365)..(365): n is a, c, g, or t
tcagtactctcgtgcacgaccggtgctcgatttagtatcactcagtcagtcgcggggtccaaacagagcttcagcaagcatagtgggaatctgcaccatgccctggactctgcctcctcctgacccctcctcactcactctgctagtcgtcagtcggtccaggcaggactgactcacgcccacccgtggtcggtccggggcctgggacacggccnccacacgtccacctgccaccgtaggaacctaaccaacaagtcggccggacaaccgagggacgccgtcgttggctacgcagacaaccgccgacggacccacccctactaacctccgtgtactacgagtatacgaaccaccgcctacaactntcagatagttacttccacctcgacgtaacaaactaaaacgtccacgtccttacactacgaaccctagttacgtccgtactaccgtactaccgtacgacgtacgacggtcctaaggtaaccttactacgtacgtaccctacggtacgtaccgtaaccgggacctaaccgaccgacccttcgtacgtccgttacgtcgggttccggtttacgggacgggtaaccggacctaaacggtccgtacggaccgttccggtacggtccctaaccggaccgaaccggttcccgccctaccccggg

SEQ ID NO: 283931 - DNA, 847 bp, Homo sapiens
  misc_feature: GYAE6OF02ICQ4D.19.85.H08.1.454.CMB.1.raw
  modified_base (606)..(606): a, c, t, g, unknown or other
  misc_feature (606)..(606): n is a, c, g, or t
  modified_base (696)..(696): a, c, t, g, unknown or other
  misc_feature (696)..(696): n is a, c, g, or t
  modified_base (730)..(730): a, c, t, g, unknown or other
  misc_feature (730)..(730): n is a, c, g, or t
tcagtactctcgtgcacgaccggtgctcgatttagtatcactcagtcagtcgcggggtccaaaacagagcttcagcaagcatagtgggaatctgcaccatgccctgggctctgcctctcctgaccctctcactcactctgcagtgtcaggtcggtccgaggtcgaacgggtactcggaccttcgaacgtcccctaacccggttcgggttacggggttccccggggggcctacgggggaccgaacgggcccctaccgaaccgtaggttacccgtaccgtaggacccggaaacccgggaaaccaacccgtaaaacaaagttccggtaccgggaccgaaccggaagggggaacgccggtacgtttcgggcctcggcgacgaaccgtaacggaccccggaaccgggtaccctacccccgtaaaccccgtaaaaccgttcccggttacgttaccggtaacgtaacggtaacgtccggaaaacccggtacccgtaaccccgtaacctaaataaccgtttacgaacggtaacgtacgtttacctttttacccgaaccgtaacccgacggtaaacctaaaaccgtaaaactaccgacgttacccttacgtaccncgttaaaacccgtacgtttacgtttacccggtccttaacctaccgtcggtaaccgtacggaccgtaggtacgtaccgttaactaaccgtntacctcacgacgtaccgtacggaccgaaccgtcnccgtcgccgtgttcgtcgttcggttacggaccgggaacggtaccgcgttcgtaaccggtcccggtacgttaccggacgttacccgccgtaaccggtcttccccggcccgttacccgg

SEQ ID NO: 283932 - DNA, 751 bp, Homo sapiens
  misc_feature: GYAE6OF02JSW0O.19.85.H08.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
  modified_base (579)..(579): a, c, t, g, unknown or other
  misc_feature (579)..(579): n is a, c, g, or t
  modified_base (591)..(591): a, c, t, g, unknown or other
  misc_feature (591)..(591): n is a, c, g, or t
  modified_base (594)..(594): a, c, t, g, unknown or other
  misc_feature (594)..(594): n is a, c, g, or t
  modified_base (604)..(604): a, c, t, g, unknown or other
  misc_feature (604)..(604): n is a, c, g, or t
tcagtactctcgtgcacgaccggtgctcgatttagtatcactcagtcggcgggggccgtttaccatctccagagacaatgccaagaagacgctctttctgcaattggacggtcctgagagtcgaagacgacggctaatttattactgtgtgagaggaggggcacgtggcgtgggtcgggtcgatttcgtttgagtttggngggccgtaaaggatccgaacgtccgttccgttcccgtntacttccgacgtccctcccgaaccggtaacggcccctagttcccggttcccttttccccccgnggtacccctaccccccgttaccgttaccgaaacggtaccggtcccgttaacccctccggggttaccgggggcctaaaccgggtacgggtccccgggtcccccggttaggggggtccctccggtcccgggttaccggggtaaccaaaacggggttacccttaccccgtttaccccggaaacggtacggttaccgttaaccgtcgggaccgggtccgggtaccgtacggtaccggaacggggtaccaacggtactaggactcgtagaccaaggtccaggnttacgacccgtncgngactacgtcncgcgtgcgcgcgcgtacgacgacgtacgtagtcgagacgacgcgaccgacgtagtacgtctcgtacgtacgtcgtcgtcgacgcgtcgtactcgtcgtcgcgtcgtccgtacgacgacgacgtaccgtccgtccgtacgtcgtaccg

SEQ ID NO: 283933 - DNA, 885 bp, Homo sapiens
  misc_feature: GYAE6OF02HL0NV.19.85.H08.1.454.CMB.1.raw
tcagtactctcgtgcacgaccggtgctcgatttagtatcactcagtcagtcgcggggtccaaacagagcttcagcaagcatagtgggaatctgcaccatcgcctgggctctgctcctcctcgaccctctcactctactctgctagtgtacagtcggtacccgaggacgaggaacttcggactaccgacgtccctacccgggttcgggttccgggtccgggggtcctaacggggacgaacgggccaaccacgtacgtaccaccgtcgaaccggacccgggaaacaacccgaactaagttcggaccggaccggtaaccggacgggacgcggtcgttcggcgtacggacgtacgacccgaaccggtcggaccgggtaccctaacccctaaccgtaaccgttccgtacgtacgtaccggaaggacgtaccggaaaccgacccgttaccgtaacgtaacgtacgttacggaacgtaacgttacggttaaccttacccggtaccgtaccgaaacggtaaaccaaaccgttaaaaggtacctacgtttaaccgtaccttaagtacccgttaactttaaacggtaccgttaccggttaaccgtacctaccgttaccggaacggttaaacccggacgggttaaccgtaccgtaaccgttaaaccggtttaaccttaccgggtacgtacccgtaaaccggtcccgggttacgggaaacccgttacggaaccctcccgggttctccccggttaggttcccggttcggtaccgttttacccggggttacggtaacccgggacggtaacccggaccggttaccggccggttaaccggttaccggtaccggtaccggaacccgtacggtaaccggtccgttaacccggtcccgtcccgg

SEQ ID NO: 283934 - DNA, 544 bp, Homo sapiens
  misc_feature: GYAE6OF02JR04O.19.85.H08.1.454.CMB.1.raw
  modified_base (214)..(214): a, c, t, g, unknown or other
  misc_feature (214)..(214): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (428)..(429): a, c, t, g, unknown or other
  misc_feature (428)..(429): n is a, c, g, or t
  modified_base (438)..(438): a, c, t, g, unknown or other
  misc_feature (438)..(438): n is a, c, g, or t
  modified_base (443)..(444): a, c, t, g, unknown or other
  misc_feature (443)..(444): n is a, c, g, or t
  modified_base (450)..(450): a, c, t, g, unknown or other
  misc_feature (450)..(450): n is a, c, g, or t
  modified_base (467)..(467): a, c, t, g, unknown or other
  misc_feature (467)..(467): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (475)..(475): a, c, t, g, unknown or other
  misc_feature (475)..(475): n is a, c, g, or t
  modified_base (487)..(487): a, c, t, g, unknown or other
  misc_feature (487)..(487): n is a, c, g, or t
  modified_base (491)..(492): a, c, t, g, unknown or other
  misc_feature (491)..(492): n is a, c, g, or t
  modified_base (496)..(498): a, c, t, g, unknown or other
  misc_feature (496)..(498): n is a, c, g, or t
  modified_base (500)..(504): a, c, t, g, unknown or other
  misc_feature (500)..(504): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(516): a, c, t, g, unknown or other
  misc_feature (515)..(516): n is a, c, g, or t
  modified_base (522)..(523): a, c, t, g, unknown or other
  misc_feature (522)..(523): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (543)..(544): a, c, t, g, unknown or other
  misc_feature (543)..(544): n is a, c, g, or t
tcagtactctcgtgcacgaccggtgctcgatttagtatcactcagtggcggggccggtttaccatctccgagagacaatgccaagaagacgctctttctgcaattgggacggcctgagagtcaagacacggctatttattactggtgtgagaggaggggggctacgtggctgggtacgggtcgtattcgtttgacgtttggcggggaccaaggntcgaagccttctccggtctacttcncgcctccaccgagggcccagtccggtaccttccccngtccacccgtctaccagtacgacctaccgtcgtacgggcaccgaacggcccggaccgttgggccttcgtccgttaggacaacggtacctaccgaccgtacgtacggacgtacgtacggacggcggcgtacggacgtggaccgtacagttcganncgtgatcgntacgnngtaacntaacgtacgcagtcagntcntnacntactggacatcntagnnacgnnnannnnnacganananannagagannganacgacncanacgcactnn

SEQ ID NO: 283935 - DNA, 347 bp, Homo sapiens
  misc_feature: GYAE6OF01DEK84.13.66.F11.1.454.CMB.1.raw
  modified_base (342)..(347): a, c, t, g, unknown or other
  misc_feature (342)..(347): n is a, c, g, or t
tcagtcacgtactacacgaccggtgctcgatttagtcacgcgagaagggcagattcaccatctccagagatgattcaaggaacacagtgttctgcaaatgaacagcctgactgccggggacactgccgtgtattactgtgccagcagcagtacctggccactatattttttgacttctggggccagggaaccctggccaccgtctcctcagcttccaccaaggcccatcggtcttcccctggcgccctgctccaggagcacctctgggggcacagcggccctgggctgcctggtcaaggctactcctagtacgtgactgagcgggctggcaaggcgcatagnnnnnn

SEQ ID NO: 283936 - DNA, 356 bp, Homo sapiens
  misc_feature: GYAE6OF01BCNI9.13.66.F11.1.454.CMB.1.raw
  modified_base (342)..(356): a, c, t, g, unknown or other
  misc_feature (342)..(356): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctggggccagggaaccctggccaccgtctcctcagcttccaccaaggcccatcggtcttcccctggcgccctgctccaggagcacctctgggggcacagcggccctgggctgcctggtcaaggctactcctagtacgtgactgagcgggctggcaaggcgcatagnnnnnnnnnnnnnnn

SEQ ID NO: 283937 - DNA, 352 bp, Homo sapiens
  misc_feature: GYAE6OF01AYJ7U.13.66.F11.1.454.CMB.1.raw
  modified_base (345)..(352): a, c, t, g, unknown or other
  misc_feature (345)..(352): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctgggctgcctggtcaaggctacttcctagtacgtgactgagcgggctggcaaggcgcatagnnnnnnnn

SEQ ID NO: 283938 - DNA, 351 bp, Homo sapiens
  misc_feature: GYAE6OF01C458P.13.66.F11.1.454.CMB.1.raw
  modified_base (344)..(351): a, c, t, g, unknown or other
  misc_feature (344)..(351): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaccctggtcaccgtctcctcagcctccaccaagggcccatcggtcttccccctggcaccctcctccagagcacctctggggcacagcggccctgggctgcctggtcaaggactacttcctagtacgtgactgagcgggctggcaaggcgcatagnnnnnnnn

SEQ ID NO: 283939 - DNA, 354 bp, Homo sapiens
  misc_feature: GYAE6OF01BA5ZM.13.66.F11.1.454.CMB.1.raw
  modified_base (240)..(240): a, c, t, g, unknown or other
  misc_feature (240)..(240): n is a, c, g, or t
  modified_base (345)..(354): a, c, t, g, unknown or other
  misc_feature (345)..(354): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctggggccagggaaccctggccaccgtctcctcagcttccaccaaggcccatcggtcttccccnggcgccctgctccaggacgcacctcgtggggcacgagcggccctgggctgcctggtcaaggactactcctagtacgtgactgagcgggctggcaaggcgcatagnnnnnnnnnn

SEQ ID NO: 283940 - DNA, 350 bp, Homo sapiens
  misc_feature: GYAE6OF01EL91R.13.66.F11.1.454.CMB.1.raw
  modified_base (345)..(350): a, c, t, g, unknown or other
  misc_feature (345)..(350): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactattattttttgacttctggggccagggaaccctggccaccgtctcctcagcttccaccaaggcccatcggtcttccccctggccgccctgctccaggagcacctctggggcacagcggcctgggctgcctggtcaaggctacttcctagtacgtgactgagcgggctggcaaggcgcatagnnnnnn

SEQ ID NO: 283941 - DNA, 356 bp, Homo sapiens
  misc_feature: GYAE6OF01CABT6.13.66.F11.1.454.CMB.1.raw
  modified_base (349)..(356): a, c, t, g, unknown or other
  misc_feature (349)..(356): n is a, c, g, or t
tcagtcacgtactacacgaccggtgctcgatttagtcacgcgagaagggcaggattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctggggctgcctggtcaaggactacttcctagtacgtgactgagcgggctggcaaggcgcatagnnnnnnnn

SEQ ID NO: 283942 - DNA, 367 bp, Homo sapiens
  misc_feature: GYAE6OF01BDSTY.13.66.F11.1.454.CMB.1.raw
  modified_base (360)..(367): a, c, t, g, unknown or other
  misc_feature (360)..(367): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccacttattattttttgacttcgtggggccagggaaccctggccaccgtctcctcagcttccaccgaacgggcccatccggtccttccccctggccaccctcctccaagacgccacctcgtgggggcacgagccggccctgggctcggcctggtcaaggctacttcagtacgtgactgacgcgggctggcaaggcgcatagnnnnnnnn

SEQ ID NO: 283943 - DNA, 362 bp, Homo sapiens
  misc_feature: GYAE6OF01ALNVC.13.66.F11.1.454.CMB.1.raw
  modified_base (352)..(362): a, c, t, g, unknown or other
  misc_feature (352)..(362): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatatttttgacttcgtggggccagggaaccctggccaccgtctcctcagcctccaccaagggcccatcggtctccccctggccgccctgctccaggagccacctccgagagcacagccggccctgggctgccctggtcaaggcctacttcctagtacgtgactgagcgggctgggcaaggccgacatagnnnnnnnnnnn

SEQ ID NO: 283944 - DNA, 349 bp, Homo sapiens
  misc_feature: GYAE6OF01BFY0K.13.66.F11.1.454.CMB.1.raw
  modified_base (347)..(349): a, c, t, g, unknown or other
  misc_feature (347)..(349): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaatcctggccaccgtctcctcagcttccaccaagggcccatcggtcttccccctggcgccctgctccaggagcacctctgggggcacagcggccctgggctgcctggtcaaggactacttcctagtacgtgactgagcgggctggcaaggcgcatagnnn

SEQ ID NO: 283945 - DNA, 352 bp, Homo sapiens
  misc_feature: GYAE6OF01BOT6E.13.66.F11.1.454.CMB.1.raw
  modified_base (346)..(352): a, c, t, g, unknown or other
  misc_feature (346)..(352): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctgggctgcctggtcaaggctacttcctagtacgtgactgagcgggctggcaaggcgcatagnnnnnnn

SEQ ID NO: 283946 - DNA, 349 bp, Homo sapiens
  misc_feature: GYAE6OF01BY7R2.13.66.F11.1.454.CMB.1.raw
  modified_base (343)..(349): a, c, t, g, unknown or other
  misc_feature (343)..(349): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctgggccagggaaccctggccaccgtctcctcagcttccaccaagggcccatcggtcttcccctggcgccctgctccaggagcacctctgggggcacagcggcccctgggctgcctggtcaaggctactcctagtacgtgactgagcgggctggcaaggcgcatagnnnnnnn

SEQ ID NO: 283947 - DNA, 352 bp, Homo sapiens
  misc_feature: GYAE6OF01CYECU.13.66.F11.1.454.CMB.1.raw
  modified_base (346)..(352): a, c, t, g, unknown or other
  misc_feature (346)..(352): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctgggccagggaaccctggccaccgtctcctcagcttccaccaagggcccatcggtcttccccctggcgccctgctccaggagcacctctgggggcacagcggccctgggctgccctggtcaaggactcttcctagtacgtgactgagcgggctggcaaggcgcatagnnnnnnn

SEQ ID NO: 283948 - DNA, 368 bp, Homo sapiens
  misc_feature: GYAE6OF01BRTAO.13.66.F11.1.454.CMB.1.raw
  modified_base (356)..(368): a, c, t, g, unknown or other
  misc_feature (356)..(368): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactattattttttgacttctggggccagggaccctggccaccgtctcctcagcttccaccaagggcccatccggtcttccccctggccgccctgcctccaggacgcaccgtctgggggcacgagcggcccctgggctgcctggtcaaggcctacttcctagtacgtgactgagcgggctgggcaaggcgcagtagnnnnnnnnnnnnn

SEQ ID NO: 283949 - DNA, 575 bp, Homo sapiens
  misc_feature: GYAE6OF01EQGZP.13.66.F11.1.454.CMB.1.raw
tcagtcacgtactacacgaccggtgctcgatttagtcacgcgagaagggggcaggagtcagacccactcaggacacagcatggacatgagggtccccgctcagctcctggggctcctgctgctctggctcccaggtgccagatgtgccatccagatgacccagtcctccatccctccctgtctgcatctgtaggagacagagtccaccgtcacgttcggccgggcgagtcacgactaattaacacttatttagcctggtatcagcagaagccgaggagagtaccctaaatttatgatctctgctgccgtccgtcttgcagtccggggtcccatctcgtcaggtggcggtgatcgtagacagtaacttctactctcaccataccacctacctcgacccacctgaagtagttgttaggtaacgtttatttacgtagtacaacgtaccttaagtaggttcgggtccggtcccgttcttccgttagttttccggggacgggtaacgggacgaacgggtcgacgagtataaccgaaacgtacgtggtcgtctacggctaacccgtcgttcgttcgttacc

SEQ ID NO: 283950 - DNA, 435 bp, Homo sapiens
  misc_feature: GYAE6OF01BBYRM.13.66.F11.1.454.CMB.1.raw
  modified_base (417)..(435): a, c, t, g, unknown or other
  misc_feature (417)..(435): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactattattttttgacttcgtggggccagggaaccctggcccaccgtctcctcagccttccaccaagggcccatccggtccttcccccgtggccgcccctgcctccgaggacgccaccgtcgtcgggggccacgacggccggcccgtggggcctcggccccgttgggtaccgaaacgggtaccttaccgtttacccgtaggtaaccgtggtaccgttggacggtccggggcgtgggaccaaacgggcgtacaagtagnnnnnnnnnnnnnnnnnnn

SEQ ID NO: 283951 - DNA, 530 bp, Homo sapiens
  misc_feature: GYAE6OF01EJBI2.13.66.F11.1.454.CMB.1.raw
  modified_base (288)..(288): a, c, t, g, unknown or other
  misc_feature (288)..(288): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (477)..(478): a, c, t, g, unknown or other
  misc_feature (477)..(478): n is a, c, g, or t
  modified_base (480)..(530): a, c, t, g, unknown or other
  misc_feature (480)..(530): n is a, c, g, or t
tcagtcacgtactacacgaccggtgctcgattttagtcacgcgagaagggcagattcaccatctccagagatgattcaaaggaacacagtgttttctgcaaatgaacagcctgactgccgggacactgccgtgtattactgtgccagcagcagtacctggccacttatttatttttttgactttcgtggggccagggaaccctggccaccgtctcctcagtccttcccaccaacgggcccctagttccggttccttccccccgtggcccgccctgcctccacgggacnccgtaccgttcggtgggggaccacggacggccggccccgtggggccttcggcccgttacgggtaccctaaaccgtttaaccgtttacccgtaacgggttaaccgttaggacccgttagggacggggccggggtccgtacggggtaacccgaaaggggcccggtaacctaagttacggatcgngntacgnngnnnnnnnnnnnnnnnnnnnnnnnnnnnnnnnnnnnnnnnnnnnnnnnnnnn

SEQ ID NO: 283952 - DNA, 415 bp, Homo sapiens
  misc_feature: GYAE6OF01CZAF5.13.66.F11.1.454.CMB.1.raw
  modified_base (397)..(397): a, c, t, g, unknown or other
  misc_feature (397)..(397): n is a, c, g, or t
  modified_base (403)..(415): a, c, t, g, unknown or other
  misc_feature (403)..(415): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccacttattatttttttgactttcgtggggccagggaaccctggcccaccgtctcctcacgccttccaaccgaaggggccccagttcccggttcccttccccccgtgggcccgtccctgcctccgaggacgccaccgtcgtgggggccacgacggccggcccgtgggctcggcccgttgggtacaacgggtccttacgtttcctaggtacgtgactggacggcgggctggacaacggcncatagnnnnnnnnnnnnn

SEQ ID NO: 283953 - DNA, 428 bp, Homo sapiens
  misc_feature: GYAE6OF01A03CI.13.66.F11.1.454.CMB.1.raw
  modified_base (383)..(383): a, c, t, g, unknown or other
  misc_feature (383)..(383): n is a, c, g, or t
  modified_base (396)..(428): a, c, t, g, unknown or other
  misc_feature (396)..(428): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctgccatatttattttttgacttcgtgggccagggaaccctggcccaccgtcctcctcagccttccaccaacgggcccatccggtccttcccccgtggccgccctgcctaccgagacgccacctcggtggggccacgacgccggcccgtagggcctcgccgtaggtcgaaaggtcttaccgtcctaggtacggtataccgtggacggccggtacgtggccaaagggcccngtagagcgtagcnnnnnnnnnnnnnnnnnnnnnnnnnnnnnnnnn

SEQ ID NO: 283954 - DNA, 347 bp, Homo sapiens
  misc_feature: GYAE6OF02JER9M.13.66.F11.1.454.CMB.1.raw
  modified_base (259)..(259): a, c, t, g, unknown or other
  misc_feature (259)..(259): n is a, c, g, or t
  modified_base (337)..(337): a, c, t, g, unknown or other
  misc_feature (337)..(337): n is a, c, g, or t
  modified_base (342)..(347): a, c, t, g, unknown or other
  misc_feature (342)..(347): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctggggccagggaaccctggccaccgtctcctcagcttccaccaagggcccatcggtcttcccctggcgccctgctccaggancacctcgagagcacagcggccctgggctgcctggtcaaggctacttcctagtacgtgactgagcgggctggcaaggcncatgnnnnnn

SEQ ID NO: 283955 - DNA, 355 bp, Homo sapiens
  misc_feature: GYAE6OF02HL94N.13.66.F11.1.454.CMB.1.raw
  modified_base (276)..(276): a, c, t, g, unknown or other
  misc_feature (276)..(276): n is a, c, g, or t
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
  modified_base (344)..(355): a, c, t, g, unknown or other
  misc_feature (344)..(355): n is a, c, g, or t
tcagtcacgtactacacgaccggtgctcgatttagtcacgcgagaagggcgagattcaccatctccagagatgattcaaggaacacagtgtttctgcaaatgaacagcctgactgccgggacactgccgtgtattactgtgccagcagcagtacctggccactatattttttgacttctgggccagggacctggccacgtctctcagcttccaccaagggcccatcggtcttccccctggccgccctgcctaccaggacgcacctctgggggcacngtcggccctgggctgccctggtacaaggctactccagtcgtnactgancggctggcagggctactagnnnnnnnnnnnn

SEQ ID NO: 283956 - DNA, 351 bp, Homo sapiens
  misc_feature: GYAE6OF02JC9Z5.13.66.F11.1.454.CMB.1.raw
  modified_base (347)..(351): a, c, t, g, unknown or other
  misc_feature (347)..(351): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaccctggccaccgtctcctcagcttccaccaagggcccatcggtcttccccctggcgccctgctccaggagcacctctgggggcacgagcggcccctgggctgcctggtcaaggctacttcctagtacgtgactgagcgggctggcaaggcgcatagnnnnn

SEQ ID NO: 283957 - DNA, 349 bp, Homo sapiens
  misc_feature: GYAE6OF02F2JKL.13.66.F11.1.454.CMB.1.raw
  modified_base (341)..(349): a, c, t, g, unknown or other
  misc_feature (341)..(349): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccacgtctcctcagcttccaccaaggcccatcggtctcccctggcgccctgctccaggagcacctctggggcacagcggccctgggctgcctggtcaaggctactcctagtacgtgactgagcgggctggcaaggcgcagtagnnnnnnnnn

SEQ ID NO: 283958 - DNA, 351 bp, Homo sapiens
  misc_feature: GYAE6OF02GNALI.13.66.F11.1.454.CMB.1.raw
  modified_base (339)..(339): a, c, t, g, unknown or other
  misc_feature (339)..(339): n is a, c, g, or t
  modified_base (345)..(351): a, c, t, g, unknown or other
  misc_feature (345)..(351): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctgggctgcctggtcaaggctactcctagtacgtgactgagcgggctggcaaggcncatagnnnnnnn

SEQ ID NO: 283959 - DNA, 355 bp, Homo sapiens
  misc_feature: GYAE6OF02G50L0.13.66.F11.1.454.CMB.1.raw
  modified_base (347)..(355): a, c, t, g, unknown or other
  misc_feature (347)..(355): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatccggtcttccccctggccgccctgcctccaggagcacctctgggggcacagcggccctgggctgcctggtcaggctactcctagtacgtgactgagcgggctggcaaggcgcatagnnnnnnnnn

SEQ ID NO: 283960 - DNA, 359 bp, Homo sapiens
  misc_feature: GYAE6OF02II32A.13.66.F11.1.454.CMB.1.raw
  modified_base (278)..(278): a, c, t, g, unknown or other
  misc_feature (278)..(278): n is a, c, g, or t
  modified_base (349)..(359): a, c, t, g, unknown or other
  misc_feature (349)..(359): n is a, c, g, or t
tcagtcacgtactacacgaccggtgctcgatttagtcacgcgagaagggcagattcaccatctccagagatgattcaaggaacacagtgtttctgcaaatgaacagcctgactgccgggacactgccgtgtattactgtgccagcagcagtacctggccactatattttttgacttctgggccagggaccctggccaccgtctcctcagctccaccaagggcccatcggtcttcccctggccgccctgcctccaggacgcacctcgtcggggcaacgngccgcccgtggctgccgtggtcaaggctacgtcctacgtacgtgactgagcgggctggacaggcgcatagnnnnnnnnnnn

SEQ ID NO: 283961 - DNA, 353 bp, Homo sapiens
  misc_feature: GYAE6OF02GDAPH.13.66.F11.1.454.CMB.1.raw
  modified_base (346)..(353): a, c, t, g, unknown or other
  misc_feature (346)..(353): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttcccctggcgccctgctccaggagcacctctgggggcacagcggcccctgggctgcctggtcaaggctacttcctagtacgtgactgagcgggctggcaaggcgcatagnnnnnnnn

SEQ ID NO: 283962 - DNA, 361 bp, Homo sapiens
  misc_feature: GYAE6OF02HMG2N.13.66.F11.1.454.CMB.1.raw
  modified_base (354)..(361): a, c, t, g, unknown or other
  misc_feature (354)..(361): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatccggtccttccccctggccgcccctgcctccaggacgccacctcgtgggggcacagcggccctgggctgcctggtcaaggctacttcctagtacgtgactgagcgggctggcaaggcgcatagnnnnnnnn

SEQ ID NO: 283963 - DNA, 354 bp, Homo sapiens
  misc_feature: GYAE6OF02GCIH2.13.66.F11.1.454.CMB.1.raw
  modified_base (348)..(354): a, c, t, g, unknown or other
  misc_feature (348)..(354): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccaccgtctcctcagcttccaccaagggcccatcggtcttccccctggcgccctgctccaggagcacctctgggggcacagcggccctgggctgcctggtcaaggactacttcctagtacgtgacctgagcgggctggcaaggcgcatagnnnnnnn

SEQ ID NO: 283964 - DNA, 150 bp, Homo sapiens
  misc_feature: GYAE6OF02HUP63.13.66.F11.1.454.CMB.1.raw
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagca

SEQ ID NO: 283965 - DNA, 362 bp, Homo sapiens
  misc_feature: GYAE6OF02GI7O0.13.66.F11.1.454.CMB.1.raw
  modified_base (350)..(362): a, c, t, g, unknown or other
  misc_feature (350)..(362): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactatattttttgacttctggggccagggaaccctggccacgtctcctcagcttccaccaagggcccatcggtccttccccctggccaccctccctccaagacgcacctctgggggcacagccggcctgggctgcctggtcaaggctactccgtagtacgtgactgacgcgggctggcaaggcgcatagnnnnnnnnnnnnn

SEQ ID NO: 283966 - DNA, 368 bp, Homo sapiens
  misc_feature: GYAE6OF02F2USD.13.66.F11.1.454.CMB.1.raw
  modified_base (343)..(343): a, c, t, g, unknown or other
  misc_feature (343)..(343): n is a, c, g, or t
  modified_base (359)..(368): a, c, t, g, unknown or other
  misc_feature (359)..(368): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagctagtacctggccactatattttttgacttctggggccagggaaccctggccgaccgtctcctcagcttccaccaagggcccatccggtccttcccccgtggccgccctgcctccgaggacgccacctcgtgggggcacagccggccctgggctgcctggtcaaggctacgttcctagtacgtgactgagcggtntggacaggcgcatagnnnnnnnnnn

SEQ ID NO: 283967 - DNA, 459 bp, Homo sapiens
  misc_feature: GYAE6OF02JB670.13.66.F11.1.454.CMB.1.raw
  modified_base (250)..(250): a, c, t, g, unknown or other
  misc_feature (250)..(250): n is a, c, g, or t
  modified_base (423)..(459): a, c, t, g, unknown or other
  misc_feature (423)..(459): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactattattttttgacttctggggccagggacccctggcccaccgtctcctcagccttccaccaacgggcccatccggtccttcccccgnggcccgccctgcctcccgaggacgccacccgtcggtcgggggccacgacggccggccccgttggggcctcggtcccgttgggtccgaaacgggtcccttacgtttccccgtaaggttaacccggtgtaacctgggacggccggggtctcgggaccaagggccgtacaagtagnnnnnnnnnnnnnnnnnnnnnnnnnnnnnnnnnnnnn

SEQ ID NO: 283968 - DNA, 370 bp, Homo sapiens
  misc_feature: GYAE6OF02G7C4U.13.66.F11.1.454.CMB.1.raw
  modified_base (262)..(262): a, c, t, g, unknown or other
  misc_feature (262)..(262): n is a, c, g, or t
  modified_base (324)..(324): a, c, t, g, unknown or other
  misc_feature (324)..(324): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (352)..(358): a, c, t, g, unknown or other
  misc_feature (352)..(358): n is a, c, g, or t
  modified_base (360)..(370): a, c, t, g, unknown or other
  misc_feature (360)..(370): n is a, c, g, or t
tcagtcacgtactacacgaccggtgctcgatttagtcacgcgagaagggcagagttcaccatctccagagatgattcaaggaacacagtgtttctgcaaatgaacagcctgactgccggggacactgccgtgtattactgtgccagcagcagtacctggccactatattttttgacttctgggccagggaccctggccaccgtctcctcagcttccaccaagggcccatccggtcttcccctggccgcctgctccgaggacncgacctcgtgggggccacagccggccctgggctgccgtggcaaggactactcctagtacgtnacgtgagcgggntggcaaggcncatagnnnnnnnannnnnnnnnnn

SEQ ID NO: 283969 - DNA, 477 bp, Homo sapiens
  misc_feature: GYAE6OF02JZ54M.13.66.F11.1.454.CMB.1.raw
  modified_base (262)..(262): a, c, t, g, unknown or other
  misc_feature (262)..(262): n is a, c, g, or t
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
  modified_base (462)..(462): a, c, t, g, unknown or other
  misc_feature (462)..(462): n is a, c, g, or t
  modified_base (465)..(477): a, c, t, g, unknown or other
  misc_feature (465)..(477): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggcctactatttattttttgacttcgtggggccagggaccctggccctaccgtctccctcagccttccgaacctacgggcccctagttccggtcccttccccccgngggcccgtccccgttaggacccgtaaccgaacggacggtcccaaccttccggtcggggggacctaccgaaggccccggtcccctggggcctggccccgtttgggaccaaagggcctttaccgtcccttaacgggtcgtacggttaccncgggtagccgggggtctgggaccaagggccttaccagtaggctnagctgcancgnnnnnnnnnnnnn

SEQ ID NO: 283970 - DNA, 448 bp, Homo sapiens
  misc_feature: GYAE6OF02F166R.13.66.F11.1.454.CMB.1.raw
  modified_base (377)..(377): a, c, t, g, unknown or other
  misc_feature (377)..(377): n is a, c, g, or t
  modified_base (404)..(404): a, c, t, g, unknown or other
  misc_feature (404)..(404): n is a, c, g, or t
  modified_base (413)..(448): a, c, t, g, unknown or other
  misc_feature (413)..(448): n is a, c, g, or t
tcagtcacgtactacacgaccggtgctcgatttagtcacgcgagaagggcagattcaccatctccagagatgattcaaggaacacagtgtttctgcaaatgaacagcctgactggccggggacactgccgtgtattactgtgccagcagcagtacctggccactattattttttgactttcgtggggccacgggtaaccctggcccaccgttcctcctcacgtccttcccaaccgaagggtcccccagttcccggtcccttcccccgtggcccgtccctcgcctcccgaggtcgccacccgtcggtcggggccacgacgccgggcccgtgggctcgccgtggtacaacggcttaccgttccgtaggtacgtgacgtnacgggccggcgtaggaccgagggtccnaagtcgagnnnnnnnnnnnnnnnnnnnnnnnnnnnnnnnnnnnn

SEQ ID NO: 283971 - DNA, 477 bp, Homo sapiens
  misc_feature: GYAE6OF02G8Q7N.13.66.F11.1.454.CMB.1.raw
  modified_base (122)..(122): a, c, t, g, unknown or other
  misc_feature (122)..(122): n is a, c, g, or t
  modified_base (261)..(261): a, c, t, g, unknown or other
  misc_feature (261)..(261): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
  modified_base (405)..(405): a, c, t, g, unknown or other
  misc_feature (405)..(405): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (423)..(425): a, c, t, g, unknown or other
  misc_feature (423)..(425): n is a, c, g, or t
  modified_base (428)..(430): a, c, t, g, unknown or other
  misc_feature (428)..(430): n is a, c, g, or t
  modified_base (432)..(477): a, c, t, g, unknown or other
  misc_feature (432)..(477): n is a, c, g, or t
tcagtcacgtactacacgaccggtgctcgatttagtcacgcgagaagggcagattcaccatctccagagatgattcaaggaacacagtgtttctgcaaatgaacagcctgactgccgggganactgccgtgtattactgtgccagcagtcagtacctggcccactattatttttttgactttcgtggggccagggtaaccctggcccaccgtctcctcacgcttcccaaccgaagggcccagttccggtcccttcccccgngggccctccctagccctccgaggacgctaccctggtcgggggacaacncggccggtccgtcggggcttacgccgttggtacgaagtacctaccgttcctagtaccgtgtacnggacgtcgggagtcggacgtaaaggccggtanaactaggctncngatntnnncgnnngnnnnnnnnnnnnnnnnnnnnnnnnnnnnnnnnnnnnnnnnnnnnnn

SEQ ID NO: 283972 - DNA, 461 bp, Homo sapiens
  misc_feature: GYAE6OF02F7NKH.13.66.F11.1.454.CMB.1.raw
  modified_base (439)..(461): a, c, t, g, unknown or other
  misc_feature (439)..(461): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggccactattattttttgacttcgtggggccagggaccctggccaccgtctcctcagtccttccaaccgaacgggccccagttccggtcccttccccccgtggcccgccctgcctccgacggacgccacccgttcggtcggggggccaccgacggcccgggacccccgttggggccttcgggccccgttagggtaccgaaacgggtaccttaccgtttaccgtacggttaccggtcgacctggacggccgggcgtagggaccgaacgggcgacgaagtacggnnnnnnnnnnnnnnnnnnnnnnn

SEQ ID NO: 283973 - DNA, 615 bp, Homo sapiens
  misc_feature: GYAE6OF02JD7GK.13.66.F11.1.454.CMB.1.raw
  modified_base (501)..(501): a, c, t, g, unknown or other
  misc_feature (501)..(501): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (523)..(524): a, c, t, g, unknown or other
  misc_feature (523)..(524): n is a, c, g, or t
  modified_base (531)..(531): a, c, t, g, unknown or other
  misc_feature (531)..(531): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (545)..(545): a, c, t, g, unknown or other
  misc_feature (545)..(545): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (555)..(555): a, c, t, g, unknown or other
  misc_feature (555)..(555): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
  modified_base (579)..(579): a, c, t, g, unknown or other
  misc_feature (579)..(579): n is a, c, g, or t
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (596)..(600): a, c, t, g, unknown or other
  misc_feature (596)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (612)..(613): a, c, t, g, unknown or other
  misc_feature (612)..(613): n is a, c, g, or t
tcagtcacgtactacacgaccggtgctcgatttagtcacgcgagaagggcagattcaccatctccagagatgattcaaggaacacagtgtttctgcaaatgaacagcctgactcggccggggacaccgtgccgtgtattactcgtgccagcagcagtacctggccaacttatttagtttttttacgacgtttcgtcggggaccgaaccggggtaaccccgtcggtacccacccggttcccttccctaccgacggtccctttacccgaaaccgacggggtacccctaaggtttcccggttcccgtttccccccgtcgggtacccgccccgttcgcccttccgaagggactccaaccctcggggtcggggaacctacggacggtccggcccggtcggctacggccgttgtacgaacggtcttaccgtccgtacgttaccgagtaccgtcgggacggtccgggtcgtacggccggaacgggcgtaacctaggttaacgcgtgcnccgtaagctgcgtgngncgcgnngcgcganacgtcncgngngcncncngatacncgactcncncngcncnncgtagcnctgngcgncgncgncgnnnnngngncgntnctnntc

SEQ ID NO: 283974 - DNA, 455 bp, Homo sapiens
  misc_feature: GYAE6OF02JHTWV.13.66.F11.1.454.CMB.1.raw
  modified_base (409)..(411): a, c, t, g, unknown or other
  misc_feature (409)..(411): n is a, c, g, or t
  modified_base (413)..(455): a, c, t, g, unknown or other
  misc_feature (413)..(455): n is a, c, g, or t
tcagtcacgtactacacgaccggtgctcgatttagtcacgcgagaagggcagattcaccatctccagagatgattcaaggaacacagtgtttctgcaaatgaacagcctgactgccggggacactgccgtgtattactgtgccagcagcagtacctggaccacttattatttttttgactttcgtaggggcccagggaaccctggcccaccgtctccgtcacgccttccaaccaagggcccatccgtccttccccctggccgtccctgcctccgaggcgctacctcgtcgggggcacgaggccggccccgtgggctcgccgttcgacgaaaggtccttacgttcctaagttacgtacgacgttggaccggcggggccgtgggaccgaaagggtccgaactagtaaggcnnngnnnnnnnnnnnnnnnnnnnnnnnnnnnnnnnnnnnnnnnnnnn

SEQ ID NO: 283975 - DNA, 417 bp, Homo sapiens
  misc_feature: GYAE6OF01AKCNN.14.57.F02.1.454.CMB.1.raw
  modified_base (414)..(417): a, c, t, g, unknown or other
  misc_feature (414)..(417): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcaccctcctccaagagcacctctgggggcacagcggccctgggctgcctggtcaaggctacttccgtactagacgctgagcggctggcaaggcgcatagnnnn

SEQ ID NO: 283976 - DNA, 301 bp, Homo sapiens
  misc_feature: GYAE6OF01EQZD0.14.57.F02.1.454.CMB.1.raw
  modified_base (295)..(301): a, c, t, g, unknown or other
  misc_feature (295)..(301): n is a, c, g, or t
tcagcgtctagtaccacgaccggtgctcgatttagctcgatatagttgggtttgggggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccgccatctgagtactagacgctgagcgggctggcaaggcgcatagnnnnnnn

SEQ ID NO: 283977 - DNA, 417 bp, Homo sapiens
  misc_feature: GYAE6OF01CA2VO.14.57.F02.1.454.CMB.1.raw
  modified_base (413)..(417): a, c, t, g, unknown or other
  misc_feature (413)..(417): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggctttcatgtctggggccaagggacgctggtcaccgtctcttcagctccaccaagggcccatcggtcttccccctggcaccctcctccaagacgcacctctggggcacagcggccctgggctgcctggtcaaggactacttccgtactagacgctgagcgggctggcaaggcgcatagnnnnn

SEQ ID NO: 283978 - DNA, 507 bp, Homo sapiens
  misc_feature: GYAE6OF01BBG1T.14.57.F02.1.454.CMB.1.raw
  modified_base (484)..(484): a, c, t, g, unknown or other
  misc_feature (484)..(484): n is a, c, g, or t
  modified_base (499)..(499): a, c, t, g, unknown or other
  misc_feature (499)..(499): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctagaagtatttgctagtttattactgtcagcagcgggcaagttcggccgctctacgtttcggcggggaccaggtggagtcgaaacgacgtggtggntgcacatctgtcttnctctccgc

SEQ ID NO: 283979 - DNA, 538 bp, Homo sapiens
  misc_feature: GYAE6OF01BTYO4.14.57.F02.1.454.CMB.1.raw
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccanagggccacggcatccccagccaggttcagtggcagcgggtcngggacngacttcactctcaccatcagcagcctagagtctagaagtattttgctagtttattactgtcagcaggcgggactaagttcggaccgtcgtcgtacgtttcgggcgggggacgagggtggagttacgaaacggtaacgtggtggctgccacgtatctgtcttacacttccgttcccgtacc

SEQ ID NO: 283980 - DNA, 420 bp, Homo sapiens
  misc_feature: GYAE6OF01BICA8.14.57.F02.1.454.CMB.1.raw
  modified_base (416)..(420): a, c, t, g, unknown or other
  misc_feature (416)..(420): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnn

SEQ ID NO: 283981 - DNA, 507 bp, Homo sapiens
  misc_feature: GYAE6OF01BF46Y.14.57.F02.1.454.CMB.1.raw
  modified_base (308)..(308): a, c, t, g, unknown or other
  misc_feature (308)..(308): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggccaccggcatcccagccaggttcagtggcagcgggtctgggacagacttcactctcaccatcagcagcctagagtctgaagtattttgctagtttattactgtcagcagcgggcagttggccgctctacgtttcgggcgggggacaggtggagtcgaaacgactggtgntgcacatctgtcttnactctcccgcc

SEQ ID NO: 283982 - DNA, 509 bp, Homo sapiens
  misc_feature: GYAE6OF01AXOQ2.14.57.F02.1.454.CMB.1.raw
  modified_base (385)..(385): a, c, t, g, unknown or other
  misc_feature (385)..(385): n is a, c, g, or t
  modified_base (502)..(502): a, c, t, g, unknown or other
  misc_feature (502)..(502): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagngtctagaatattttgctagtttattattgtcagcagtataaatactgcctccgtggtacgttcggacgaagggaccaaggtgaaatacaaacgacgtgtgctgcacatctgtcttcntctcccg

SEQ ID NO: 283983 - DNA, 528 bp, Homo sapiens
  misc_feature: GYAE6OF01EQZSY.14.57.F02.1.454.CMB.1.raw
  modified_base (306)..(306): a, c, t, g, unknown or other
  misc_feature (306)..(306): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanacgggccaccggcactccccagccaggttcagtggcaggcgggtctgggacagtacttcactctcaccatcagcagcctagagtctgaagtattttgctagtttattactgtcagcgaggcgggacaagttcggccgtctcgtacgtttcggggcgggggtaccagggtggagttacgaaacgtagtgtggctgcacatctcgtcttcattcctcccgctac

SEQ ID NO: 283984 - DNA, 544 bp, Homo sapiens
  misc_feature: GYAE6OF01BWQF5.14.57.F02.1.454.CMB.1.raw
  modified_base (366)..(366): a, c, t, g, unknown or other
  misc_feature (366)..(366): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcatcccacgaggggcccaccggcactccccagcccaggttcaggtggcaggcgggtctggggacngacttcactctcaccatcagcagcctagacgtctagaagtattttgactagtttattactgtcagcgaggcgggactaagttcggccgtctcgtacgttcgggcgggggaccgtagggtggtagtacgaaacgtacgtggtggctgcacatcgtcgttcttctatccttcccgctacg

SEQ ID NO: 283985 - DNA, 517 bp, Homo sapiens
  misc_feature: GYAE6OF01DR19Y.14.57.F02.1.454.CMB.1.raw
  modified_base (507)..(507): a, c, t, g, unknown or other
  misc_feature (507)..(507): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggcccaccggcatcccagccaggttcagtggcagcgggtctgggacagacttcactctcaccatcagcagcctagagtctgaagtattttgctagtttattactgtcagcaggcgggctaagttggccgctcgtacgtttcgggcgggggtaccagggtggagttacgaacgacgtgtggcgtgcacatctgtcttcntctccgctac

SEQ ID NO: 283986 - DNA, 582 bp, Homo sapiens
  misc_feature: GYAE6OF01BF61T.14.57.F02.1.454.CMB.1.raw
  modified_base (200)..(200): a, c, t, g, unknown or other
  misc_feature (200)..(200): n is a, c, g, or t
  modified_base (306)..(306): a, c, t, g, unknown or other
  misc_feature (306)..(306): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaagngccacctctcctgcagggccagtcagagtgtcaacaccaacttacgcctggtttcagcagaagcctggccaggctcccaggctcctcatgtatgatgcactcccanacgggccaccggcaactcccagccaggttcagtcggcagcgggtctggggaccaggacttcacgtcgtcacctatcaagtcagcctagagtctagaagtatttcgactagtttattacgttgtctagtcgaggcgggtactaagttcggccgtcgtccgtacggtttcgggaccgggggtactaacgggtggtaacggttcgaaacggtacgtggtacggtcgtagacgtaccgagttcgttcgttacttaccgtattcccgttcccgcccgtacg

SEQ ID NO: 283987 - DNA, 586 bp, Homo sapiens
  misc_feature: GYAE6OF01B08WP.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgagggcccaccggcactcccagccaggttcagtggcaggcggtctgggacagtacttcactctcaccatcagcagcctagagtctagtaagtattttgactaagtttattactgtcagcaggcgggactaagttcggcccgtctaccgtaccggtttcggggaccgggggtaacgtaagggtcggtaacgttaccgaaacgtacgttggtcgggtccgtggacctacccgtaattccgttacgttccgtttacctagtttccccttccccggccttaacg

SEQ ID NO: 283988 - DNA, 511 bp, Homo sapiens
  misc_feature: GYAE6OF01EE49I.14.57.F02.1.454.CMB.1.raw
  modified_base (489)..(489): a, c, t, g, unknown or other
  misc_feature (489)..(489): n is a, c, g, or t
  modified_base (503)..(503): a, c, t, g, unknown or other
  misc_feature (503)..(503): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagccaggttcagtggcagcgggtctgggacagacttcactctcaccatcagcacgcctagagtctagaagtatttgctagtttattactgtcagcaggcgggcaagttggccgctctacgtttcgggcgggggacagggtggagttcgaaacgacgtgtcggntgcacatctgtctnctctccgc

SEQ ID NO: 283989 - DNA, 523 bp, Homo sapiens
  misc_feature: GYAE6OF01DW9VO.14.57.F02.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcagggccagtcagagtgtcaacaccaacttagcctggttcagcagagcctggccaggctccaggctcctcatgtatgatgcatcccanacgggccacggcatcccagccaggtcagtgcagcggtnggacngactcactcncacntcagcagcctagagtctgaagtatttgactagtttattactgtcagcgaggtcgggctaagtggcctcgtcgtacgttcgggacggggactagggtcggagttacgaaacgtacgtggtcggntggcaccgtatcgtacgtcttancttccgtcccgtac

SEQ ID NO: 283990 - DNA, 511 bp, Homo sapiens
  misc_feature: GYAE6OF01A5XJA.14.57.F02.1.454.CMB.1.raw
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctagaagtattttgctagtttattactgtcagcaggcgggctaagttggccgctcgtacgttcgggcgggggaccagggtggtagtacgaacgactggtgntgcacntctntcttnctctccgc

SEQ ID NO: 283991 - DNA, 516 bp, Homo sapiens
  misc_feature: GYAE6OF01BCIEU.14.57.F02.1.454.CMB.1.raw
  modified_base (305)..(305): a, c, t, g, unknown or other
  misc_feature (305)..(305): n is a, c, g, or t
  modified_base (491)..(491): a, c, t, g, unknown or other
  misc_feature (491)..(491): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccanagggccaccggcactcccagccaggttcagtggcagcgggtctgggacagacttcactctcaccatcagcagcctagagtctgaagtatttgactagtttattactgtcagcgaggcgggacaagttcggccgctcgacgtttcgggcggggacgaggtggagttacgaacgtactggtggctgcncatctgtcttcatccttcccgctac

SEQ ID NO: 283992 - DNA, 526 bp, Homo sapiens
  misc_feature: GYAE6OF01A632O.14.57.F02.1.454.CMB.1.raw
  modified_base (305)..(305): a, c, t, g, unknown or other
  misc_feature (305)..(305): n is a, c, g, or t
  modified_base (501)..(501): a, c, t, g, unknown or other
  misc_feature (501)..(501): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccaggctcccaggctcctcatgtatgatgcatcccanagggccaccggcatcccagccaggttcagtggcagcgggtctgggacagacttcactctcaccatcagcagcctagagtctagaagtattttgctagtttattactgtcagcaggcgggactaagttcggccgtctcgtacgtttcgggcgggggacgtaagggtggacgttacgaaacgtacgtggtggcgtgcnccatctgtcttcatcctcccgctac

SEQ ID NO: 283993 - DNA, 639 bp, Homo sapiens
  misc_feature: GYAE6OF01DADQQ.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatcccacagggccaccggcactcccagccaggttcagtggcaggcggtctgggacagacttcactctcacatcagcagcctagagtctgaagtatttgctagtttattactgtctagcgaggcgggactaagttcggacccgtcgtccgtaccggtttccggggaccggggggtaaccgtaacggggttacgggaacggtttaacccgaaaacgggtaaaccggttacgggtacggggtaccgttacgggtacccgtaacccgtaacgttcccgtttacggtttcccgttttacccgtaccgtttacccccgtttcccccggtccccgtttaacccgg

SEQ ID NO: 283994 - DNA, 685 bp, Homo sapiens
  misc_feature: GYAE6OF01DV151.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctatttaaagatgtccagtgtgaggtgcagctgttggaggtccgggggaggcttggtacgaggcccggggggtccctgacactctcctgtgcagcctcaggtattctatttttagcgaatatgccatgagcgtgggtccgccaggcctccgaggggagggctggagtgggtctcgagcaatcgaggttggttactaggtaggaagtactagttcggaccgtcccgtcgtccggtaggtaacgggtcccggtttctaccctattccctaccgaagacgaacctaaacttacccaaagtaacctaacttaccttaacttttaccttaacgaaaagttcggaacctaaggtacccgtaagaaaacggaacggaaacgaccggtaacgggtacgtttagtttaagtttttgaggtaagtaaagtagtaaacggtaagttaccttaagtacgtaacgttaaacccgttaaaggttttacgggggaacgggttcccttttagaacggtttggtccggtacggggg

SEQ ID NO: 283995 - DNA, 542 bp, Homo sapiens
  misc_feature: GYAE6OF01EAVCV.14.57.F02.1.454.CMB.1.raw
  modified_base (531)..(531): a, c, t, g, unknown or other
  misc_feature (531)..(531): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattcatttttagcgaatatgccatgagctgggtccgccaggctccgaggggaggggctgggagtgggtctcagcaatcagtggttctagtggaagtacattcgacgccgtctccgtgaagggccgttctccatctccagagacaattccaagacactctatttcttacaaatggacagcctagaaagacgaagacgacgggcgttgttattttgtgtagaaagataacgaagtctatgatacccaagtttcgggagggtctttnattgtgtgggg

SEQ ID NO: 283996 - DNA, 587 bp, Homo sapiens
  misc_feature: GYAE6OF01DPTRU.14.57.F02.1.454.CMB.1.raw
  modified_base (355)..(355): a, c, t, g, unknown or other
  misc_feature (355)..(355): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgctccaggggaaagagccaccctctcctgcagggccagtcagagtgtcaacaccaacttagcctggttcagcagaagcctggccaggctcccgaggcctcctcatgtatgatgcactcccacgagggcccaaccggcactccccagccaggttcaggtggcaggcgggtntgggacagcttcgactctcaccatcagtcacgcctagacgtctagtaagttattttcgacttagttttacttacttgttcaagtcgaagggtcggggactaacggttcggcccgtacgtccgtaaccggtttcgggaccggggggtactaaggggtcgggaacgtttacgaaacggtaacgtggtacgggctagcacctagtcttcgttccttcacttcccttcccgctacg

SEQ ID NO: 283997 - DNA, 550 bp, Homo sapiens
  misc_feature: GYAE6OF01C3GZB.14.57.F02.1.454.CMB.1.raw
  modified_base (370)..(370): a, c, t, g, unknown or other
  misc_feature (370)..(370): n is a, c, g, or t
  modified_base (375)..(376): a, c, t, g, unknown or other
  misc_feature (375)..(376): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (405)..(405): a, c, t, g, unknown or other
  misc_feature (405)..(405): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaaacaccaacttagcctggttcagcagaagcctggccaggctcccaggctcctcatgtatgatgcatcccacgacggcccaccggcactcccagccaggttcagtggcaggcgggtctgggacagacttcactcncacgnngcgcncncgtcgctacgtgagtatttntntagttagtttattgtcgtagctagtataataactcgtcgtccgtcggtacggtcggtcgaacggaacggacgtaaggtaacgtaacaacgaacgtacgtggtacgcgtcgacctactcttcgtattcctactccttcccgtaccc

SEQ ID NO: 283998 - DNA, 535 bp, Homo sapiens
  misc_feature: GYAE6OF01BQBHV.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggcccaccggcatcccagccaggttcaggtggcagcgggtctgggacagacttcactctcacatcagcagcctagagtctagaagtatttgctagtttattactgtcagcgagcgggctaagttcggccgtcgtcgtaccgtttcgggcgggggtaccgagggtggtagttacgaaacggaacgtggtcggctgcaccagtctcgtcttcactccgttcccgcc

SEQ ID NO: 283999 - DNA, 602 bp, Homo sapiens
  misc_feature: GYAE6OF01EHXQI.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggcctcctcatgtatgatgcatccccagacgggccaccggcactcccagccaggttcagtggcaggcgggtctgggacagacttcactctcacatcagcagcctagacgtctagtaagtattttgacttagtttattactgtcagcgaggcgggacaagttcggccgtcgtccgtaccggtttcggggacggggggtaccgtaaggggtcgggtaacggttaccgaaaacggtaacgttggtacgggtaccgttacggacctaacccgtaagttccgttcggttaccctttaccgtactttcccgttccccggtacccg

SEQ ID NO: 284000 - DNA, 520 bp, Homo sapiens
  misc_feature: GYAE6OF01DYC8M.14.57.F02.1.454.CMB.1.raw
  modified_base (494)..(494): a, c, t, g, unknown or other
  misc_feature (494)..(494): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagccaggttcagtggcagcggtctgggacagacttcactctcaccatcagcagcctagagtctagaagtatttgactagtttattactgtcagcgaggcgggcaagttcggccgctcgtacgtttcgggcggggaccaagggtggtacgtacgaacgactgtcggctgcncatctgtcttcattcctcccgctacg

SEQ ID NO: 284001 - DNA, 602 bp, Homo sapiens
  misc_feature: GYAE6OF01CKTA0.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaaggggaaagacgccaccctctcctgcagggccagtcagagtgtacaacaccaacttagcctggttcagcagaagcctggccaggctccaggcctcctcatgtatgatgcatcccacaggccaccggcatcccagccaggttcagtggcaggcgggtctgggacagtacttcactctacacatcagcagacctagagtctagtaagtattttgactagtttattactgtcagctaggcgggactaagttcggccgtcgtccgtacggtttccggggacggggggtaaccgtaaggggtacgggaacgttacgaaaaccggtaaacgtacggtacgggcgttacggacctaacccgtagttaccgtttacggttacctttaccgtaactttccctttccccggccttaacg

SEQ ID NO: 284002 - DNA, 503 bp, Homo sapiens
  misc_feature: GYAE6OF01CAWY1.14.57.F02.1.454.CMB.1.raw
  modified_base (480)..(480): a, c, t, g, unknown or other
  misc_feature (480)..(480): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatccccagccaggttcagtggcagcgggtctggggacagacttcactctcaccatccagcagcctagagtctgaagtatttgctagtttattactgtcagcaggcgggcaagttggcgctcacgtttcgggcggggacaggtgagtcaagactgtggctgcncatctgtcttcatcttccgctac

SEQ ID NO: 284003 - DNA, 543 bp, Homo sapiens
  misc_feature: GYAE6OF01D93AL.14.57.F02.1.454.CMB.1.raw
  modified_base (366)..(366): a, c, t, g, unknown or other
  misc_feature (366)..(366): n is a, c, g, or t
  modified_base (510)..(510): a, c, t, g, unknown or other
  misc_feature (510)..(510): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaacttagcctggtttcagcagaagcctggccaggcctcccaggctcctcatgtatgatgcatcccagacgggcccaccggcactccccagcccaggttcaggtcggcaggcgggtctgggacngacttcactctcaccatcagcagcctagagtctagtaagtatttgctagtttattactgtcagcgaggcgggctaagttcggccgtctcgtacgtttcgggacgggggtacgagggtggacgttacgaaacgtacgtggtcggntgcactatcttcgtcttacacttcctcccgtac

SEQ ID NO: 284004 - DNA, 422 bp, Homo sapiens
  misc_feature: GYAE6OF01BBJAH.14.57.F02.1.454.CMB.1.raw
  modified_base (415)..(422): a, c, t, g, unknown or other
  misc_feature (415)..(422): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggccatcggtcttccccctggcaccctcctccaagacgcacctctggggcacagcggccctgggctgcctggtcaagggactacttccgtactagacgctgagcggctggcaaggcgcatagnnnnnnnn

SEQ ID NO: 284005 - DNA, 539 bp, Homo sapiens
  misc_feature: GYAE6OF01B6WFU.14.57.F02.1.454.CMB.1.raw
  modified_base (202)..(202): a, c, t, g, unknown or other
  misc_feature (202)..(202): n is a, c, g, or t
  modified_base (432)..(432): a, c, t, g, unknown or other
  misc_feature (432)..(432): n is a, c, g, or t
  modified_base (526)..(526): a, c, t, g, unknown or other
  misc_feature (526)..(526): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagagcctggccaggcctcccaggctcctcatgtatgatgcatcccagacgggcccaccggcactcccagccaggttcagtggcaggcgggtctgggacagacttcactctcaccatcagccagcctagagtctagaagtatttgctagtttattactgtcagcaggcgggnagttggccgtcgtcgtacggtttcgggcgggggaccgagggtggtaggttacgaaacggtacgtggtggtctcggcacctattcgtcgtcttancttccgtcccgtc

SEQ ID NO: 284006 - DNA, 588 bp, Homo sapiens
  misc_feature: GYAE6OF01A7UPF.14.57.F02.1.454.CMB.1.raw
  modified_base (379)..(379): a, c, t, g, unknown or other
  misc_feature (379)..(379): n is a, c, g, or t
  modified_base (402)..(402): a, c, t, g, unknown or other
  misc_feature (402)..(402): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagagcctggccaggctcccaggctcctcatgtatgatgcactccccacgacgggcccaccggcactccccagccaggttcaggtggcaggcgggtctgggacagacttcactctcacntcagcagctagagtctagtaatntttgctagtttatactgtcagcgaggcgggactaagttcggaccgtcgtccgtacggtttccggggaccgggggtaccgtaagggtcggtacggttaccgaaacggtaacgtcgggtacgggacctacggacctaaccgtacgttaccgttcgttacccgttacctacttcccgttccccgtaccg

SEQ ID NO: 284007 - DNA, 298 bp, Homo sapiens
  misc_feature: GYAE6OF01BBCGB.14.57.F02.1.454.CMB.1.raw
  modified_base (292)..(298): a, c, t, g, unknown or other
  misc_feature (292)..(298): n is a, c, g, or t
tcagcgtctagtaccacgaccggtgctcgatttagctcgatatagttgggtttgggggccaccggcatcccagccaggttcagtggcagcgggtctgggacagacttcactctcaccatcagcagcctagagtctgaagattttgcagtttattactgtcagcagcgggcaattggccgctcactttcggcgggggaccaaggtggagttcaaacgaactgtggctgcaccatctgtcttcatcttcccgcatctgagtactagacgctgagcggctggcaaggcgcatagnnnnnnn

SEQ ID NO: 284008 - DNA, 553 bp, Homo sapiens
  misc_feature: GYAE6OF01CLB93.14.57.F02.1.454.CMB.1.raw
  modified_base (201)..(201): a, c, t, g, unknown or other
  misc_feature (201)..(201): n is a, c, g, or t
  modified_base (432)..(432): a, c, t, g, unknown or other
  misc_feature (432)..(432): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaaggggaaanacgccaccctctcctgcagggccagtcagagtgtcaacaccaacttagcctggttcagcagaagcctggccaggctccaggctcctcatgtatgatgcactcccacgaggcccaccggcactcccagccaggttcagtggcaggcgggtctggggacagacttcactctacaccatcagccagctagagtctagaagtatttgactagtttattactgtcagcaggcgggntaacgttcggccgtcgtccgtacggtttcgggacgggggtacgaagggtacggtacgtacgtaaacgtacgtggtacggcgtagacaccgactctcgtacttctacttccttcccgctacg

SEQ ID NO: 284009 - DNA, 727 bp, Homo sapiens
  misc_feature: GYAE6OF01C8PCO.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgagggaaagagccaccctctcctgcgagggccaggtcagagtgtacaacaccaacttagcctggtttcagcagaagccgtggaccacggcctcccgaggcctcctcatgtatgatgcactcccacgacgggccaccggccactaccccgacggcccgtacggttcgaggtcggcgacggtcgggtcgtggggacacggtacttcacgtctaccaccactcgaacgtcacgtccgtagtacgtacgtagtaagttagttttagtacgttaagttttattaaccgttggtacgtacggtacgaacgggtacggggtactaacggttcgggtacccgtaccgttaccgggttaaccggggtttccgggggaaccgggggggttaaccgtaaacggggttacgggttaaccggttaaaccggtaaacggtaaaccggttacgggtacgggtaccgttaggacccgtaaacccgttagtttccggtttacccgttccgtttaccgtacccgtttacccgtttccccgtcctttaacccgg

SEQ ID NO: 284010 - DNA, 531 bp, Homo sapiens
  misc_feature: GYAE6OF01CCFXM.14.57.F02.1.454.CMB.1.raw
  modified_base (308)..(308): a, c, t, g, unknown or other
  misc_feature (308)..(308): n is a, c, g, or t
tcagcgtctagtaccacgaccggtgctcgatttagctcgatatagttgggtttggggggaactgctcagttaggacccagaggggaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggctcctcatgtatgatgcatcccanacgggccaccggcatccccagccaggttcagtggcaggcgggtctggggacagacttcactctcaccatccagcagcctagagtctgaagtattttgctagtttattactgtcagcagcgggacaagttcggccgtctccgtacgtttcgggcgggggtaccgaagggtggagttcgaaacgtacgtgtggctgcaccgatctgtcttcatccttcccgctac

SEQ ID NO: 284011 - DNA, 510 bp, Homo sapiens
  misc_feature: GYAE6OF01B9MB6.14.57.F02.1.454.CMB.1.raw
  modified_base (505)..(505): a, c, t, g, unknown or other
  misc_feature (505)..(505): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgagactctcctgtgcagcctctggattcgtctttagcagctatgccatgagctgggctcgccaggctccgagggaagggctggagtgggtctctgctattcctggcaggtggtgatatcgaatactacgcagactcgtgaagggccgttcactgttccagagacaattccaagaacacactgtatctgcagatgaccagcctgagagccgaggacacggctatattactgtgcgaaacgcaagtacttttggagttgttattnttacg

SEQ ID NO: 284012 - DNA, 600 bp, Homo sapiens
  misc_feature: GYAE6OF01DYFEG.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtcctgacactctcctgtgcagcctcaggattctatttttagcgaatatgccatgagcgtgggtccgccgaggctccgaggggaagggctgggagtggtctcagcaatcgagtggttctagtaggaagtactagttccggacgccgtctccggtggaacgggtccggttctccactcctccgaagagaacaacttaccaaagtaacctactacttactttcttacaaagtgacacgccgtagaaacggaacgaacgacgtacggtcgttagttagtttttagtgtaagtaaagataacggtaagtcttaagtagtaactacccgtaaagtttggggacgggtcctttagagttgtcggtacgggg

SEQ ID NO: 284013 - DNA, 588 bp, Homo sapiens
  misc_feature: GYAE6OF01EEOVM.14.57.F02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
  modified_base (372)..(372): a, c, t, g, unknown or other
  misc_feature (372)..(372): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccagtcagagtgcaacaccaacttagcctggtttcagcagaagcctggccaggctcccaggctcctcatgtatgatgcatccccacgacgggcccaccggcactccccagccaggttcaggtggcaggcgggtcngggacagcttcactcncaccatcagcagcctagagtctagtaagtatttgactagtttattactgtacagcgaggcgggctaagttcggccgtcgtccgtacggtttccggggacggggggtaaccgtaaggggtcggtaaggttaccgaaaacggtacgttggtacgggtcgtacggacctacccgtagttccgttcggttccttacctacgtttcccgttccccgtaccc

SEQ ID NO: 284014 - DNA, 566 bp, Homo sapiens
  misc_feature: GYAE6OF01DIT6O.14.57.F02.1.454.CMB.1.raw
  modified_base (305)..(305): a, c, t, g, unknown or other
  misc_feature (305)..(305): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccanagggcccacggcatcccagccaggtcagtggcagcgggtctggggacagacttcactctcaccatcagcagcctagagtctgaagtattttgactaagtttattactgtcagctaggcggggctaagttggacccgtctccgtacggtttcgggcggggggtaccgaagggtcggacgtttacgaaacggaaacgttggtacgggtctaggaccaccaagttccgttcgttccgttactattcccgttccccgtccctaac

SEQ ID NO: 284015 - DNA, 624 bp, Homo sapiens
  misc_feature: GYAE6OF01CQPM0.14.57.F02.1.454.CMB.1.raw
  modified_base (199)..(199): a, c, t, g, unknown or other
  misc_feature (199)..(199): n is a, c, g, or t
  modified_base (311)..(311): a, c, t, g, unknown or other
  misc_feature (311)..(311): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgctcagggaangccaccctctcctgcagggccagtcagagtgtacaacaccaacttagccttggttcagcaaggaagcctggccaggcctcccgaggcctcctcatgtatgatgcactcccancgggccacgcatcccagccaggtcagtcggacaggcgggtctgggacagtaccttcgactctacaccatcagcacgacctagacgtcgtagtaagtattttagacttagttttacttacgttgtacgagtcgtacggtacggggactaacggtcggtacccgtcgtaccgtaccggtttccggggaccggggggtaaccgtacgggtacgggtaacgttaccggaaaacggtaccgtgggttcggaccgttacggccgtaacccgtacgttccgttacgttacttaccgtaacgttcccgttccccggtaccg

SEQ ID NO: 284016 - DNA, 425 bp, Homo sapiens
  misc_feature: GYAE6OF01A142Q.14.57.F02.1.454.CMB.1.raw
  modified_base (416)..(425): a, c, t, g, unknown or other
  misc_feature (416)..(425): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcacccctcctccaagacgcacctctggggcacagcggccctgggctgcctggtcaaggctacttccgtactagacgctgagcgggctggcaaggcgcatagnnnnnnnnnn

SEQ ID NO: 284017 - DNA, 560 bp, Homo sapiens
  misc_feature: GYAE6OF01DZB3S.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactcttgctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggctcctcatgtatgatgcatcccacgacgggccaccggcactcccagccaggttcaggtggcaggcgggtctggggacaggtactcactctacaccatcagcagcctagagtctagtaagtatttgtactagtttattacttgtacagtcgaggcgggactaagttcggccgtcgtcgtacggtttcggggcgggggtaccgtagggtcggtacgttacgaaacggtaacgtggtcggctggcaccgtatcgtcgttcttctacttccgttcccgtc

SEQ ID NO: 284018 - DNA, 534 bp, Homo sapiens
  misc_feature: GYAE6OF01AJ20B.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcaggcgggtctgggacagacttcactctcaccatcagcagcctagagtctgaagtattttgcttagtttattactgtcagcgaggcgggctaagttcggccgctcgtacgtttccgggcgggggaccgagggtggacgttcgaaacgtacgtggtcggctgcaccatcgtcgtcttcacttccgttcccgtcc

SEQ ID NO: 284019 - DNA, 600 bp, Homo sapiens
  misc_feature: GYAE6OF01C3500.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatcccagacgggcccaccggcactcccagccaggtcaggtgcaggcggtctgggacagacttcactctcaccatcagcagcctagacgtcgtagtaagtagttttgacgttagtttacttacgtgtacagcgaggcgggtactaaggttcggccgtacgttccgtacggtttccggggacgggggtaaccgtaaggggtacggaacggttaaccgaaaaccggtacgtagggtcggcgttaggaccgtacctagttccgttcgttaccttactaccttcccttccccgtccgttaacg

SEQ ID NO: 284020 - DNA, 568 bp, Homo sapiens
  misc_feature: GYAE6OF01AK147.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcactcccacacggggccaccggcactccccagccaggttcaggtggcaggcgggtctggggacagacttcactctcaccatcagcagcctagagtctagtaagtatttgctagtttattactgtcagcgaggcgggctaagttcggccgtcctcgtaccggtttcggggaccggggggtactaaggggtggtacgttacgaaacggtacgtggtacggtcgtagaccgaccgtatccgtgttccttacattcccgttcccgtcctacg

SEQ ID NO: 284021 - DNA, 634 bp, Homo sapiens
  misc_feature: GYAE6OF01B4XFL.14.57.F02.1.454.CMB.1.raw
  modified_base (286)..(286): a, c, t, g, unknown or other
  misc_feature (286)..(286): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggctccncatgtatgatgcatcccacacggcccaccggacactccccagccctaggttcaggtggcaggcgggtcgtgggacagacttcgactctcaccatcagcagcctagacgtctaggaagtattttgactaagttttattaacgttgtacgtagcgtacggcggggtactaaggtttcgggtcgtaccgttcgtaaccgggttttccggggaccggggggtaaccgtaagggttacgggaacggtttacgaaacggtaaccgttaggtacgggtaccgtacggacctacccgtaagttcccgttacggttcctttaccgtaaccgtttcccgtttaccccgcccttaaccg

SEQ ID NO: 284022 - DNA, 550 bp, Homo sapiens
  misc_feature: GYAE6OF01BQ4JP.14.57.F02.1.454.CMB.1.raw
  modified_base (524)..(524): a, c, t, g, unknown or other
  misc_feature (524)..(524): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccgaggctcctcatgtatgatgcactcccacgaggggcccaccggcactccccagcccgaggttcaggtggcaggcgggtctgggacagacttcactctcaccatcagcagcctagagtctagaagtattttgctagttttattactgtcagcgaggcgggactaagttcggcctcgtcgtacgtttcggggcgggggtaacctaagggtggtacgttacgaaacgtagtggtggctggccacgntcttgtcttcacttcctcccgctacg

SEQ ID NO: 284023 - DNA, 546 bp, Homo sapiens
  misc_feature: GYAE6OF01BU1X1.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggctcctcatgtatgatgcatcccacagggcccaccggcactcccagccaggttcagtggcaggcgggtctggggacagacttcactctcaccatcagcagcctagagtctgaagtatttgctagtttattactgtcagcagcgggctaagttcggccgctcgtaccgtttcggggcggggggtaccaagggtggtaggtacgaaacggacgtggtcggctaggccaccgatcgtcgtccttacgtacttcccttcccgcctacg

SEQ ID NO: 284024 - DNA, 539 bp, Homo sapiens
  misc_feature: GYAE6OF01EJGT5.14.57.F02.1.454.CMB.1.raw
  modified_base (506)..(506): a, c, t, g, unknown or other
  misc_feature (506)..(506): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgagggccaccggcatcccagccaggttcagtggcagcgggtctgggacagacttcactctcaccatcagcagcctagagtctagaagtatttgactagtttattactgtacagcgaggcgggactaagttcggccgtctcgtacgtttcgggcgggggtacaagggtggacgttacgaaacgtacgtggtggtctgacnccgtatcgtcgtcttacacttcctcccgctacg

SEQ ID NO: 284025 - DNA, 565 bp, Homo sapiens
  misc_feature: GYAE6OF01CTMP8.14.57.F02.1.454.CMB.1.raw
  modified_base (203)..(203): a, c, t, g, unknown or other
  misc_feature (203)..(203): n is a, c, g, or t
  modified_base (384)..(384): a, c, t, g, unknown or other
  misc_feature (384)..(384): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgccagggccagtcagagtgtacaacaccaacttagcctggtttcagcagaagcctggccaggcctcccaggcctcctcatgtatgatgcactcccacgacgggccaccggcactcccagccaggttcaggtcggcaggcgggtctgggacagacttcactctcaccntcagcagcctagacgtctagtaagtagttttagacttagttttatactgtcagtcgaggcgggactaacgttcggacctacgtcgtacgtttcgggacgggggtacctagggtcggtaagttacgaaacgtacgtggtcggtctggacacgatcgtcgttacttctacttccgttcccgcc

SEQ ID NO: 284026 - DNA, 559 bp, Homo sapiens
  misc_feature: GYAE6OF01CXBIS.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagagcctggccaggctcccaggctcctcatgtatgatgcatcccagacgggcccaccggcatccccagccaggttcaggtggcaggcgggtctgggacagacttcactctcaccatcagcagcctagacgtctagaagtattttgactaagttttattattgtctagtctagtaataataacgtggtacctcgtaggtacgttcggaccgtaacgggaccgtaagggtacggaaactacgaaacgtaacgtaggtggtctaggaccacctatcgttcgtcttactacttccgttcccgac

SEQ ID NO: 284027 - DNA, 412 bp, Homo sapiens
  misc_feature: GYAE6OF01C9EVP.14.57.F02.1.454.CMB.1.raw
  modified_base (297)..(297): a, c, t, g, unknown or other
  misc_feature (297)..(297): n is a, c, g, or t
  modified_base (408)..(412): a, c, t, g, unknown or other
  misc_feature (408)..(412): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctaatgatacccaatttgggaggggcctttcatgtctggggcaagggacgctggtcacgtctcttcagcctccaccaagggccancggtctcccctggcaccctcctccaagagcacctctggggcacagcggccctgggctgctggtcaaggactacttccgactagacgctgagcggctggcaaggcgcatagnnnnn

SEQ ID NO: 284028 - DNA, 554 bp, Homo sapiens
  misc_feature: GYAE6OF01EX2H5.14.57.F02.1.454.CMB.1.raw
  modified_base (391)..(391): a, c, t, g, unknown or other
  misc_feature (391)..(391): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacagccggggggtccctgacactctcctgtgcagcctcaggattcatttttagcgaatatgccatgagctgggtccgccaggctccgaggggaaggggctggagtgggtctcagcaatcagtgttctagtgaagtacattcgacgccgtctccgtgaagggccggttntccatctccagagacaattcaagaacactctatttctacaatggacagccagaaagacgaagacgacgggcttgttattttggtagtagaaagtagtaacgtaagtctataggacttaaccccgaagtttcgggacgggtacctttagattcggtgtacgggg

SEQ ID NO: 284029 - DNA, 570 bp, Homo sapiens
  misc_feature: GYAE6OF01C95VS.14.57.F02.1.454.CMB.1.raw
  modified_base (390)..(390): a, c, t, g, unknown or other
  misc_feature (390)..(390): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgacgggcccaccggcactcccagccaggttcagtggcaggcgggtctggggacagacttcactctcaccatcagcagctagngtactgaagtattttgacttagtttattactgtacagcgaggcggggactaagttcggccgtccgttcgtaccggtttcggggaccggggggaccgtaagggtcgggtaagttacgaaacggtaacgttggtcggtcgtagaccaccagttctcgttcttacattcccttcccgcctacg

SEQ ID NO: 284030 - DNA, 580 bp, Homo sapiens
  misc_feature: GYAE6OF01D4YZ9.14.57.F02.1.454.CMB.1.raw
  modified_base (408)..(408): a, c, t, g, unknown or other
  misc_feature (408)..(408): n is a, c, g, or t
  modified_base (546)..(546): a, c, t, g, unknown or other
  misc_feature (546)..(546): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcagggccagtcagagtgtacaacaccaacttagccttggttcagcagaagcctggccaggcctcccgaggctcctcatgtatgatgcactcccgagacggccaccggcactcccagccaggttcaggtggcaggcgggtcgtgggacagacttcactctcacatcagcacgtcctagagtctagaagttntttgacttagtttactacgtgtacagcgagggcggggtataaggttcggaccgtcttaccgttacggtttcgggggaccgggggtactacggggtggtaacgttacgaaacggtacgtggtacggctaggcctaccgnttccgtcgttacttcgtacttcccgtcccgtacc

SEQ ID NO: 284031 - DNA, 612 bp, Homo sapiens
  misc_feature: GYAE6OF01C43O5.14.57.F02.1.454.CMB.1.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (379)..(379): a, c, t, g, unknown or other
  misc_feature (379)..(379): n is a, c, g, or t
  modified_base (398)..(398): a, c, t, g, unknown or other
  misc_feature (398)..(398): n is a, c, g, or t
  modified_base (575)..(575): a, c, t, g, unknown or other
  misc_feature (575)..(575): n is a, c, g, or t
tcagcgtctagtaccacgaccggtgctcgatttagctcgatatagttgggtttggggaggaactgctcagttaggacccagagggaaccatggaagccccagctcagcttctcttcctctgctactctggctcccagataccaccggagaaattgtgttgacacagtcctccactccaccctgtctttgtctccgaaggggaaangcccaccctctcctgcagggccagtcaggagtgtacaacaccaattagccttggtttcagcagaacgccgtggccaggcctcccgaggtcctcctnatgtatgatcgacctactccccgagacgggcccaccggcacgtccccagcccaggttccaggtcggcagggcgggtcngggacagtactcgactccncaacatccagcgacgaccgtagacgtcgtagtaagttgtttagacttagtttacttacgtgtactagacgtaggcgggtactacggtcgccgtctacggtaccggttcggggacggggtaaccgtagggtacggtacgttaccgaaacgtacgtggtacggcgtacgcgtacccgtnttccgttcgtccttactaccgttcccgttcccgtacc

SEQ ID NO: 284032 - DNA, 539 bp, Homo sapiens
  misc_feature: GYAE6OF01DNBFV.14.57.F02.1.454.CMB.1.raw
  modified_base (373)..(373): a, c, t, g, unknown or other
  misc_feature (373)..(373): n is a, c, g, or t
  modified_base (514)..(514): a, c, t, g, unknown or other
  misc_feature (514)..(514): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccgaggcctcctcatgtatgatgcactcccacgacgggccaccggcactcccagccaggtcagtggcaggcggtctgggacagtacttcactcncaccatcagcagcctagacgtcgtagtaagttattttgacttagtttacttacgtgtcagcgaggcgggactagttcggccgtcgtcgtacggttcgggacggggtacagggtcgacgtacgaacgactgtcgctgctacntctcgtcttctactcctccgctacg

SEQ ID NO: 284033 - DNA, 597 bp, Homo sapiens
  misc_feature: GYAE6OF01D712F.14.57.F02.1.454.CMB.1.raw
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (399)..(399): a, c, t, g, unknown or other
  misc_feature (399)..(399): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggcctcctcatgtatgatgcatcccacgacgggcccaccggcactcccagccaggttcagtggcaggcggtctgggacagacttcactctcaccntcancagcctagcgtactgaagtntttgactagtttacttacgtgtcagcgaggcgggtactaagttcggccgtacgtaccgtaccggtttccggggacgggggtaaccgtaaggggtcggtaaggttaccgaaacggtaccgttagggtacggtccgttaggaccctaccgtacgttcgtacgttcctttacgtacctttacccgttcccccgccgttacg

SEQ ID NO: 284034 - DNA, 562 bp, Homo sapiens
  misc_feature: GYAE6OF01A8FN4.14.57.F02.1.454.CMB.1.raw
  modified_base (401)..(401): a, c, t, g, unknown or other
  misc_feature (401)..(401): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgcgggcccaccggcactccccagccaggttcaggtggcaggcgggtctgggacagacttcactctcaccatcagcacgcctagagtctgagtntttgctagtttatactgtcagcaggcgggctaagttcgggccgcgtcgtaccggttcggggaccgggggtaccgtagggtggtacgttacgaaacggtacgttggtcggtactggcctacctagttccgttcgttccttacctacttccgttccccgtacc

SEQ ID NO: 284035 - DNA, 584 bp, Homo sapiens
  misc_feature: GYAE6OF01DHHYY.14.57.F02.1.454.CMB.1.raw
  modified_base (200)..(200): a, c, t, g, unknown or other
  misc_feature (200)..(200): n is a, c, g, or t
  modified_base (369)..(369): a, c, t, g, unknown or other
  misc_feature (369)..(369): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttgccttggtttcagcagaagcctggccaggctcccaggcctcctcatgtatgatgcatcccagacgggccaccggcactcccagccaggttcagtggcaggcgggtctgggacagacttcactcncaccatcagcagcctagagtctagaagttattttgacttagtttattactgtcagcgaggtcgggactagttcggcctcgtaccgttacggttcggggaccgggggtaccgtaagggtacggtaacgttaaccgaaacggtacgtagggtcggtcgtaggacctaccgtacgttcgtacgtttccttaccgtactttcccttccccggccttacg

SEQ ID NO: 284036 - DNA, 629 bp, Homo sapiens
  misc_feature: GYAE6OF01BIY6G.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcagggccagtcagagtgtcaacaccaacttagcctggtttcagcagaagcctggccaggctcccgaggcctcctcatgtatgatgcactcccacgacgggcccacggcactccccagccaggttcaggtggcaggcggtctgggacagacttcactctcaccatcagcacgctagagtctagaagtatttgcttagtttattacgtgtacagtcgaggcggggtactaagtttcggtccgtcgttacgtaccgggttttccggggaccggggggtaaccgtaaggggttacgggtaacgttaccgaaaacggtaaccgttagggtacgggtaccgtacggacccgtaacccgtagttccgttacggtttccctttaccgttaccgtttcccgtttaccccggtccgttaaccg

SEQ ID NO: 284037 - DNA, 649 bp, Homo sapiens
  misc_feature: GYAE6OF01A42NW.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagagctggccaggctccaggctcctcatgtatgatgcatcccacgacgggcccaccggcactccccgagccctaggttccaggtggccaggcgggtctgggacaggaccttcactctcaccatccagcagcctagacgtctagtaagtattttgacttaagttttaactttacttgtacaggtaccgagggtccggggtactaagtttcgggcccgtacgttccgtaccggttttccggggaccgggggtaaccgtaaggggttcgggtaacggttaccgaaaaccggtacgttcgggtacgggtaccgttacggaccgtacccgtaagttccccgtttaggttacccctttaccgtaaccgtttcccccgtttccccgggcccttaacgg

SEQ ID NO: 284038 - DNA, 568 bp, Homo sapiens
  misc_feature: GYAE6OF01BONZ1.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcactcccacgacgggcccaccggcactccccagccaggttcaggtcggcaggcgggtctgggacagacttcactctcaccatcagcagcctagagtctagaagtatttgcttagtttattactgtcagcgaggcgggactaagttcggccgtctcgtaccggtttcggggaccgggggtaccgaagggtacggtacggttacgaaacggtacgtggtacggcgtggaccaccgattcgttcgttcttctacttcccttcccgcctacg

SEQ ID NO: 284039 - DNA, 602 bp, Homo sapiens
  misc_feature: GYAE6OF01AHFWJ.14.57.F02.1.454.CMB.1.raw
  modified_base (200)..(200): a, c, t, g, unknown or other
  misc_feature (200)..(200): n is a, c, g, or t
  modified_base (383)..(383): a, c, t, g, unknown or other
  misc_feature (383)..(383): n is a, c, g, or t
  modified_base (416)..(416): a, c, t, g, unknown or other
  misc_feature (416)..(416): n is a, c, g, or t
  modified_base (598)..(598): a, c, t, g, unknown or other
  misc_feature (598)..(598): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagccttggttcagcagaagcctggccaggcctcccaggcctcctcatgtatgatgcatcccacgagggcccaccggcactcccagccaggttcagtcggcgaggcgggtctgggacagtacttcactctaccacctancacgcgacgtacgtagtacgtacgtagtagttntttcgtacttagttttactacgttgtacgagcgagggtcgggtactaacggtccggcccgtcgttaccggtaccgggttcgggggaccggggtacgtaggggtacgtaacgtaacgaacggttacgtgggtacgtcgtacgccacgtcgttccttcgttccttactacccttccgttccctntacg

SEQ ID NO: 284040 - DNA, 535 bp, Homo sapiens
  misc_feature: GYAE6OF01AV0W3.14.57.F02.1.454.CMB.1.raw
  modified_base (474)..(474): a, c, t, g, unknown or other
  misc_feature (474)..(474): n is a, c, g, or t
  modified_base (523)..(523): a, c, t, g, unknown or other
  misc_feature (523)..(523): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccggggggtccctgacactctcctgtgcagcctcaggattcatttttagcgaatatgccatgagctgggtccgccaggctccgagggaaggggctgggagtgggtctcagcaatcagtggttctagtggaagtacattcgacgccgtctccgtgaagggccggttctccatctccagagacaattccaagaacactctatttctcaatgacagcctagaaagacgaagacacgggctgtattttgngtagaagatacgaagtctatgactaccctaagtttgggagggtccttanatgtcgtcgggg

SEQ ID NO: 284041 - DNA, 621 bp, Homo sapiens
  misc_feature: GYAE6OF01EWYFY.14.57.F02.1.454.CMB.1.raw
  modified_base (541)..(541): a, c, t, g, unknown or other
  misc_feature (541)..(541): n is a, c, g, or t
tcagcgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgtggacaggacccttggtccttccggcgagcgggtcttttcacccgtctttatcgttacttatgtcagctatttccgctactttctcgacttaccctccagcatcgccctcacagccacaccttcacaggccttaacgacgaaccgccctacccctaacccaacaaccgcaataacgccgtcgctcgcccgcacgtcgttcgggtncctagtttcggtttaccgtcccccgttttcacctttcccgttccccgacctacgttcctaggtacgttacgtaggtaccg

SEQ ID NO: 284042 - DNA, 518 bp, Homo sapiens
  misc_feature: GYAE6OF01BFKQC.14.57.F02.1.454.CMB.1.raw
  modified_base (308)..(308): a, c, t, g, unknown or other
  misc_feature (308)..(308): n is a, c, g, or t
  modified_base (493)..(493): a, c, t, g, unknown or other
  misc_feature (493)..(493): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacngggccaccggcatcccagccaggttcagtgcagcgggtctgggacagacttcactctcaccatcagcagcctagagtctgtaagatttgctagtttatactgtcagcaggcgggcaagttcggccgtctcgacgttcgggcgggggaccaagggtggagttacgaaacgtacgtggtggctgccncatcgtcgtctcatcttcccgctac

SEQ ID NO: 284043 - DNA, 549 bp, Homo sapiens
  misc_feature: GYAE6OF01B91IC.14.57.F02.1.454.CMB.1.raw
  modified_base (352)..(352): a, c, t, g, unknown or other
  misc_feature (352)..(352): n is a, c, g, or t
  modified_base (434)..(434): a, c, t, g, unknown or other
  misc_feature (434)..(434): n is a, c, g, or t
tcagcgtctagtaccacgaccggtgctcgatttagctcgatatagttggttttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggctcctcatgtatgatgcatcccacgacgggccaccggcactcccagcccaggttcaggtggcagcgggtntgggacagacttcactctcaccatcagcagcctagagtctagaagtattttgctagtttattactgttcagcaggcgggtanaagttcggccgtacgtcgtaacgtttccgggacgggggacaagggtcggagttacgaaacgtacgtgtacggtcgtagcgacacgtactcgttcttactatccttcccgcctacg

SEQ ID NO: 284044 - DNA, 618 bp, Homo sapiens
  misc_feature: GYAE6OF01EHZX8.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagacgcccaccctctcctgcgagggccagtcagagtgtacaacacaacttagcctggttcagcagaagctggccaggctcccaggcctcctcatgtatgatgcactcccacgacggcccacggcatccccagcctaggttcaggtggcaggcggtcgtgggactagtacttcactctccacctatcagcacgctagagtctagtagttattttgacttagtttattactggtactagcgtaggcgggtactaagttcgggcctacgtcggtacgtttcggggaccgggggtaccgtaagggtcggtaacgttaacggaaacggtacgttacgggtcggaccgttacggaccaaccgttacgttaccgttacggttaccctttaccgtaccgtttaccccgtttccccggaccttaacg

SEQ ID NO: 284045 - DNA, 588 bp, Homo sapiens
  misc_feature: GYAE6OF01CF0TX.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctccgaggcctcctcatgtatgatgcactcccagcgggccaccggcactcccagccaggttcaggtcggcaggcgggtctggggacacggtacttcgactctcaccgatcgagcacgcctagagtctagtaagtatttgacttaagtttactacgtgtcagcgagacgggtactaagttcggccgtcttcgtaccggtttcggggaccgggggtactaacggggtcggtaacgttaccgaaacggtacgtggtcggtacgtggacctaccagttccgttcgttccttacgactttcccgttcccgcgtaacg

SEQ ID NO: 284046 - DNA, 691 bp, Homo sapiens
  misc_feature: GYAE6OF01C5JCG.14.57.F02.1.454.CMB.1.raw
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggcttctttcttgtggcttattttaaaagatgtccagtgtgaggtgcagctgttggaggtccgggggagcttggtacgaggccgggggggtcctgacactctcctgtgcagcctcaggtattctatttttagacgtaatatcgccatgagtcgtcgggtcccgccgaggctaccgaggggaaggggctgggagtgggtctcgagacaatcgaggttcggttactaggtacggaaagtacgagttccgacggtccgttacgtccggttaggaacgggtcccggttacctccacgttcctaccgaagacgaactaaacgttaccaaaacgtaacctaacttacctttaacttttaccttaacgtaaaagttacggaaccaaggtacccgttaaaggaaacgggaacgaacggaaccgtaaccgggtcgttaagttttagttttgggagttaaggaaagtagtaaacgagttactagtacgtacttaacccgttaaaggtttcgggggtacgggttacctttagtagttcggtcggtacggggg

SEQ ID NO: 284047 - DNA, 579 bp, Homo sapiens
  misc_feature: GYAE6OF01DLR86.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggcctcccgaggcctcctcatgtatgatgcactcccacgcgggcccaccggcactccccgagccctaggttcaggtggccaggcgggtctggggacagtacttcgactctacacatcagcagccgtagagtctagagtatttgctagtttatactgtacagcgaggcgggtataacgttcggccgtcgtcgtaccggtttcggggaccgggggacctaaggggtaggtaacgttacgaaacggtacgtggtacggtccgtgcctaccgtagtcgttcgttccttactacttcccttcccgctacg

SEQ ID NO: 284048 - DNA, 529 bp, Homo sapiens
  misc_feature: GYAE6OF01BYOF1.14.57.F02.1.454.CMB.1.raw
  modified_base (309)..(309): a, c, t, g, unknown or other
  misc_feature (309)..(309): n is a, c, g, or t
  modified_base (498)..(498): a, c, t, g, unknown or other
  misc_feature (498)..(498): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggccaccggcatcccagccaggttcagtggcagcgggtctgggacagcttcactctcaccatcagcacgcctagacgtctagaagtatttgctagtttattacttgtcagcaggcggggctaagttcggccgctccgtacgtttcgggcgggggacagggtggtacgttcgaaacgacgtggtcggntcgcactatctgtcttcacttcctcccgtcc

SEQ ID NO: 284049 - DNA, 579 bp, Homo sapiens
  misc_feature: GYAE6OF01C95CQ.14.57.F02.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanacgggcccaccggcactccccagccaggttcagtggcagcgggtntgggacagacttcactctcaccatcagcagcctagacgtcgtagaagtattttgacttaagtttattaacgttgtcgagtcgaggtcgggctaagttcggccgtcttacgtaccgtttccggggcgggggtaacctaagggtggtaacgttaccgaaaacgtaccgtaggtcggcgtaggaccaaccgtattacgtcgttacctttacacttccttcccgtctaaccg

SEQ ID NO: 284050 - DNA, 553 bp, Homo sapiens
  misc_feature: GYAE6OF01CUL4K.14.57.F02.1.454.CMB.1.raw
  modified_base (487)..(487): a, c, t, g, unknown or other
  misc_feature (487)..(487): n is a, c, g, or t
  modified_base (538)..(538): a, c, t, g, unknown or other
  misc_feature (538)..(538): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttggagtccgggggaggcttggtacaggccgggggggtccctgacactctcctgtgcagcctcaggattctatttttagcgaatatgccatgagctgggtccgccaggctccgagggaaggggctggagtgggtctcagcaatcagtggttctaggtggaagtacattcgacgtcccgtctccgtgaagggcccgttctccatcctccagagacaacttccaaagaacactctatttctacaaatggacagcctagaaagacgaagacacgggctgttattttgngtagaaagatacgaagtctatagactacctaagtttgggacgggtcctttnactggtcgtacgggg

SEQ ID NO: 284051 - DNA, 528 bp, Homo sapiens
  misc_feature: GYAE6OF01DHV7S.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccagacgggccaccggcactccccagccaggttccagtcggcaggcgggtctgggacagacttcactctcaccatcagcagctagagtctgaagtatttgctagtttattactgtcagcgaggcgggacaagttcggccgtctcgtacgtttcgggacggggacgaggtggagttacgaaacgactggtggctgactacatcgtgtcttcattccgtcccgctac

SEQ ID NO: 284052 - DNA, 724 bp, Homo sapiens
  misc_feature: GYAE6OF01AOCSB.14.57.F02.1.454.CMB.1.raw
  modified_base (262)..(262): a, c, t, g, unknown or other
  misc_feature (262)..(262): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtccctgacactctcctgtgcagcctnaggattcatttttagcgaatatgccatgagctgggtccgccaggcctccgaggggaaggggcgtggagtgggtctcgagcaagtcagttggttctagtggaaagtcagttcgacgccgtctccgtgaacgggtccgttctccattcctaccagacgactaacgttacccaaaggtaacctaacctcgttaacttttaccgttacctaaaagtcggtaactacgtacccgttaaggaaaacgaaccggtaaaggaacccgtaacgggggtacccggtttaggttttaacgttttttacgggtacggttaaacgggtaaaagtaaacgttaaccggtaaaaagggtttaccgttaaagtttacgggtaaaaccttaaccccggttaaaaggtttttacggggggtaaccggggttacccgtttttaaccgacggtttcgggttaaccgggttaaccgggggggg

SEQ ID NO: 284053 - DNA, 560 bp, Homo sapiens
  misc_feature: GYAE6OF01D1FZF.14.57.F02.1.454.CMB.1.raw
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggactgagttggcttctttcttgtggctattttaaaagatttccagtgtgaggtgcagctgttggagtccgggggaggcttggtacaggccggggggtccctgacactctcctgtgcagcctcaggattcatttttagcgaatatgccatgagctgggtccgccaggctccgagggaaggggctggagtgggtctcgagcaatcgagtggttctaggtggaagtacattcgacgccgtcgtccgtgaacgggccgttctccatctcagagacaatccaagacactctatttcttacaatgacagcctagaagacgaagacacgggtntgttattttgngtagaaagatacgaagttctattagaacttaccctaagtttcggggacgggttcctttagagttcggtcggtcggggaccg

SEQ ID NO: 284054 - DNA, 576 bp, Homo sapiens
  misc_feature: GYAE6OF01EH8QC.14.57.F02.1.454.CMB.1.raw
  modified_base (207)..(207): a, c, t, g, unknown or other
  misc_feature (207)..(207): n is a, c, g, or t
  modified_base (368)..(368): a, c, t, g, unknown or other
  misc_feature (368)..(368): n is a, c, g, or t
  modified_base (418)..(418): a, c, t, g, unknown or other
  misc_feature (418)..(418): n is a, c, g, or t
tcagcgtctagtaccacgaccggtgctcgattttagctcgatatagtttggggtttgggggggaactgctcagttaggacccagagggaaccatggaagccccagctcagcttctcttcctcctgctactctggcctcccagataccaccggagaaattgtgttgacacagtctccactcaccctgtctttgtctccgaggggaaancgccaccctctcctgcagggccagtcagagtgcaacacctaacttagcctggtttcagcagaagcctggccaggcctcccaggcctcctcagttgtatgatcgcactcccgagacgggcccaccggcactccccgagccaggttcagtggcaggcgggtcngggacagacttcactctcaccatccgagcagcctagacgtctagtaagtnttttgacttagttttattactgtacagcgaggcgggtacagttcggcctacgtcgtacggtttcggggaccgggggtacaagggttcggaacgttacgaaaccgtacgtggttacggcttggaccctacgattcttgtcttcactccttcccgctacg

SEQ ID NO: 284055 - DNA, 624 bp, Homo sapiens
  misc_feature: GYAE6OF01B8E9I.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacgggccaccggcactcccagccaggtcagtggcagcgggtctgggacagacttcactctcaccatcagcagctagacgtctagaagtatttgctagtttattacttgtcagcgacggcggggtctaagttcggcccgtcgttaccgtaccggtttccggggaccggggggtaacccgtaaggggttacgggtaacggttaccgtaaaaccgggtaacgtacgggttacgggccgttacggacccgtaacccgtacgttcccgttacggttccctttaccgttaccgtttccccgtttcccccggtcccttaacccg

SEQ ID NO: 284056 - DNA, 528 bp, Homo sapiens
  misc_feature: GYAE6OF01CWVID.14.57.F02.1.454.CMB.1.raw
  modified_base (292)..(292): a, c, t, g, unknown or other
  misc_feature (292)..(292): n is a, c, g, or t
  modified_base (353)..(353): a, c, t, g, unknown or other
  misc_feature (353)..(353): n is a, c, g, or t
  modified_base (505)..(505): a, c, t, g, unknown or other
  misc_feature (505)..(505): n is a, c, g, or t
  modified_base (514)..(514): a, c, t, g, unknown or other
  misc_feature (514)..(514): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtacaacaccaacttagccttggttcagcagaagcctggccaggctcccaggcctcctnatgtatgatgcactcccacacgggccacggcatcccagccaggttcagtggcaggcgggtngggacagacttcactctcaccatcagcagcctagagtctagaagtattttgactagtttattactgtcagcaggcgggactaagttcggccgtctcgtacgtttcgggcggggtacgagggtggagtacgaaacgacgtggtggctgcactntctcgtctntactccgttcccgc

SEQ ID NO: 284057 - DNA, 558 bp, Homo sapiens
  misc_feature: GYAE6OF01AW49V.14.57.F02.1.454.CMB.1.raw
  modified_base (201)..(201): a, c, t, g, unknown or other
  misc_feature (201)..(201): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggttcagcagacgcctggccaggctcccaggctcctcatgtatgatgcactcccacgacgggcccaccggcactcccgagccaggttcaggtgcgagcgggtctgggacagtacttcactcncaccntcagcagcctagacgtctagaagtatttgacttagtttattacgtgtcgagcgaggcgggtactaagttcggccgtctccgtacggttccggggcggggtaccgagggtcggtacgtacgtaacggacgtggtggtcgtgacgtacgtcgtctcgttactctactccgttcccgtctacg

SEQ ID NO: 284058 - DNA, 662 bp, Homo sapiens
  misc_feature: GYAE6OF01EBCGY.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcacctgtctttgtctccgaggggaagacgccaccctctcctgcagggccagtcagagtcgtcaacacctaacttagccttggtttcagcagaagccgtggccaggcctcccgaggctcctcagtgtatgatgcactcccgagacgggccaccggcactcccagccgtaggttcagtcggcgaggcgggtctgggactacggtacttccgactcctacaaccgtatccgagcacgtaccgtagtacggtactaggtaagttacgtttacgtacgttaagttttactttacgttcgttacgtagtaccggtacgggtacggggtactaacggttccggacccgtccgttaccggttaccgggttccggggaccgggggtaacgtaagggtacgggtaacgttaccggaaacgtacgtacggtcggtacgtacggccgtaaccgtagtccgtttcgttaccttaccttaccgtttcccgtccccgtaccg

SEQ ID NO: 284059 - DNA, 575 bp, Homo sapiens
  misc_feature: GYAE6OF01DPXGC.14.57.F02.1.454.CMB.1.raw
  modified_base (549)..(549): a, c, t, g, unknown or other
  misc_feature (549)..(549): n is a, c, g, or t
  modified_base (562)..(562): a, c, t, g, unknown or other
  misc_feature (562)..(562): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtacaacaccaacttagcctggtttcagcagaagcctggccaggcctcccgaggctcctcatgtatgatgcactccccacgacggggacccaccgggcactaccccagacccgaggttccaggtcggcaggtcgggtcgtggggacaaggtaccttcgaacttcctcaccatcgacgccacgtccgtaagacgtctagtaagttagtttgtacttaagtttattacgtgtacagtcgaggcgggactaagtcgccgcgtcgtacggttcgggcggggtacgagggtggtagtacgaaacgagtggtcggctgcncatcgtgtacctntctccttccgtcc

SEQ ID NO: 284060 - DNA, 593 bp, Homo sapiens
  misc_feature: GYAE6OF01EM0VX.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggagcttggtacaggccggggggtccctgacactctcctgtgcagcctcaggattctatttttagcgtaatatgccatgagcgtgggtccgccaggctccgaggggaaggggctgggagtgggtctcgagcaatcagttggttctagtggaagtacagttcgacgccgtctccggtggaacgggtccgttctccatcctccagacgaactaacttaccaaagaacactcttactttctacaatggacagcctagaaacgacgaagacgacgggtcgttgttattttggagtagaaacgtagtaagaagttctaagtacgtaacttaacccgtaaggtttacggggacgggttacctttagagttggtcggtaccggggg

SEQ ID NO: 284061 - DNA, 520 bp, Homo sapiens
  misc_feature: GYAE6OF01CURUN.14.57.F02.1.454.CMB.1.raw
  modified_base (508)..(508): a, c, t, g, unknown or other
  misc_feature (508)..(508): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccacagggccaccggcatcccagccaggttcagtggcagcgggtctgggacagacttcactctcaccatcagcagcctagagtctagaagtatttgactagtttattactgtcagcgagcgggactagttggccgcgtcgtacgtttcgggcggggacgagggtggagtacgaaacgtagtggtggctggcaccatctgtcttnctcgtcccgtcc

SEQ ID NO: 284062 - DNA, 565 bp, Homo sapiens
  misc_feature: GYAE6OF01DRI5I.14.57.F02.1.454.CMB.1.raw
  modified_base (524)..(524): a, c, t, g, unknown or other
  misc_feature (524)..(524): n is a, c, g, or t
  modified_base (537)..(537): a, c, t, g, unknown or other
  misc_feature (537)..(537): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccgaggctcctcatgtatgatgcatcccacgagggcccaccggcactcccagcccaggttcagtcggcacggcggggtctggggacaggtaaccttcgacttccgcaacccatccagccagccctagacgtctgtaagtattttgacttaagttttattactgtcagcgaggcggggctaagttggccgtctcgtaccgtttcggggacgggggtaccaagggtggagttaccgaaacgacgtaggnggtctagcctacngtctgttcttcacttccttcccgctacg

SEQ ID NO: 284063 - DNA, 559 bp, Homo sapiens
  misc_feature: GYAE6OF01BGXIB.14.57.F02.1.454.CMB.1.raw
  modified_base (360)..(360): a, c, t, g, unknown or other
  misc_feature (360)..(360): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggcctcccaggcctcctcatgtatgatgcatcccacagggcccaccggcatccccagccaggttcagtcggcaggcgggtctggggacngacttcactctcaccatcagcagcctagagtctagtaagtatttgctagtttattactgtcagcgaggcggggtactaagttcggccgtctccgtacgtttccgggacggggggaccgaagggtgggacggttacgaaacggtacgtaggtcggcgtgaccgacacttcgtcgttcttctacttccttcccgtcctacg

SEQ ID NO: 284064 - DNA, 566 bp, Homo sapiens
  misc_feature: GYAE6OF01AQTFB.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagngccaccctctcctgcagggccagtcagagtgtcaacaccaacttagcctggttcagcagagcctggccaggcctccaggctcctcatgtatgatgcatcccacgacgggccacggcactcccagccaggttcagtggcaggcgggtctgggacagtacttcactctcaccatcagcacgcctagacgtctagaagtatttgcttagtttattacgtgtacagcgaggcgggactagttcggccgtcgttcgtaccgtttcggggaccgggggtacgtaagggtacggtacgttaccgaacgtacgtggtcggccgtgaccgtacgacgttcgtacgttcttacgtacttcccgttcccgcgtacg

SEQ ID NO: 284065 - DNA, 584 bp, Homo sapiens
  misc_feature: GYAE6OF01BTXLE.14.57.F02.1.454.CMB.1.raw
  modified_base (498)..(498): a, c, t, g, unknown or other
  misc_feature (498)..(498): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccggggggtccctgacactctcctgtgcagcctcaggattcatttttagcgaatatgccatgagctgggtccgccaggctccgaggggaagggctggagtgggtctcgagcaatcagtggttctagtggaagtacattcgacgccgtctccggtgaacgggccggttctccatcctccagacgactaactccaagaacactcttatttctacaatgacagacctagaaagacgaagacgacgggtcttagttattttggagtagaaagtntaacggtaagtcttagtacgtaacttaaccccgtaaggtttacgggggacgggttacccttttagacgttggttccggtacggggg

SEQ ID NO: 284066 - DNA, 648 bp, Homo sapiens
  misc_feature: GYAE6OF01BMSEM.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccaggctccaggctcctcatgtatgatgcatcccacacggggccaccggcactcccagccaggttcaggtggcaggcggtctgggacagacttcactctcaccatcagcagcctagagtctagaagtatttcgactagtttattactgtcagtcgaggtcggggactaacgttcggaccgtcgttacgtaccggttttccggggaccgggggggtaaccgtaacgggggttacgggtaaacggtttaccggtaaaaacccgggtaaacggttcgggttaacgggtcccgttagggtacccgtaacccgttacgttacccgtttacggttccccgttttaccgtaaccgtttccccggttttccccgtcccgttaacccg

SEQ ID NO: 284067 - DNA, 420 bp, Homo sapiens
  misc_feature: GYAE6OF01CB3U3.14.57.F02.1.454.CMB.1.raw
  modified_base (413)..(420): a, c, t, g, unknown or other
  misc_feature (413)..(420): n is a, c, g, or t
tcagcgtctagtaccacgaccggtgctcgatttagctcgatatagttgggtctcagcaatcagtgtttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagtctccaccaagggccatcggtcttccccctggcaccctcctccaagagcacctctggggcacagcggccctgggctgcctggtcaaggactacttccgtactagacgctgagcggctggcaaggcgcatagnnnnnnnn

SEQ ID NO: 284068 - DNA, 623 bp, Homo sapiens
  misc_feature: GYAE6OF01BDZTF.14.57.F02.1.454.CMB.1.raw
  modified_base (429)..(429): a, c, t, g, unknown or other
  misc_feature (429)..(429): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggactgagttggctctttcttgtggctattttaaaagatttccagtgtgaggtgcagctgttggaggtccgggggaggcttggtacgaggccggggggtccctgacactctcctgtgcagcctcaggtattctaatttttagcgtaatatgccatgagcgtgggtccgccaggcctccgaggggaggggctgggaggtgggtctcgagcaagtcaggtggttctaggtacggtaagtactagtttccggacgtccgtcgtccgtaggaacgggtccgttcctcatccnccagacgaactaacttaccaaagtaactactcttaatttccttacaaattcggacacgtacctaagaaacgaacgaagacgacgggtacgttagtttagttttgagtaagaaagtataacgtaagttctatagaacttaacccgtaagttacggggtaggttaccctttagagttcgttcggtcggggtaccgg

SEQ ID NO: 284069 - DNA, 556 bp, Homo sapiens
  misc_feature: GYAE6OF01CCMKG.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggcccaccggcatccccagccaggttcagtggcagcgggtctgggacagacttcactctcaccatcagcagcctagagtctgaagtattttgctagtttattactgtacagtcaggcgggacaagttcggccgtcgtccgtacggtttccgggaccggggggtaccgaagggtggaacggttacgaaacggtaacgtggtggcttaggccacctattcgtcgttcttctacttccgttcccgtcc

SEQ ID NO: 284070 - DNA, 638 bp, Homo sapiens
  misc_feature: GYAE6OF01DJLVX.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacacctaacttgcctggtttcagcagaagcctggccaggcctcccgaggctcctcatgtatgatcgcactcccgacgacgggcccaccggccactccccgagtcccgtaggttacaggtcggcgacggtccggggtcgtacggggacacggtaaccttcgaccttctaccaccgatccacgccagacctaggagttctagtaagttattttgacgttagttttacttacgtgttacgagacgagggtcgggtataacgttcgggccgtacgttccggtacgggtttccggggacggggggtaaccgtaagggtgggtaacgttacgaaacggtacgttaggtcggtcgtacggacctaccgtatccgttacgtcctttactacgttcccttcccgtcttacg

SEQ ID NO: 284071 - DNA, 581 bp, Homo sapiens
  misc_feature: GYAE6OF01CFIPP.14.57.F02.1.454.CMB.1.raw
  modified_base (359)..(359): a, c, t, g, unknown or other
  misc_feature (359)..(359): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccagacgggccacggcactccccagccaggttcagtggcagcgggtctgggacngacttcactctcaccatcagcagcctagacgtctagtaagtattttgcttagtttattacgtgtcagcaggcgggactaagttcgggccgtcgtaccgtacggtttccggggacggggggtaccgaagggtcggtacggttaccgaaaacggtaacgtggtcgggtcgtacggccaccgtattccgttcggttccttacgtacttcccgttccccgtacccg

SEQ ID NO: 284072 - DNA, 590 bp, Homo sapiens
  misc_feature: GYAE6OF01DXUL6.14.57.F02.1.454.CMB.1.raw
  modified_base (354)..(354): a, c, t, g, unknown or other
  misc_feature (354)..(354): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggcctcccgaggctcctcatgtatgatgcactcccacgacgggccaccggcactcccagccaggttcagtgcaggcggtcngggacagtactcactctcaccatcagcagcctagagtctagaagtattttagcttagtttacttactgtcgagtcgaggcgggactaagttcggccgtcgtacgtacggtttccggggacggggggtaaccgtaggggtagggaacgttacgaaaccggtaacgtcgggtacgggtcgttaggccaacccgtacgttccgttcgtttaccttactacttcccgttccccggtaccc

SEQ ID NO: 284073 - DNA, 603 bp, Homo sapiens
  misc_feature: GYAE6OF01CWQN3.14.57.F02.1.454.CMB.1.raw
  modified_base (389)..(389): a, c, t, g, unknown or other
  misc_feature (389)..(389): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccgaggcctcctcatgtatgatgcactcccacgacgggcccaccggcactccccgagccgaggttcaggtcggacgaggccggggtcgtggggacacggtacttccactcnccaccactcacgcacgcctagacgtcgtagtaagtagtttttacgacttaagtttattacgtgttacagcgacggtcgggactaagtcggccgtcgtacgtccggtttcggggacggggtaccgaagggtcggtacggttacgaaacggtacgtggtcggactggaccacctacgttcgttcgttaccttctacttcccgttcccgtccttacg

SEQ ID NO: 284074 - DNA, 592 bp, Homo sapiens
  misc_feature: GYAE6OF01DHSJ2.14.57.F02.1.454.CMB.1.raw
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtccaacaccaaacttagcctggttttcagcagaagcctggccaggctcccaggcctcctcatgtatgatgcaatccccagacgggccaccggcactcccagccaggttcagtggcnggcgggtctgggacagacttcactcncaccntcagcagcctagngtctagaagtagttttgacttaagtttattactgtacgagcgaggcgggtactaagtttcggccgtcgtaccgtacggtttccggggaccgggggaaccgtaagggtcggtaacggttacgaaaacggtacgtaggtcgggtccgtagaccaccgtacttcgttcggttccttactacctttccgttccccgtcctacg

SEQ ID NO: 284075 - DNA, 576 bp, Homo sapiens
  misc_feature: GYAE6OF01A67CX.14.57.F02.1.454.CMB.1.raw
  modified_base (443)..(443): a, c, t, g, unknown or other
  misc_feature (443)..(443): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggctcctcatgtatgatgcactcccacagggccaccggcactccccagccaggttcagtggcaggcgggtctgggacagacttcactctcaccatcagcagcctagagtctagaagtagtttgtctagttttattactgttacagtcgaggcccccggggntaacgttcggccgtctcgtaccggtttccggggacgggggtaaccgtaagggtcgggaacggttaccgaaacggtaaccgtggtcggtcgtgccacctacgttcttcgttcttctattcccttcccgcctacg

SEQ ID NO: 284076 - DNA, 420 bp, Homo sapiens
  misc_feature: GYAE6OF01EYGS2.14.57.F02.1.454.CMB.1.raw
  modified_base (415)..(420): a, c, t, g, unknown or other
  misc_feature (415)..(420): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcaccctcctccaagagcacctctgggggcacagcggccctgggctgcctggtcaaggactacttccgtactagacgctgagcggctggcaaggcgcatagnnnnnn

SEQ ID NO: 284077 - DNA, 639 bp, Homo sapiens
  misc_feature: GYAE6OF01DPND7.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaangccaccctctcctgcagggccagtcagagtgtcaacacctaacttagccttggtttcagcaggaacgccgtggccaggcctcccgaggccttcctcattgtatgatgactactcccgacgcgggcccaccggcactcccgagccgtaggttcaggtcggcgagggcgggtctagggacacggtaccttcacttcctacacctatccagcacgtctagtacgttactaggtaagttagttttagacgtttaagtttacgttacgttgtaccgaggtaccgagggtccgggtactaacggttccggaccgtccgttaccggtaccggtttcgggggaccggggtaacgtagggtacggtacgttaaccgaaacggtacgtggtcggatacggaccaccgtattccgttcgttcttacgtcctttcccgtcccgtaccg

SEQ ID NO: 284078 - DNA, 554 bp, Homo sapiens
  misc_feature: GYAE6OF01EYSTM.14.57.F02.1.454.CMB.1.raw
  modified_base (355)..(355): a, c, t, g, unknown or other
  misc_feature (355)..(355): n is a, c, g, or t
  modified_base (444)..(444): a, c, t, g, unknown or other
  misc_feature (444)..(444): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgacgggccaccggcactccccagcccaggttcagtggcagcgggtntgggacagcttcactctcaccatcagcagcctagagtctgtaagtatttgactagtttattactgtcagcgaggcgggctagtcggccncgtcgtacgtttacgggacgggggtaaccgtagggtacgggacgttacgaaacggtaacgtggtcggcgtcgcaccgtatcgttcgttcttacacttcccgtcccgtacc

SEQ ID NO: 284079 - DNA, 733 bp, Homo sapiens
  misc_feature: GYAE6OF01CMECR.14.57.F02.1.454.CMB.1.raw
  modified_base (716)..(716): a, c, t, g, unknown or other
  misc_feature (716)..(716): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccatggtagtttgggctgagttggcttctttcttgtggcttaattttaaaagatgtccagtgtgaggtgcagctggttggaggtccgggggagtcgttggtacgacgggccggggggtccctgacactctctgcgcagcctcgaggtatttacgttatttttagacgtaaattagtcgacctaagttggaacggtcggttccggggtcccgacccgacggccgtaccgggaagggggaacggggtcgtagggaggttcgggtcctacgagtactaacgtcgtaggttcggttacgttaaggtacgggtaaattacgtacgttccggaccggtcccggttacgtacccgggtaagggtaaccggggttccccgttccgtaccctacgttcccgtaccgaagtaacgtaaacctaaactttaacccgaaagtaaaccctctttacgtttacttttacgtaacctaaaggtccgaactacgacctaaaggaacgaacgaacgacgtacgggtattgtttatttgagtaagaagacgtagaagttctatacgtaccttaccggttaggttacggggtaccgttcttagngttcggtcggtacgggg

SEQ ID NO: 284080 - DNA, 640 bp, Homo sapiens
  misc_feature: GYAE6OF01CE7I4.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccacggagaaattgtgttgacacagtctccactcaccctgtctttgtctccgaggggaagagcccacctctcctgcagggccagtcagagtgtaccaaacaccaattacgccttggttcagcaagaacgccgtggccaggcctcccgaggcctcctcattgtatgatgcactcccagacggccaccggcactcccagcctaggttcagtcggcgaggccgggtgtgggacagtcttcactctacactatcagcacgcctagagtcgtagaagttagttttgacttaagtttattactgtacgagcgtacgggcggggtactacggttcgggccgtacgttccggttaccggtttaccgggggaccgggggtaaccgtaaggggtacgggttaacggttaacgaaaccggtaacggttcggtacgggtaccgttcggaccgtaacccgtagttccgttacgttcccttactaccgttttccccgttccccgacccttacgg

SEQ ID NO: 284081 - DNA, 620 bp, Homo sapiens
  misc_feature: GYAE6OF01AMI4J.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggaagagccaccctctcctgcagggccagtcagagtgtcaacaccaacttagcctggttcagcagaacgcctggccaggcctcccaggcctcctcatgtatgatgcactcccacgacgggcccaccggcactccccagccgtaggttcaggtggcgacggtcgggtcgtgggacaggtaccttcacgtcctccaccgatacgacgccacgccgtaggacgtcgtaggtaagttagttttcgacgttagttttaacttacgttcgttacgagtacgacgggcgggtactaacggttcggacccgtcgtaccggtaccggtttccggggaccgggggtaccgtaagggtacggtaacggttacgaaacggtacgtaggtcgggcgtgacctacctagtcgttgtcttacctatcccttcccgtctacg

SEQ ID NO: 284082 - DNA, 589 bp, Homo sapiens
  misc_feature: GYAE6OF01D3LJV.14.57.F02.1.454.CMB.1.raw
  modified_base (202)..(202): a, c, t, g, unknown or other
  misc_feature (202)..(202): n is a, c, g, or t
  modified_base (353)..(353): a, c, t, g, unknown or other
  misc_feature (353)..(353): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcagggccagtcagagtgtcaacaccaacttagccttggttcagcagaagcctggccaggcctcccgaggcctcctcatgtatgatgcatcccagcgggccacggcactcccagccaggttcagtggcaggcggtcngggacagacttcactcacacatcagcagaccgtagtagtcgtagtaagttagtttcgacttagtttacttacgtgttacacgtacgacggtcgggactacgttcggccgtacgtcgtacggtttccgggacgggggtaccgtaagggtacggtaacggttaacgaaaccggtacgtaggtcgggtacgtaggacctacgtacgttcgtcgtcttactacttcccttcccgcgtacg

SEQ ID NO: 284083 - DNA, 679 bp, Homo sapiens
  misc_feature: GYAE6OF01DETDE.14.57.F02.1.454.CMB.1.raw
  modified_base (306)..(306): a, c, t, g, unknown or other
  misc_feature (306)..(306): n is a, c, g, or t
  modified_base (372)..(372): a, c, t, g, unknown or other
  misc_feature (372)..(372): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanacgggccaccggtcactccccagccaggttcagtggaccaggcggtcgaggacacgtactcgctcnccacactcgacgacacgtaccgtaggtacgtaccgtaggaaagttacgtttttacgaacgtttagtttaacttttacgtagttacgaggtccgtacggggtcgggaacttaaggttcgggaccgtccgttaccggttaccgggtttaccggggggaccggggggtaaacccggtaagggggttcgggtaaacggttaaccggtaaaacggaaccggttgggtaccggtacgtacggtaccgtaacccgtagttaccgttcggtttaccttaccgttacgtttccccgttccccgtacgttaacccgg

SEQ ID NO: 284084 - DNA, 641 bp, Homo sapiens
  misc_feature: GYAE6OF01ASJEJ.14.57.F02.1.454.CMB.1.raw
  modified_base (303)..(303): a, c, t, g, unknown or other
  misc_feature (303)..(303): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggttcagcagagcctggccaggctcccaggctcctcatgtatgatgcatcccanacgggccaccggcactcccagccaggttcagtcggcaggcgggtcgtgggacacgtctcactcacactactcgacgacgacgtacgtagtacgtcgtagtaagtttacgtttcgtacgtttaagtttttacttacgttcgtacgacgtacggacgggtcgggtaacttaacggttccgggcccgttacgttaccggtttaccggggtttccggggggaccgggggtaacggtaggggtacgggttaacgtaacggaaacgtacggttgggtaccggtcgtacggaccctacgtcgttccgttcgttccttacgtacctttccccgttcccgcgttacg

SEQ ID NO: 284085 - DNA, 536 bp, Homo sapiens
  misc_feature: GYAE6OF01EAH9E.14.57.F02.1.454.CMB.1.raw
  modified_base (203)..(203): a, c, t, g, unknown or other
  misc_feature (203)..(203): n is a, c, g, or t
  modified_base (529)..(529): a, c, t, g, unknown or other
  misc_feature (529)..(529): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccactggagaaatagtgatgacgcagtctccagccaccctgtctgtgtctccaagggggaaangcccaccctctcctgcaggccagtcagagtgtagaagcaattgcctggaccagcagaaacctggccaggctcccaggcctcctcatctatggtgcatcccacgacgggccacgtggtcgtcccagccgaggttcaggtggcaggtcgggtctggggacagtagttcactctcacctatcgagcacgcctgacagtctagtaagtattttgacttagttttattattgtcagtctagtataatacgtggacctcggtggtacgttcggaccgaagggactaaggtagaaactacgaaacgtacgtgtggctgcacctatctgtcttncttcccg

SEQ ID NO: 284086 - DNA, 572 bp, Homo sapiens
  misc_feature: GYAE6OF01CGH8H.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattcatttttagcgaatatgccatgagctgggtccgccaggctccgagggaaggggctggagtgggtctcagcaatcagtggttctagtgaagtacattcgacgccgtctccgtgaacgggccgttctccatcctccagagacaattccaagaacactctatttctacaatggacagcctagaagacgaagacgacgggtcttgttattttgagtgaaagtataacggaagtccttaagtacggtactaaccccgtaagttttacgggggacggggttcccttttagacttggtcgtacgggggg

SEQ ID NO: 284087 - DNA, 554 bp, Homo sapiens
  misc_feature: GYAE6OF01A78P0.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccacgacgggccaccggcactccccagcccaggttcaggtggcaggcgggtctggacagacttcactctcacatcagcacgcctagagtctagaagtattttgactagtttacttacttgtcagcgaggcgggactagttcggccgcttcgtaccggtttcggggacgggggtaccgtagggtcgggagttacgaaacgtacgtggtcggcgtcgcgtacagtctgtacttcacttccgttcccgtcc

SEQ ID NO: 284088 - DNA, 605 bp, Homo sapiens
  misc_feature: GYAE6OF01DOFYQ.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaanagcccaccctctcctgcagggccagtcagagtgtcaacaccaacttagccttggttcagcagaagcctggccaggcctcccgaggctcctcatgtatgatgcatcccgacgacgggcccacggcactcccagcccaggttcagtggcaggcgggtctgggacagtacttcactctcaccatcagcacgcctagacgtgtagtaagtatttgacttagttttattacgttgtcgagtcgacggcgggtactaaggttcggcccgtcgttccgtaccggtttccggggaccgggggtaaccgtaggggtacgggtaacgttaccgaaacggtacgttgggtacggtacgtacggtccgaccgtagttccgttcgttccttacgtaccttcccgttccccggtacc

SEQ ID NO: 284089 - DNA, 593 bp, Homo sapiens
  misc_feature: GYAE6OF01DPBJ7.14.57.F02.1.454.CMB.1.raw
  modified_base (371)..(371): a, c, t, g, unknown or other
  misc_feature (371)..(371): n is a, c, g, or t
  modified_base (424)..(424): a, c, t, g, unknown or other
  misc_feature (424)..(424): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgacgggcccaccggcactcccagccgaggttcagtgcagcgggtctgggacagtacttcactcncaccatcagcagcctagacgtctagtaagttatttgacttagtttattacgtntacacgcgaggtcgggactaaggttcggccgtcgtccgtacggtttccggggaccgggggtacgtaaggggtggttaacgttaaccgaaacggtacgtggtcggtccgttcgaccgtacccgtagttccgttacgttccttacctactttcccttccccgtcgttaccg

SEQ ID NO: 284090 - DNA, 622 bp, Homo sapiens
  misc_feature: GYAE6OF01AWWUE.14.57.F02.1.454.CMB.1.raw
  modified_base (415)..(415): a, c, t, g, unknown or other
  misc_feature (415)..(415): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaacttagcctggtttcagcagaagcctggccaggcctcccaggcctcctcatgtatgatgcactcccacgacgggcccaccggcactcccagccaggttcagtggcaggtcggtctggggacagacttcgactctacactactcagcacgtcctagacgtacgtagtaaagttnttttgacttaagtttttattacgttcggttacacgtacgagggtccggggtactaacggtttcggcccgtcgttaccgtacgggttttcgggggaccggggggttaaccgtaaggggtcgggtaaacgttaccgaaaacggtacgtgggtggtcctaggaccaccgtagttccgttacgttcttactacttcccgttcccgtctacg

SEQ ID NO: 284091 - DNA, 655 bp, Homo sapiens
  misc_feature: GYAE6OF01DNQ56.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacaggccgggggggtccctgacactctcctgtgcagcctcaggtattctatttttagcgtaatatgccatgagcgtcggggtcccgccgaggcctccggaagggggaacgggggtctgggaggtggggtcctcgagcaatcgagttggttctaggtaggaactacacgtttcggacgtccggtctccgggtaggaacggggtcccggttcctaccgactcctaccgaagacgaactaacttaccaaagaacctacttacttatttcttacaaatggacagaccgtagaaacgacgaacgaacgacgggtacttagtttacgttttggtagtaagtaaagtagttaacgtaagttactaagttagtaaccttaaacccgtaagggtttacggggtaacggggttcctttagacgttcggtcggtacggggg

SEQ ID NO: 284092 - DNA, 556 bp, Homo sapiens
  misc_feature: GYAE6OF01BB1KE.14.57.F02.1.454.CMB.1.raw
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
  modified_base (456)..(456): a, c, t, g, unknown or other
  misc_feature (456)..(456): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaattagcctggttcagcagagcctggccaggctcccaggctcctcatgtatgatgcatcccanacgggccaccggcaactccccagcctaggttcaggtcggcaggtcggggtctggggaccaggtaccttcactctcaaccatcagccagcctaagngtctgaagtatttgattagtttattactgtacagtcgaggcggggataagtcggccncgtcgacggtttcgggcggggtaccgagggtggagtacgaaaccgtagtggtggctcgacgtaccagttcctcgttccttacacttccttcccgtctacg

SEQ ID NO: 284093 - DNA, 783 bp, Homo sapiens
  misc_feature: GYAE6OF01BOB92.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacgaggccggggggtcctgacacgtctcctgtgcagcctcgaggtattctattttagcgtaatatgccatgacgtcgtcgggtccgccgaggcctaccggaggggaacggggtcgtgggaggtcggggtctacgagactaagtcgtaaggttggttacgtaggtagggtaaacgttactagtttaccggaccggtcccggttccgtccgggtacggaaaccggggttcccggtttacctacccgtaacgttcccgtaccgtaaggaacggtaaacctaaaccgttaacccgaaacgtaaaccctacttacctttaacttttaccgttaactaaagttcgggaacctaacgtaaccctaaggaaaacgaacggtaaacgaaccgggtaacggggttacgtttaggttttaagtttttacggtaagggttaaggtaaaacgtagttaaaccggtaaagttacgttaaagtacggtaaaccgttaacccggttaaagggtttacgggggtaacgggtttacccgttttaacgtacggttccgggttacgggttaaccgggggg

SEQ ID NO: 284094 - DNA, 551 bp, Homo sapiens
  misc_feature: GYAE6OF01AXMMV.14.57.F02.1.454.CMB.1.raw
  modified_base (200)..(200): a, c, t, g, unknown or other
  misc_feature (200)..(200): n is a, c, g, or t
  modified_base (305)..(305): a, c, t, g, unknown or other
  misc_feature (305)..(305): n is a, c, g, or t
  modified_base (425)..(425): a, c, t, g, unknown or other
  misc_feature (425)..(425): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccagtcagagtgtcaacaccaacttagcctggttcagcagagcctggccaggctcccaggctcctcatgtatgatgcatcccacngggccaccggcactcccagccaggttcaggtgcagcgggtctgggacagacttcactctcaccatcagcacgcctagacgtctagaagtatttgactagtttatactgtcagcagcgggntaagttcggccgtctcgtacgtttcgggaccgggggtaccaaggggtggacgttacgaaacggtacgtggtacggtcgtcgacctacctagtccgttcgtccttactacttcccttcccgcctacg

SEQ ID NO: 284095 - DNA, 711 bp, Homo sapiens
  misc_feature: GYAE6OF01AEECU.14.57.F02.1.454.CMB.1.raw
  modified_base (199)..(199): a, c, t, g, unknown or other
  misc_feature (199)..(199): n is a, c, g, or t
tcagcgtctagtaccacgaccggtgctcgatttagctcgatatagttgggtttggggggaactgctcagttaggacccaggagggaaccatggaacgccccagctcagcttctcttcctctgctactctggctccagataccacggagaattgtgttgacacagtctccactcacctgtctttgtctccgaggggaacncgccacctctcctgcagggccagtcagtagtgtacaacaccaactagccttggttcagcagacgcctggccaggctccgaggcctcctcatgtatgatgcactcccgacgacggccaccggcactcccgagcctagggttcagggtcggcgaggcgggtcgtaggggactacgtaccttcaacgtcacaccgtatcaacggtccaacgtcgtaacgacgttacgtaggtaacgttagttttacggtactttaacgttttaacttacgttcggtacgacgacggtacgggtacggggttactaaacgggtttccgggtcccgttaccggttcggtttaaccggggtttaccgggggaaccggggggtaaaccgttaaggggtacggttaacggttaaaccggaaaccggttaaccggttagggtaccggtacgtaccgtacccgtaccgttacgttcccgttacgtttacccgtttaccgtacccgttttcccgttcccgtacccgttaccgg

SEQ ID NO: 284096 - DNA, 823 bp, Homo sapiens
  misc_feature: GYAE6OF01EFGM5.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagtgccagtcagagtgtacaacaccaacttagccttggtttcagcagaagcctggccaggcctcccaggcctcctcatgtatgatgacactcccgacgacggcccaccggcacctcccgacgccgtaggttcaggtcggacgaggcgggtcgagggacgacgtaccgttcaccgtcctaccaacctacgtaccacgtaccgtacggtacccttaaggacgttaccgtaaggtaaacgttagtttttacgaaccgttttaacgtttttaacgtttaaccgttcggttaccgtaacggtaccggtaacggggtacccgggggtaacttaaacgggtttcccgggtacccccggtaccggtttaccccggttaacccgggggtttttacccgggggggaaccccggggggggtaaaccgttaacggggggtttaacgggttaaacccggttttaaacccgggtaaaaacccggggttaccggtttaacgggggtacccggttaaccggttaccgggaacccccttaaaccggtaacccgttttacggtttaccccgggtttacccgtttaacccgtttaccccgtttacccccggtttaacccccccgg

SEQ ID NO: 284097 - DNA, 688 bp, Homo sapiens
  misc_feature: GYAE6OF01DY3F1.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcactacccagacgggcccaccggcacctacccgacgccgtacggttaccgaggtcggaccgtacgggtccggggttcggtacggggaacctaacggtacctttaccaaccttaccgtaccaacccgtaagtaccgacgaccgacggtacccgtaaggtacgttacgtaggtaaagtttacgttttcgaacgtttaagttttacttacgtgtaccgaggtacgagggcggggtaactaaggttccggaccgtccgttaccgttaccgggtttccgggggaccgggggtaactaaggggtcggtaacgttaaccgaaacgtacggtaggtcggtctacgacctaccgtacgttcgtacgttcttacctactttccccgtcccgcctaacg

SEQ ID NO: 284098 - DNA, 650 bp, Homo sapiens
  misc_feature: GYAE6OF01BDQ3R.14.57.F02.1.454.CMB.1.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagactaccaccggagaaattgtgttgacacagtctccactcacctgtctttgctccgaggggaaancgccaccctctcctgcgagggccagtcacgagtcgtacaaacctaccaaacttagcccttgggtttccaggcaggacgccgtggaccagggcctcccgaagggtcctccgtcaatcggatggatgcacgtcccacgtgggcccacggcactcccagccgtaggtcaagtcggctaggcggtacngggacacgtcttcactctaccaacntacacgtactacgccgtagacgtcgtagtaagtcgtttagacttaggttacttacgtgtacgtaggtctacgggtacgggtactacgttcggtacccgtacgttaccgttacgggtttaccgggacgggggtaaccaaggggttcggtaacggttaaccgaaaccgtaacggttggtaccggtcgttacggactaccgtacttcgttacgttaccttagtccttcccgttaccgtaccg

SEQ ID NO: 284099 - DNA, 704 bp, Homo sapiens
  misc_feature: GYAE6OF01CCGZW.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaanacgccaccctctcctgcgaggccagtcagagtgtacaacaccaacttagcctggttcagcagaacgcctggccaggctccgaggcctcctcatgtatgatgaccactcccaacgacgggcccaaccggcaactccccgaagccctaagggtttccaggttcggaccgaggccggggttacgtaggggaactacggtacctttccacgttacctacaacccagtaccgaacggaccacgtaccttaaggacgttacgtaaggtaaacgttagtttttacgactttaaggttttaacttacgttgtaccgaagtccgagggtaccgggactaaggttccggacccgtcgttaccgtaccgggttttcggggacccggggggtaaccgtaaggggttcgggtaaacggttaaccgaaaacggtaaccggttgggtacggtacgtacggtaccgaccgtacttacgttcgttaccgtttacctaacgtttcccgttcccgtaccc

SEQ ID NO: 284100 - DNA, 703 bp, Homo sapiens
  misc_feature: GYAE6OF01CTPPP.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgagggaaancgccaccctctcctgcgagggccagtcagagtgtacaacaccaacttagcctggttacagcagaagcctgccaggctccaggctcccatgtactgatgacactcccgacgacgggccaccggcacgtcccgacgccgaggtcaggtcgacaggcgggtctgggacacgtacttcgacctcgtcaacctatcgaagacgtagacccgtaagtacgttcgtagtaaacgttacgttttagaccgttaaggtttactttaacgttacgttacgtaagaaccgttaaggttaacgttaacgaccgtaacggtaccgttaccgggtaccccttaccccggttaacccggttttaccggggaccgggtaaccggggtacccgtaaacggggttaacggaaacggtaaaccgttacccgaaaacggtaaccggttcggacggtaccgtacggtaacccgaacccgtacgttacccggttctttaccttaccgtccgtttaacccccg

SEQ ID NO: 284101 - DNA, 576 bp, Homo sapiens
  misc_feature: GYAE6OF01B9EIN.14.57.F02.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (293)..(293): a, c, t, g, unknown or other
  misc_feature (293)..(293): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctccngcgagggccagtcagagtgtacaacaccaacttagcctggtttcagcagaacgcctggccaggctcccgaggcctccncatgtatgatgcactcccagacggccacggcactcccagccgagtcagtgcgaggcggtgaggactagacttcactctacactatcgagcacgcctagacgtctagaagtatttgacttagtttatacgttgtcgagcgaggcgggactaagtcggccgtcgttaccgtacggtttccggggacgggggtaaccgtagggtaggtacgttacgaaaccggtacgtcggtcggcgtacgtaccaccgtacgttcgtcgttacttactcgttccgttccccgtac

SEQ ID NO: 284102 - DNA, 797 bp, Homo sapiens
  misc_feature: GYAE6OF01EVGM0.14.57.F02.1.454.CMB.1.raw
  modified_base (210)..(210): a, c, t, g, unknown or other
  misc_feature (210)..(210): n is a, c, g, or t
tcagcgtctagtaccacgaccggtgctcgatttagctcgatatagttggggtttgggggggaactgctcagttaggacccgagacgggaaccattggaagccccagctcagcttctcttcctcctgctactctggctccagataccacggagaaatttggtgttgacacagtctccaactcaccctgttctttgtctccgaagggggaangccaccctctccgtgctaggggccaggtcgagtagtcgtacaaccgacctaacttacggccttgggtttcaaggtcctaaggtaacgtccgttagggcccgtaacggggtcccttcccccggggtcttacccgttcgtaacgttcggttaacgtcgggaacgttcgggaccgtaccgttaccccggaacgggtaccgggggtacccctaaaccccgggtactaaaccgttaccccgaaggtacccggttaagggtttaccaaagggttcgggaccgtacggggtaccggggtacgtacgggggaaacctaacgggtaaccttttaccggaaccttttacccaaccgtaaacctacgtaccgaacggtacaacggttacccgttaaggaacggtttacgtaaggtaagtttacgttttacgaacgttaagttttaacttacgtacgtacgaacggacgacgggacgggtctacggttcgaccgtcgtacgttacggttcgggggacggggtaacaagggtgtacgtacgaaacgtgtaggtagacgtcgacactgtacctgtacctcgtacgtccctaccggctgtcg

SEQ ID NO: 284103 - DNA, 690 bp, Homo sapiens
  misc_feature: GYAE6OF01DD923.14.57.F02.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (396)..(396): a, c, t, g, unknown or other
  misc_feature (396)..(396): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagatacccaccggagaattgtgttgacacagtctccactcaccctgtctttgtctccaggggaaangcccaccctctcctgcagggccagtcagagtgtccaacaccaacttagcctggtttcagcagaagccgtggccaggctcccaggcctcctcatgtangatgcatcccagacggcccaccggcactccccagccaggttcaggtggcaggtccgggtctggggacctaggtaccttccacgttccctacgaacctntaccacggacctacgtacccgtaacggacgttaccgttaagtaaggttatttttacggtaacgtttaagttttacgtttacgttacgttaccgacggtacgacgggtcgggtacttaacggttcggcccgtaccgttaccggttaccgggtttccggggaccgggggtaaccgtacggggttacgggtaacgttaccggtaaaaccggtacggtgggttacggtccgtacggacccgtaccgtacgttccgttacgttacccttaccgtacctttcccgtccccgtcgttaccg

SEQ ID NO: 284104 - DNA, 769 bp, Homo sapiens
  misc_feature: GYAE6OF01BGPEQ.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcgttggtacaggccgggggggtccctgacactctcctgtgcagcctcaggtattctaatttttagcgtaatatgccatgagtcgtcgggtccgccgacggcctccgaaggggaaggggctgggaggttgggtctcgagcaatcgaggttggttctaggtaggaagtactacttccggaccgtccgttcgtaccggtaggaacgggtccgttctcctactcctaccgaagtacgaactaaacttaccgaaagtaaaccctacgttacctttaacgttttaccttaacctaaaacgtacgggtaactaaccggtaacccttaaggaaaaacgtaaccgggaaaacggaaccggtaacccggggttaccggttttaggtttaacgtttttttgggtaacggttaaaggtaaaaacggtacgttaaaacgggtaaacgttaccgttaaattaccgggttaaacttaaaccccggttaaaagggttttacggggggtaaccgggggtttacccctttttaggaaccgtttggggttacccgggttaaccggggggg

SEQ ID NO: 284105 - DNA, 306 bp, Homo sapiens
  misc_feature: GYAE6OF01A89DD.14.57.F02.1.454.CMB.1.raw
  modified_base (269)..(269): a, c, t, g, unknown or other
  misc_feature (269)..(269): n is a, c, g, or t
  modified_base (298)..(306): a, c, t, g, unknown or other
  misc_feature (298)..(306): n is a, c, g, or t
tcagcgtctagtaccacgaccggtgctcgatttagctcgatatagttgggtttgggggccaccggcatcccagccaggttcagtggcagcgggtctgggacagacttcactctcaccatcagcagcctagagtctgaagattttgcagtttattactgtcagcagcggggcaattggccgctcacgtttcgggcgggggaccaaggtggagttcaaacgactgtggctgcaccatctgtcttcatcttcccgcatctgagtactagacnctgacggcggctggcaaggcgacagtagnnnnnnnnn

SEQ ID NO: 284106 - DNA, 730 bp, Homo sapiens
  misc_feature: GYAE6OF01CLMB4.14.57.F02.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
  modified_base (428)..(428): a, c, t, g, unknown or other
  misc_feature (428)..(428): n is a, c, g, or t
  modified_base (554)..(554): a, c, t, g, unknown or other
  misc_feature (554)..(554): n is a, c, g, or t
  modified_base (696)..(696): a, c, t, g, unknown or other
  misc_feature (696)..(696): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccgganaaattgtgttgacacagtctccactcaccctgtctttgtctccgaggggaaancgccacctctcctcgcgacggacgacgtacgacgaggtgtacaaccaacctaaccttaacgtccgttacggtttcgtacgacgacgaaaggaccgttccggaccggaccggaccgtcccgtaccggcgtcccttccgtatacgtagtgtagtacgtaccacctaccccaccggaacggacccggtacccggaccacgtacccgaccgaccgtacggttacgtacgnggtaccgacggtccgggtcgtacgggacgagtactacctacgtacctaccactactcgacgacgactaccgtacgtaggtaccttagacgttaaattttcggtaactacgttttaagttctacgtntacggcgtacggacggggtactaacgtttcggacccgaccttcggttaacccgggtttacggggggaccgggggaacgtaagggttagggaaccgttaacgaaaacggtcgtagggtcggtacctagtaccgacttacggtnttccgtacttcctaacttcccggtccccagtacg

SEQ ID NO: 284107 - DNA, 628 bp, Homo sapiens
  misc_feature: GYAE6OF01CURM1.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaaacaccaacttagccttggttcagcagaagcctggccaggctacccaggcctcctcatgtatgatgcactcccacgacggcccaccggcactcccagccaggttcagtggcaggcgggtcgtgggacagtacttcgaccttctaccacactcacgcacgacctagagtcgtagtaagttattttgacttaagtttattacgtgtacagcgaggtcgggactaagttcgggacccgtcgttacggtaccgggtttccgggggaccgggggtaaccgtaacggggttcggtaacggttaaccgaaaaccggtacgttagggtacggtacgtcggaaccgtaccgtacgttccttcgtttaccgttacgtacctttcccgtccccgtccgtacg

SEQ ID NO: 284108 - DNA, 783 bp, Homo sapiens
  misc_feature: GYAE6OF01D48KS.14.57.F02.1.454.CMB.1.raw
  modified_base (180)..(180): a, c, t, g, unknown or other
  misc_feature (180)..(180): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctattttaaaagntgtcagtgtgaggtgcagctggttggaggtccgggggaggtcgttggtacgacgggcccgggggggtccctgaccactcctcctgtgcacgcctcaggtatttctatttttagcgtaatatgccatgagcgtcgggtccgccgaggcgtccggaggggaaggggcgtgggagtgggtctacgagacaatcgaggttggttacgtaggtacggaacgtactagttccggaccgtcccggtaccgtcccggttagggaaaccggggtccccggtttacctacccgtacgttcccttacccgaagggtaacgtaaacctaaacgtttacccgaaaacgtaaacctacctttacctttaactttttcctttaaccaaaagttccggaactaaccggtaccgttaaaggaaaacggaaccgaaacggaaccgggtaacggggttccgtttagttttagtttttagggtacgttaaaggaaaacggtagtaaaccggttaaaggttacgtttaaagttacggtaaaccttaaaccccggttaaagggttttacgggggtacggggtttacccttttaggtacggttgggttccgggtaacccggggggg

SEQ ID NO: 284109 - DNA, 633 bp, Homo sapiens
  misc_feature: GYAE6OF01D7M4E.14.57.F02.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagngcccaccctctcctgcagggccagtcagagtgtacaacaccaacttagcctggttcagcagaagcctggccaggcctccgaggcctcctnatcgtatgatgcactccacgcggcccaccggcactcccgagccgtaggttcaggtcggcgacggtccgggtacgtacgggacacggtaccttccgactcgtaccaccgtatcccgagtccgaacggtccctaaggacgttacgtagtaacgtttatttcggaacttagttttacttcgtacgtcagtacggagggcggtacgtaagtccggccgtacgtacggtaccgggttaccgggggaccgggtaacgtagggtacggaacgttaacgaaacgtcgtggtacggctacggcctacgtagttccttacgttctaacctcttacccgtcccgtctacgg

SEQ ID NO: 284110 - DNA, 536 bp, Homo sapiens
  misc_feature: GYAE6OF01EFRCA.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccctggctcctcatgtatgatgcatcccacgagggccaccggcatcccagccaggttcagtggcagcgggtctgggacagacttcactctcacatcagcagcctagagtctgaacgtattttgactagtttaattacttgtacagcgacggcgggtactaagttcggccgtcctcgtaccgtttcggggccggggacaaggggtcggtaagtacaaacgactggtggctgctcatctcgtcttcacttcctcccgctac

SEQ ID NO: 284111 - DNA, 727 bp, Homo sapiens
  misc_feature: GYAE6OF01AVWZL.14.57.F02.1.454.CMB.1.raw
  modified_base (374)..(374): a, c, t, g, unknown or other
  misc_feature (374)..(374): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtgaggtgcagcttggttgggaggtccggggggaggtcgttgggtacgacgggcccgggggggtccctgacactcctcctgtcgcacgcctcaggtattctattttagacgtaatatcgaccagtcgacgtcgtcgggtcccgccgaggcctaccggaggggacgggcgtgggaggtcgggtcncgagactaagtcgtaggttgttacgtaggtaggaaagtactacgttccggaccgtcccgttccgtaccggtagggtaaccggggttcccggtttacctacccgtacttcccgtacccgaaggaacgtaaccttaaacgttaacccgaaacgtaaacctacttacctttaacttttacttaactaaagtcggaactacgtaccgtaagaaacgaacgaaacggaccggtacgggtacgtttagtttagttttaggaggtaagtaaagtacgttaacgtaagttcttagtacgtaacgttaacccgttaaggtttacggggtacgggttactttaggacgttggtcggtacgggg

SEQ ID NO: 284112 - DNA, 691 bp, Homo sapiens
  misc_feature: GYAE6OF01EEBRV.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtgaggtgcagctggttgggaggtccgggggaggtcgttggtacgacgggcccgggggggtccctggaccacctcctcctgtcgcacgcctcgaggtattcttaagttttttagacgtaaattatcgacctaagtggagccgtcggggtcccgccgagggccgtaccggagggggaacggggtcgtgggaggttgggtctcgagacaatcgtaggttcggttacgtagtaggaaagtactacgttccgacgtccgtctccggtaggacggtccgttctcctatccgtacgaagtacgaactaacttaccaaacgaactacttacttactttctaactaatcggaacagtaccgtaaggaaacgtaaccgaacggaaccgtacgggttacgttagttttacttttaggacgttaagaaagtacgtaagtaaacgttctagtaggtaacctaaccgttaaggttacggggtacggttaccttagtagttcggtcggtacgggg

SEQ ID NO: 284113 - DNA, 650 bp, Homo sapiens
  misc_feature: GYAE6OF01A0KRO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggaggtccgggggaggcttggtacaggccgggggggtccctgacactcctcctgtgcagcctcaggtattctatttttagcgtaatatgccatgagcgtcgggtccgccgaggccgtccggaggggaaggggcgtgggaggtgggtctcgagcaatcgaggttggttcgtaggtaggaagtacagttcgacgtccgtcgtccggtaggacgggtccgttctcctactctccgagacgtaacaacttaccaaacgaacctacttacttaacttttacctactaaacgtcggaacacgtacctaaggaaacgaccgaaggaccgtacggggtcgttagttagttttagagttaggaaagtagtacggtaagttcttaagacggtaacctaacccgttaggtttacggggacgggttaccctttagtaggttcggttcggtaccggggg

SEQ ID NO: 284114 - DNA, 760 bp, Homo sapiens
  misc_feature: GYAE6OF01DB611.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacgagggcccggggggtccctgacacctctcctgtgcacgcctcaggtattctatttttagacgtaatatgccagtgacgccgtgggtcccgccgaggcctccggaggggaagggcgtgggagtcgggtctcgagactaatcgagttggttacgtaggtaggaagtacgtacgttaccgaccgtcccgttccgtacccggtagggtaaccggggttcccggtttacctacccgtacttcccgtacccgaaggtaacgtaacctaaacgtttaacccgaaaacgtaaacctacccgtttacctttaactttttacccgttaactaaacgtacggtaacctaacggtaacccgtaaggaaaaccggtaacgaaaccggaccggtaaccggggttcgtttacggttttaagtttttggtaggttaaaggtaaacggtacgtaaccggtaaagttcgtaagttacgtaaaccgttaaccccgttaaggtttacgggggtacggttaccctttaggacgttcggtcgggtaacccggggg

SEQ ID NO: 284115 - DNA, 743 bp, Homo sapiens
  misc_feature: GYAE6OF01DCWUC.14.57.F02.1.454.CMB.1.raw
  modified_base (177)..(177): a, c, t, g, unknown or other
  misc_feature (177)..(177): n is a, c, g, or t
  modified_base (243)..(243): a, c, t, g, unknown or other
  misc_feature (243)..(243): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggctattttaaagntgtccagtgtgaggtgcagctgttggaggtccgggggagcttggacgaggccggggggtcctgacnctctcctgtgcagcctcaggtattctagtttttagcgaatatgcctatggagtcgtcggggtcccgccaggtcctccggaaggggaacggggtctagggaggttgggtcctcgaggcaagtcgtaggttggtttactaagggtggaaacgttactacgtttccggacggtccccgtcgtccgggtaggtaaaccggggtccggtttcctaccgtacttccgtaccaaggaacgtaacctaaactttacccgaaaagtaacctaacttacgtttaacgttttacttaaccgaaaagttcgggaaacctaacggacccgtaagggaaaacgaacggaaacggaaccgtaccggggtacgttaggtttacgtttttagggagtaaggtaaaacgtacgttaaacgtaacggtttacctaagttacgtaacgttaaaccccggttaaggttttcgggggaaccgggtttcctttaacgtaggttccggttcgggtacccggggg

SEQ ID NO: 284116 - DNA, 420 bp, Homo sapiens
  misc_feature: GYAE6OF01CLGR7.14.57.F02.1.454.CMB.1.raw
  modified_base (329)..(329): a, c, t, g, unknown or other
  misc_feature (329)..(329): n is a, c, g, or t
  modified_base (414)..(420): a, c, t, g, unknown or other
  misc_feature (414)..(420): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttggggaggggtcctttcatgtctggggccaagggcgctggtcacgtctcttcagcctccaccaagggcccatcggtcttccccctggcaccctcctccaagngcacctctggggcacagcggccctgggctgcctggtcaaggactacttccgtacagacgctgagcgggctggcgaggcgcatagnnnnnnn

SEQ ID NO: 284117 - DNA, 699 bp, Homo sapiens
  misc_feature: GYAE6OF01CD1F1.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttattttaaaagatgtccagtgtgaggtgcagctgttgggaggtccgggggaggtcttggtacgacgggccgggggggtccctgacactctcctgtgcagcctcgaggattctatttttagcgtaatatgccatgagtcgtgggtccgccgaggcctccgaaggggaaggggctgggaggtgggtctcagcaatcgaggttggttctaggtggaaagtacagttcgaccgtcccggttcgtacccggtggaacggggtcccggtttcctacccgtacttcctacccgaaggaacgtaacctaaactttacccgaaagtaaacctaaccttacttaactttttaccttaacgtaaaagttcggaactacgacccgttaaggaaaacgaaccggaaacggacggtaccggggtacgttagtttacgtttttggtaggttaaggaaaagtagtaaccggtaagtcttaagtaggtaacttaacccgttaaaggtttcggggaacgggttcctttagacgttggtcggtacggggg

SEQ ID NO: 284118 - DNA, 668 bp, Homo sapiens
  misc_feature: GYAE6OF01EFIC0.14.57.F02.1.454.CMB.1.raw
  modified_base (366)..(366): a, c, t, g, unknown or other
  misc_feature (366)..(366): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgttctttgtctccgaggggaaagagccaccctctcctgcagggccagtcagagtgtcaacaccaacttagcctggttcagcagaagcctggccaggcctccgaggctcctcatgtatgatgcacgtcccacgagggcccaccggcactcccgagccgtaggttcaggtcggacgaggtccggggtcnggggacaggacctttccacttccncaccntccagccacggcctaaggtacgtcgtagtaaacgttagttttacgacttaagttttaactttacgtgttacacgtcgtaacgggcggggtactaacggttcgggacccgtacgttaccggtacgggtttccgggggaccggggggtaaccaaggggttacgggtaacggtttaaccggaaaccggtaacggtacgggttcgggtaccgtggacccgtacccgtaacgttcgttacgttcctttacgtactttcccgttccccggcttaaccgg

SEQ ID NO: 284119 - DNA, 604 bp, Homo sapiens
  misc_feature: GYAE6OF01ESBTH.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggctcctcatgtatgatgcatcccgacagggcccaccggcactcccagccaggttcaggtggcaggcggtctgggacagacttcactctcaccatcagcagcctagacgtctagaagtattttgacttagtttattactgtcagcgaggcgggactaagttcgggccgtcgtccgtacggtttccggggaccgggggtaaccgtaaggggtcggtaacgttaaccgaaaaccggtacgttagggtacggtcgtaggacccgacccgtacgttaccttcggttacctttacgtaaccgtttccccgttaccccgccgttaacg

SEQ ID NO: 284120 - DNA, 746 bp, Homo sapiens
  misc_feature: GYAE6OF01AT5PS.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtcctgacactctcctgtgcagcctcaggtattctatttttagcgtaatatgccatgagcgtcgggtccgccgacggccgtaccggagggggaacggggtccgtaggggtaggttcggggtctcgagactaagttccgtagggttcggtttactaggggtaggtaaacgtaactacggtttaccggaaccggtcccgttaccgtacccgggttagggaaccggggttcccggttacctacccgtacttccgtaccgaagtacggaacctaaacgttacccgaaacgtaacctacctttacttaacttttaccgttaactaaacgttcggaaccgtacgtacccgtaaggaaacgtaaccggaaacggaccggtacgggtacgttaggttttagttttacggaggttaacgtaaagacgttaaccggaagttaccgtaagtacgtaaaccttacccgtaaggtttacgggggacgggttaccctttaggacgttcggttcggtaccggggg

SEQ ID NO: 284121 - DNA, 550 bp, Homo sapiens
  misc_feature: GYAE6OF01CCGJ3.14.57.F02.1.454.CMB.1.raw
  modified_base (436)..(436): a, c, t, g, unknown or other
  misc_feature (436)..(436): n is a, c, g, or t
  modified_base (480)..(480): a, c, t, g, unknown or other
  misc_feature (480)..(480): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattcatttttagcgaatatgccatgagctgggtccgccaggctccaggggaaggggctgggagtgggtctcagcaatcagtggttctagtggaagtacattcgacgccgtctccgtggaagggccggttctccatcctccagagacaatccaagaacactctatttctanaatgacagcctagaaagacgaagacgacgggcttgttattttgngttagaaagtataacggagtctaatgactaacccaagtttgggacgggtccttagagttgtcgtacgggg

SEQ ID NO: 284122 - DNA, 584 bp, Homo sapiens
  misc_feature: GYAE6OF01BWV4N.14.57.F02.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggttcagcagaagcctggccaggcctcccgaggcctcctcatgtatgatgcactcccacgagggccaccggcactcccagccaggtcagtggcagcgggtntgggacagactcactctcaccatccagcagccgtagagtcgtagtaagtatttgcttagtttacttacgtgtacgagcgaggtacgggcgtagttcggccgtcgttcgtacgggttacggggaccgggggtaccgtaagggtacggtacggttacgaaacgtacgtagggtcggtcgtggaccgtacctacgttcgttacgttccttacgtacttcccgttccccgtctacg

SEQ ID NO: 284123 - DNA, 639 bp, Homo sapiens
  misc_feature: GYAE6OF01EZ1KA.14.57.F02.1.454.CMB.1.raw
tcagcgtctagtaccacgaccggtgctcgatttagctcgatatagttgggtttggggctgagagaggagccccagtcctgggatcttcaggtgttttcatttggtgatcaggactgaacagagagaactcaccatggagtttgggctgagttggcttctttcttgtggctaattttaaaagatgtccagtgtgaggtgcagctgttggaggtccgggggaggcttggtacaggcccggggggtcctgacactctcctgtgcagcctcaggattctatttttagacgtaatatgccatgagcgtgggtccgccaggctccgaggggaaggggctgggaggtgggtctcgagcaatcagtggttctaggtggaagtacattcggacgccgtcgtccgtaggaacgggtccggttctcctatcctccagacgaactaacttaccaaagaacctactacttattttaccttacaaagttcggaacacgcctaaggaaacgaacggaaacggaccgtacgggtacgttaggttatttttaggtagttaaggtaaaagtagtaacggtaagttactaatacggtaacttaaccccgtaaggtttacggggaacggggttcctttagagttggtcgggtacggggg

SEQ ID NO: 284124 - DNA, 526 bp, Homo sapiens
  misc_feature: GYAE6OF01AH9N8.14.57.F02.1.454.CMB.1.raw
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggccaccggcatccccagccaggttcagtggcagcgggtctgggacagacttcactctcaccntcagcagcctagagtctgaagattttgcagtttattactgtcagcagcgggcaagttcggccgctcgacgttttcgggccggggggtaccaagggtggaagttacgaaacgtaacgtgtggctgcaccatctgttcttcatccttcccgcctac

SEQ ID NO: 284125 - DNA, 730 bp, Homo sapiens
  misc_feature: GYAE6OF01BRBIV.14.57.F02.1.454.CMB.1.raw
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttggctgagttggcttctttcttgtggctaattttaaaagatgtccagtgtgaggtgcagctgttgggaggtccgggggaggcgttggtacagggccggggggtccctgacactctcctgtgcagcctcgaggtattctattttagacgtaatatcgaccagtgagtcgtcgggtcccgccgaggcctaccgaaggggaaggggtcgtagggaggtcgggtctcgaagaccaagtcgtaaggttcggttcgtaaggtagggaaagtacgtagttcggaccgtcccgttcgtaccggtaggaaccgggtccggtttcctccacgttccgtaccgaagtaacgtaactaaacttacccgaaaggtaaaccctaacttacctttaacttttaccttaaaccgtaaagtcggaaacctacgaccctaaggaaaaccggaacgaaacggaaccgtaacgggtacgttagtttaacgttttaggtagtaaaggtaaagacgttaaacgtaagtcgttaatacgttaaaccgtaacccgttaaaggtttacgggggaaacgggtttcccttttaggacgttgggtaccggtaacggggg

SEQ ID NO: 284126 - DNA, 834 bp, Homo sapiens
  misc_feature: GYAE6OF01DT8JD.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaangccaccctctcctgcagggccagtcagagtgtacaacaccaacttagcctggttcagcagaagcctggccaggcctcccgaggcctcctcattgtatgatgcactcccgacgacggggcccaaccggcactccccgagtccctaagggttccaggtcggaccgtacgggccggggttacgtacggggacctaacggtaacctttccgaccttacctacctaaaccccgtattacccgaacggtccctaaccggtacccgttaacggtaacggttaccgttaagggtaaaacgtttacgtttttacggtaccgttttaaacggttttaacttttaccggtttacggttacgtaacggtacgtaacggggtaccggggtacttaaacgggtttccgggtacccggttaccgttaccggttacccggggttttacccggggggaaccggggggggttaacccgtaaagggggttaccgggtaaaccgggtttaaccggtaaaaaccgggttaaccgggtttacgggttaccggggtaccgttacgggaacccgttacccggtaacgttaccgtttaccggtttacccgtttacccgttaccgtttaccccggtttacccccggtacgttaacccgg

SEQ ID NO: 284127 - DNA, 798 bp, Homo sapiens
  misc_feature: GYAE6OF01DV2ED.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtcttgtctccaggggaaancgccaccctctcctgcgagggccagtcagagtgtacaacacctaacttagccttggtttcagcagaacgccgtggccaggcctcccgaggcctccgtcatgtatgatcgctactcccagacgggcccaccggcactcccagccgtacggttcaggtcggacgtaggcgggttcgtagggaccacggtaacctttccgaccgttcctacccaaccgtagttacccgaacggtacccgtaacggtacccgtaaagggtaccgttacgttaacgggtaaacgtttacgtttttacggtaacgttttaacggtttttactttaaccgtttcggttaaccgtacggtacggtaacggggtaccggggtaaccgttaaacgggtttcccgggaccccgggttaccgtttaccgggttacccggggttttacccggggggaccggggggttaaacccgtaagggggttaaccgggttaaccgggtttaaccggaaaaccgggttaacggttcgggttaccggggtacgtaccggtacccgtaacccgttacgttcccgttacgtttacccgttaccgttaccgtttccccgttccccgttaccg

SEQ ID NO: 284128 - DNA, 804 bp, Homo sapiens
  misc_feature: GYAE6OF01A2D5R.14.57.F02.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
  modified_base (284)..(284): a, c, t, g, unknown or other
  misc_feature (284)..(284): n is a, c, g, or t
  modified_base (297)..(297): a, c, t, g, unknown or other
  misc_feature (297)..(297): n is a, c, g, or t
tcagcgtctagtaccacgaccggtgctcgatttagctcgatatagttgggtttggggggtaacgtgctcagttaggaccagagggaaccatggaagccccagctcagcttctcttcctcctgctactctggctcccagataccaccggagaaattgtgttgacacagtctccactcaccctgtctttgtctccgagggaagngccaccctctcctgcagggccagtcagngtgtacaacaccaacttgcctggttcagcagaancctggcaggcctccgagccncctacgatcgtangtatcgctacgtcccagacgggccacccggctactccccgagcccgtacgggttcacggtcggaccgaggtccgggttcggaggggaaacctacgggttcccttaccgaccgtttcccgtaccaacgtaccgtaccaacgggtcccaacggtacctaacgggtacgtttacgtaacggtaaagtttacgttttgaccgtttaagtttttaaacgtccgtttaggtacccgaacgtacggtaccggggtacgggttacttaaaccggtttcggggtaccccctacgggtttacccggttaaccccggggttttccggggggaaccccggggggttaaacccgttaagggggttacgggtaaaccgggtttaacccggaaaacggttaccgggtttacgggttacggggtaccccgttcgggtaaacccgtcccggtaacgggttttacccttcggggtttacccttaacccgtccgtttaccccggtttcccccggaccgtttaacgg

SEQ ID NO: 284129 - DNA, 573 bp, Homo sapiens
  misc_feature: GYAE6OF01CDDBX.14.57.F02.1.454.CMB.1.raw
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaaacttagcctggtttcagcagaagcctggccaggctccagctcctcatgtatgatgcatcccanaggccacggnatcccagccaggttcagtggcagcggtntgggacagacttcaactctacaccatccaagctagcctagagtctagaacgtattttgctaagtttattactgtcagcgaggcgggactaagttggccgtcgtaccgtaccggtttcgggccgggggtaacaagggtacggaacgttacgaaaacgaacgttaggtgggtcctaggaccctaccaagttcctaggttcctttacacgtttcccttccccggtctaacg

SEQ ID NO: 284130 - DNA, 634 bp, Homo sapiens
  misc_feature: GYAE6OF01C1MCQ.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacatagtctccactcaccctgtctttgtctccgaggggaaanacgccaccctctcctgcagggccagtcagagtgtacaacaccaacttagccttggttcagcagaacgcctggccaggcctcccgaggcctcctcatgtatgatcgcactcccacgacgggccaccggcactcccagccaggttcagtcggcgaggcgggtctgggacacggtctcactctcactatcagcagtcctagacgtcgtagtaagttatttgtacttaagttttacttacgtcgttacgacgtacgtacgggtacgggtacgtaacggttcggacccgtcgttaccgtaccgggtttaccgggggaccgggggtaaccgtaggggtacgggtaacggttaaccggaaacggtagtcggtcggtaccgtacggtacctaccgtacgttcgttacgttacttacgtaccgttcccgttcccgtacc

SEQ ID NO: 284131 - DNA, 751 bp, Homo sapiens
  misc_feature: GYAE6OF01C7AG5.14.57.F02.1.454.CMB.1.raw
tcagcgtctagtaccacgaccggtgctcgatttagctcgatatagttgggtttggggggaactgctcagttaggacccagagggaaccatggaagccccagctcagctctcttcctcctgctactctggctccagataccacggataaattgtgttgacacagtctccactcaccctgtctttgtctcgagggaaagacgccaccctctcctgcgacgggccagtcagagtcgtacaacacctaacttagccttggtttcagacgaagaacgtccgcggccaggcctcccgaggcctcctcaagttgtatagtatcgaccacctacccgaacgacgggacccgaccggccacgtcccgacgccgttaacgggttcgacggtcggaccgagggtccggggtacgtacggggaacctaacggttacctaccgtaccgttacacccaaccgtactaccgacgtacgacgtaccgtaagtacgtacgttaggaaacttttgtttacgaacgttattttactacgttgtacgtacgacggtacgggacgggtaactacggttccgggccctacggtttacccgtacgggggtttaccggggggaaccgggggtaaccgttaaagggggttccggtaaaccgtttaacggaaaacccggtaggtttaccggggtcggtaccggttcggacccttaacccggttacttccgtttccgtaccgtttacacccgttttcccgaccccggtctttaacggg

SEQ ID NO: 284132 - DNA, 831 bp, Homo sapiens
  misc_feature: GYAE6OF01D9IJR.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctatttcttgtggctattttaaaagatgtccagtgtgaggtgcagctgttggaggtccgggggaggcttggtacgaggccggggggtccctgacactctcctgtgcacgcctcgaggtattctatttttagacgtaatatgccatgagcgttcggggtcccgccgaggtccgtccggaagggggaacggggcgtggggtaggttcgggtcctacgagtacaaacgttccgtaaggttcggtttacgttaaggttaggggtaaagttaaccgtagtttaccggaacccggtccccggtttacccgttcccgggttacggggtaaaccggggttccccgggttttaccgttacccgtaacgttcccgtacccggaaggaacgtaaacccttaaacctttacccgaaaaacggtaaacctaacccttaccttttaactttttacccttaacaaaacgttcggaaacctacggtacccgtaagggaaaacgtaaccgggaaacggacccggtaacggggtacgtttaggtttaagttttttacggaggttaaacgaaaggtaaccgttaaacgggtaacgttacgttaagttacggaaaacctttaaccccggttaaagggttttaccggggggaacggggtttaccctttacgtaggtttcggttccgggtaaccgggggg

SEQ ID NO: 284133 - DNA, 599 bp, Homo sapiens
  misc_feature: GYAE6OF01CZMF5.14.57.F02.1.454.CMB.1.raw
  modified_base (177)..(177): a, c, t, g, unknown or other
  misc_feature (177)..(177): n is a, c, g, or t
  modified_base (267)..(267): a, c, t, g, unknown or other
  misc_feature (267)..(267): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (425)..(425): a, c, t, g, unknown or other
  misc_feature (425)..(425): n is a, c, g, or t
  modified_base (542)..(542): a, c, t, g, unknown or other
  misc_feature (542)..(542): n is a, c, g, or t
tcagcgtctagtaccacgaccggtgctcgatttagctcgatatagttgggtttggggtccagtgtgaggtgcagctgttggagtccgggggaggcttggtacagccggggggtccctgacactctcctgtgcagcctcaggattcatttttagcgaatatgccatgagctgggtccnccaggctccagggaagggctggagtgggtctcagcaatcagtggttctagtggaagtacattcgacgccgtctccgtgaagggtccgttntccatctccagagacaattccaagacactctattcttcaaatggacagcctagaaagacgaagacacgggctgtaatttttgagttgaaagntaacgaagtctatgataccctaagtttgggacggtcctttnagtcgtcgtgggtccaagggaccgngtcggtctaccgtctacttcgacgtcctaccgaccgtaacgggccctagtcccggtaccttccccgtggtacctacccgtcctaccgaacgacgcctaccgtcgtacggggccacgngccggcctgggcctcgccgtcgtacgaacggtactaccgtaccgtacgtaggtaccg

SEQ ID NO: 284134 - DNA, 600 bp, Homo sapiens
  misc_feature: GYAE6OF01DEDTZ.14.57.F02.1.454.CMB.1.raw
  modified_base (415)..(415): a, c, t, g, unknown or other
  misc_feature (415)..(415): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaaggggaaagagcccaccctctcctgcgagggccagtcagagtgtcaacaccaacttagcctggtttcagcagaagcctggccaggcctcccgaggcctcctcatgtatgatgcactcccacgacgggccaccggcactcccagcccaggttcaggtgcgaggcggtcgtgggacagacttcactctacaccatcagcagcctagtacgtctagtaagttnttttgacttagtttattacgtgtcagccgaggcgggataacgttcggccgtcgtaccgtcggtttccggggacgggggtaaccgtagggtggtaacggttacgaaacggtacgtcgggtacggtacgtcgacctaacccgtagttccgttcgttaccttcgtaccgttccccgttccccgtaccg

SEQ ID NO: 284135 - DNA, 593 bp, Homo sapiens
  misc_feature: GYAE6OF01CVAHL.14.57.F02.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (230)..(230): a, c, t, g, unknown or other
  misc_feature (230)..(230): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (358)..(358): a, c, t, g, unknown or other
  misc_feature (358)..(358): n is a, c, g, or t
  modified_base (563)..(563): a, c, t, g, unknown or other
  misc_feature (563)..(563): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgctccgaggggaaangccaccctntcctgcagggccagtcagngtgtcaacaccaacttagccttggttcagcaagtaagcctggccaggcctcccgaggctcctnactgtatgatcgctacncccacgacggccacggcactcccagccaggttcagtcgcgagcgggtngggacagtcctcgctcacactagtcagtcagaccgtagagttactagtaagttagttttcgaacgttagttttaacttacgtagttacgaggtccgagggcgggtactaagggttccgcccgttcgttaccgtcgggtttcggggaccgggggtactacgggtaggtacgtacgaaacggtcgtgggtcgactcgaccaaccgtntcgtcgttacttacgcttcccgttccgtac

SEQ ID NO: 284136 - DNA, 606 bp, Homo sapiens
  misc_feature: GYAE6OF01BWYFG.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagccttggtttcagcagaagcctggccaggctcccaggcctcctcatgtatgatgcactcccacgacggcccaccggcactcccagcctaggttcagtcggcgaggtccgggtcgtacgggactacggtacttcactcctaccactatccgagccacgtaccgtaggacgttctagtaagttatttcgacttaagttttacttactgtcacgtacgaggtacgggtactaaggtcggaccgtcgttcggtaccgggtttccggggacggggtacgtagggtcggtaacgttacgaaacggtacgtggtcgggtactacgaccgtactagtcgttctcttaccgacttccgttcccgtac

SEQ ID NO: 284137 - DNA, 624 bp, Homo sapiens
  misc_feature: GYAE6OF01A28N2.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggcccaggcctcccgaggcctcctcatgtatgatcgcactcccacgacgggcccaccggcactccccagtcccaggttccaggtcggccgtaggtccgggtcgtacggggaccaggtaccttcgaccttcgtaccacctatcgacgccacgtccgtagacgtcgtagtaagttattttcgcttaagttttacttacgttgtacgagacgtaggacggggtactaaggttcggtaccgtcttaccggtaccgggttcggggacgggggtaccgtaagggtcggtaacgttacgaaacgtacgtggtacggtcgtacgactacacgttctcgttcttactacttccgttcccgcttac

SEQ ID NO: 284138 - DNA, 640 bp, Homo sapiens
  misc_feature: GYAE6OF01DXUH5.14.57.F02.1.454.CMB.1.raw
  modified_base (202)..(202): a, c, t, g, unknown or other
  misc_feature (202)..(202): n is a, c, g, or t
  modified_base (478)..(478): a, c, t, g, unknown or other
  misc_feature (478)..(478): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccagtcagagtgtcaacaccaacttagcctggtttcagcagaacgcctggccaggctcccaggcctcctcatgtatgatcgctactccccgacgacgggcccaccggcactccccgagtcccgtaggttccaggtcggcgacgggccggggttcgtggggactaggaccttcgacctctaccaaccatccgaagcacgcctagacgtcgtagtaagttagtttcgacttaagttttattcgtacgttcacggtacncgggcgggtacgtaacgttcggacccgtcgttccggtacggtttccggggacgggggtaaccgtagggttacggtaacgttacgaaaccggtacggtcggtacgggactcggcctaccgtacttcgttcgttacccttacttcgttccccgtcccgtacccg

SEQ ID NO: 284139 - DNA, 647 bp, Homo sapiens
  misc_feature: GYAE6OF01CKO7M.14.57.F02.1.454.CMB.1.raw
  modified_base (286)..(286): a, c, t, g, unknown or other
  misc_feature (286)..(286): n is a, c, g, or t
  modified_base (357)..(357): a, c, t, g, unknown or other
  misc_feature (357)..(357): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtacaacaccaacttagcctggtttcagcagagcctggcaggctccaggctccnatgtatgatgcactcccacgacgggcccaccggcactccccgagccaggttcaggtggcgaggcgggtcgnggggacaggacttcgacctctaccgaaccatccacggactacgccgtaagacgtacgtagtaacgtattttcgacttaagttttattactgtactaggcgagggcgggtactaagttcgggacccgtcgttcgtaccgggtttcggggaccggggggtaacccgtaaggggtcggtaacggtaaccgtaaacggtaaaccggttcggtagggtccgtacggacccgtaccgtacgttacccgttcggtttacctttacccttactttccctttaccgtcccggttacccg

SEQ ID NO: 284140 - DNA, 735 bp, Homo sapiens
  misc_feature: GYAE6OF01B88EK.14.57.F02.1.454.CMB.1.raw
  modified_base (204)..(204): a, c, t, g, unknown or other
  misc_feature (204)..(204): n is a, c, g, or t
  modified_base (461)..(461): a, c, t, g, unknown or other
  misc_feature (461)..(461): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccgacggagtaaattgtgttgacactagtctccactcacctgttctttgtcctccgaaggggaanacgcccaccctctcctgacgaggccagtcagagtgtacaacgactaactgccttaggttcacgacagaacgtccgtcggaccacggtcctaccgaggtcctaccgtcatggtaatgactcgaccaaccgtcccgaaccggaccggacccgtaccggacctacgtaccccgacgtaccggttacgggttacgacggtcggacggaacggtccgggttacggacgggactaacggtccgtaccactaccgtcccaaacngtaccacgacgtacgtccgtaggtactacgtacgtaacggttaaagtttacgtttacgaacttttaagtttacgtacgtttacgtacggacgtacggacgggacggtaaccgtaggttccgaccggtcgttacccgggtaccgggtttacggggaccgggtaacggtacgggttaacgggtaaccgtacggaaacggtgttacggggtactacgtacggactaccggtacttacgttccgttacttaccgttaaccgttccgtccccggttaac

SEQ ID NO: 284141 - DNA, 548 bp, Homo sapiens
  misc_feature: GYAE6OF01A1LST.14.57.F02.1.454.CMB.1.raw
  modified_base (441)..(441): a, c, t, g, unknown or other
  misc_feature (441)..(441): n is a, c, g, or t
  modified_base (468)..(468): a, c, t, g, unknown or other
  misc_feature (468)..(468): n is a, c, g, or t
  modified_base (493)..(493): a, c, t, g, unknown or other
  misc_feature (493)..(493): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttcttgtggctattttaaaagatgtccagtgtgaggtgcagctgttggagtccggggaggcttggtacagccggggggtcctgacactctcctgtgcagcctcaggattcattttagcgaatatgccatgagctgggtccgccaggctccgagggaagggctggagtgggtctcagcaatcagtggtctagtggaagtacattcgacgccgtctccgtgaagggccggttctccatctccagagacaattccaagacactctattctcaatgacagcctagaaanacgaagacgacggtcgtagtattttgngtgaaagattaaggaacgttcgtancgtataacccgtaacgtttaggggtacggggaccttttacgattgtcgtacgggg

SEQ ID NO: 284142 - DNA, 605 bp, Homo sapiens
  misc_feature: GYAE6OF01CZ332.14.57.F02.1.454.CMB.1.raw
  modified_base (201)..(201): a, c, t, g, unknown or other
  misc_feature (201)..(201): n is a, c, g, or t
  modified_base (459)..(459): a, c, t, g, unknown or other
  misc_feature (459)..(459): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaaacaccaacttagccttggttcagcagaagcctggccaggctccaggctcctcatgtatgatgcatcccagacgggccaccggcactcccgagcccgtaggttccaggtggacaggccggggtctaggggactaggaccttcgacttcctccacactcaacgcacgtacctagagtactagtaagtatttgactagtttatacttgtacagcgaggtcggganaagttcggccgtcttcgtaccggtttccggggacgggggaacgtaaggggttcggtaacggtttacgaaaaccggtacgttaggtacggccgtaggtaccacgtacgttcgttacgttaccttctacctttccttcccgccttacg

SEQ ID NO: 284143 - DNA, 773 bp, Homo sapiens
  misc_feature: GYAE6OF01CGQQN.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtgctaattttaaaagatgtccagtgtgaggtgcagctgttgggagtccgggggagcgttggtacaggccggggggtccctgacactcctcctgtgcagcctcgaggtattcttaagtttttacgacgtaaattatcgtccaagtgagtccgtcggggtccccgccgacggccgtaccggaagggggacggggcgtagggacggttcgggtctacgaggtctaaagtccgtaaggttcggtttacgttaagggtagggtaaacgttaacgtacgtttaccggaacccggtcccgtaccgttcccgggtaaggtaaccgggggttcccggtttccgttcccgtaacgttcccgtacccgaacggtaacggaacctaaacccgtttaccgaaaacgtaaacccttacgtttacctttaactttttacccttaactaaaagttccggaactaacgtcccgtaaaggaaacggaaccgaaacggaaccgggtacgggtacggtttagttttacgttttggtagttacgaaagtactaaacggaagttactagtacggtaacctaccggttaaggtttcggggtaacgggttccttagcgtcgggtacggtcgggg

SEQ ID NO: 284144 - DNA, 626 bp, Homo sapiens
  misc_feature: GYAE6OF01ESJOM.14.57.F02.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcacctgtctttgctcagggaaangccaccctntcctgcagggccagtcagagtgtaccaaacaccaacttagccttggtttcagcagagcctgccaggctcccaggctcctcatgtatgatgcactcccagacgggccacggcacgtccagcgtaggttcagtggcaggcggtctagggacagaccttcactcacacaatcacgcagctagagtactagaagtatttgacgtagtttattactgtacgtagacgtacggacggggtactaacggttcgggacccgtaccgttcgttaaccggttttcgggggacccggggggtaaccgtaaggggtaccggttaaggttaaccggaaaaccgtaacggttacgggtaccggtacgtcggtaccgaacccgtaagttccgttacggttctttacctaacgtttcccgttacccgtaaccccg

SEQ ID NO: 284145 - DNA, 743 bp, Homo sapiens
  misc_feature: GYAE6OF01DJIGG.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaattgtgttgacacagtctccactcaccctgtctttgtctccaggggaangccaccctctcctgcagggccagtcagagtgtcaacaccaacttagccttggttcagcagagctggccgaggctccacggctcctcatgtactgatgcacttttcccacgacgggaccgaccggccacgtcccgacgccgtaggttccgacgtcgggcgacggcggggtcgttacggggacgaacggtaccgttcctacctcctaccgaaccctacgtaccgacggaccacggtacccgtaggtacgttacgttaggtaaacgttagttttacggtacgtttagttttaactttacgttagtaccgtacggtacgacgggtacggggtacgtaacggtttcgggtacccggtccgttaccggttaccggtttaccgggggtaccggggggtaaccgggtaacggggttaacggggtaacgggtttaaccggtaaaaccgggtaaacggttacgggtcgggttacggtacggtaccgtaacccgttacgttaccgtttcggttaccttaccgtttaccgttcccgtttccccggttaaccccgg

SEQ ID NO: 284146 - DNA, 849 bp, Homo sapiens
  misc_feature: GYAE6OF01AXCOX.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccagggaaagagccaccctctcctgcagggccagtcagagtgtcaacaccaacttagcctggtttcagcagaagctggccaggctccaggctcctcatgtatgatgacactcccgacgacgggcccaccggcaccgtccccgagtcccgacggttcaggttcggcgacggtcggggtcgtaggggaccgtagtaccgttccacttccgtactaacccaattaccgacgtaccgaacggtaccccgtaaggtaccgttacgttacggtaaaacgtttacgttttttacggtaccgtttaaagggtttttaaactttaacccgtttggttacccgtaaggtacccggtaacggggtcccgggggtaacctaaacggttttccgggacccggttaccgtttaccggttaacccggggtttttacccggggggggacccgggggggttaaaccccgttaaacggggggtttacgggtaaaccgggttttaaacccgggaaaaaacccgggtttaaccggtttaggggtaacccggggttacccggttacgggtaacccgtaaacccccggttacgtttaacccggttttcgggtttttacccctttaaccggtttaaccccgttttcccccgggttttcccccccgtaaccgttttaaacccgg

SEQ ID NO: 284147 - DNA, 534 bp, Homo sapiens
  misc_feature: GYAE6OF01D6U71.14.57.F02.1.454.CMB.1.raw
  modified_base (204)..(204): a, c, t, g, unknown or other
  misc_feature (204)..(204): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (515)..(515): a, c, t, g, unknown or other
  misc_feature (515)..(515): n is a, c, g, or t
tcagcgtctagtaccacgaccggtgctcgattttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtacaacaccaacttagcctggtttcagtcagaagcctggccaggcctcccgaggcctccgtcatgtatgatgcactcccacgacgggcccaccggcactcccgagccgagttcgaggtcggcgaggcgggtcgtggggacaggacttcacgtctaccgacatcagcacgcctagagtctagaagttntttagnttagtttattacgtgtcagcgaggcggtatagttcggcctcgtcgtcgttcgggcgggtacaggtgagtcgaagngtgngctgcacntctcgtctcatcctcgctc

SEQ ID NO: 284148 - DNA, 619 bp, Homo sapiens
  misc_feature: GYAE6OF01DM36U.14.57.F02.1.454.CMB.1.raw
  modified_base (289)..(289): a, c, t, g, unknown or other
  misc_feature (289)..(289): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaattagccttggttcagcagaagcctggccaggctcccaggcctccncagtgtatgatgcactcccagacggccaccggcacgtccccagcctaggttcagtggcgagcgggtcgtgggacagtacttccgactcgtacaccatcagtccagccgtagagtcgtagaagttagtttacgtcgtacgttttattacttgtacgtacgtacgacgggacgggtactaaggttacggccgtacgtccgtacgggttttccggggaccgggggtacgtaagggtgggtaacggttacgaaaccggtaacgtgtacggtcgtacgaccgtacgtacgttcgttacgttcctttacgaccgtttcccgttccgcccgttaacg

SEQ ID NO: 284149 - DNA, 790 bp, Homo sapiens
  misc_feature: GYAE6OF01A8I6E.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactccaccatggagtttgggctgagttggcttctttcttgtggctattttaaaagatgtccagtgtgaggtgcagctgtggaggtcggggagcgttgacgaggcccgggggtcctgactactctcctgtgcacgtcctcgaggtacttcgtaatttttagacgtaatatacgctatgagtcgtcgggtccgcgaggtcctccggaaggggaacgggtcgtagggtaggtcgggtctacgagacgtaagtcgtaggttcggttacttagggtaggtaacgtaacgtacgtttcggaccggtcccgttaccgtaccggtacggaaacgggttcccggttcctacccgtaacgttaccctacgtaaccgtaaccgtaaccgtaaacgttacccgaaagtaaccctaaccttaccgttaacttttacctaacgtaaaacgttcggtaaacgtaacgttacccgttaaaggaaaacggtaaccgaaacggtaaccgggtaccgggttacgttttaggtttaacgttttacggtaaggttaagtaaaacggtacgttaaaacgggtacgtttaacgtaagtttacggtaaaccgttaaccccggttaaagggtttacgggggtaaccggttacccttttaaggaccgtttgggttaccgggtaaccggggg

SEQ ID NO: 284150 - DNA, 538 bp, Homo sapiens
  misc_feature: GYAE6OF01BQJ5A.14.57.F02.1.454.CMB.1.raw
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (456)..(456): a, c, t, g, unknown or other
  misc_feature (456)..(456): n is a, c, g, or t
  modified_base (512)..(512): a, c, t, g, unknown or other
  misc_feature (512)..(512): n is a, c, g, or t
  modified_base (524)..(524): a, c, t, g, unknown or other
  misc_feature (524)..(524): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctccagataccaccggataaattgtgttgacacagtctccactcaccctgtctttgtctccgaggggaagacgccacctctcctgcagggccagtcagagtgtcaacaccaacttagcctggttcagcagaacgcctggccaggcctcccgaggcctcctcatgtatgatgcactcccacgacgggccaccggcactcccagccgtagtcagtggacaggcggtngggacagactcactcncactatacngcagactagacgtcgtagtacgttntttagacgttagtttatctgtcagtacgaggcgggtactaggtcgcccgtntaccgtcgggttcggggacggggtacagggtgacgtaacgagtagtggcgctcgcngatcgtctctanacttcctcgctacg

SEQ ID NO: 284151 - DNA, 792 bp, Homo sapiens
  misc_feature: GYAE6OF01BPT4W.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggagtcgttggtacgagggccggggggtccctggacactctcctgtcgcacgcctacgaggtattcgtaatttttagacgtaaattatcgacctagtcggagtcgtcggggtcccgaccgacggccgtccggaagggggaacggggcgtagggacggtcgggtctacgagacaatcgtaggttcggttacgtaggtaggtaagtacagttccgacgtcccgtcgtccggtaggtaacgggtccggttctaccactccgtacgagtaacgaactaacgtaccgaaacgtaaacctaccgttacttaacttttaccgttaacgtaaacttcgggaaacctacggtacccgttaaaggaaacggtaaccggtaaacgggaacccgtaccggggttacggtttagttttaacgttttttacgggtaacggttaaagggtaaaacgtaacgttaaaccgggtaaaaggtttaccttaaaggttacggtaaacctttaaaccccggttaaagggttttaccggggggtaacgggtttaccccttttaccggaaggttccgggtttaccgggtaaacccgggggg

SEQ ID NO: 284152 - DNA, 485 bp, Homo sapiens
  misc_feature: GYAE6OF01DQVSU.14.57.F02.1.454.CMB.1.raw
  modified_base (466)..(485): a, c, t, g, unknown or other
  misc_feature (466)..(485): n is a, c, g, or t
tcagcgtctagtaccacgaccggtgctcgatttagctcgatatagttgggtctcagcaatcagtggttctagtgtaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaagtttggggaggggtcctttcatgtcgtggggccaagggacgcgtggtcaccgtctcttcacgcctccaccgaacgggcccatccggtcttcctcccgtcgccaccctcctccaacgacgccaccgtcggtcggggccacgacggccggcccgtcgggctcgccgtggtacgaacggtacctacgtaccgtacgtacgaccgtcgtaggacggcgggtcgtcggacgacggcgacagtacgnnnnnnnnnnnnnnnnnnnn

SEQ ID NO: 284153 - DNA, 690 bp, Homo sapiens
  misc_feature: GYAE6OF01E0JG7.14.57.F02.1.454.CMB.1.raw
  modified_base (199)..(199): a, c, t, g, unknown or other
  misc_feature (199)..(199): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgctccgagggaangccaccctctcctgcgagggccagtcagagtgtacaacacctaacttagccttggttcagcagaacgccgtggccaggcctcccgaggtcctcctcatgtatggatcgcactcccgacgacggcccacggcacctccgagcctaggttcaggtcggcgacggtcgggtcgtgggaactacggtacttcacgtctaccaaccgtgtccaggtacctacgaccgttaggtacgttacgtagttaaagtttagttttacgacgtttagttttactacgtcgtacgtaacgcggtaacgggtcggggtaactaagggttccggtaccggtacttacccgggttacgggtttcccgggggaccggggttaaccgtaaggggtacggtaacggttaccgaaacgggttacgtcgggtacggtaccgttaggaccctaaccggtattccggtttaccgttcctttacggttcctaccccggtttcccgacgttaccgg

SEQ ID NO: 284154 - DNA, 581 bp, Homo sapiens
  misc_feature: GYAE6OF01ER7ZW.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaacgcctggccaggcctcccaggctcctcatgtatgatgcatccccacgagggcccaccggcactcccagccaggttcaggtggcaggtcgggtctgggacagtacttcactcacaccatcagcagcctagagtctagtaagtatttgacttagtttattacgtgtctagcagggcggggactaagttcggaccgtcgttcgtaacggtttccggggaccgggggtaacccgaagggtacgggtagttaccgaaacggtaacgttggtcggtagtcggcaacgtagtactgttacttactacttccgttcccgtacc

SEQ ID NO: 284155 - DNA, 791 bp, Homo sapiens
  misc_feature: GYAE6OF01CQJ1V.14.57.F02.1.454.CMB.1.raw
  modified_base (202)..(202): a, c, t, g, unknown or other
  misc_feature (202)..(202): n is a, c, g, or t
  modified_base (294)..(294): a, c, t, g, unknown or other
  misc_feature (294)..(294): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcacctgtctttgtctccgaggggaaagngcccaccctctcctgcgagggccagtcagagtgtacaacaccaacttagccttggttcagcagaagcctggcacggcctccgaggcctcctnatgtatgatgcataccccgagacgggacccaccggcactacccgacgcctacggttcaggtggccgaggtcggggtctcggggaactacggtactttacaccttaccgtaccaacctaacgtccaaggaccacgtacccgtaaggtacgttaccgttaggtaaacgttacgtttttacggtaacgtttaaacggtttttaacgtttaaccgttcggtttaaccgaacggtaccgggtaacggggtaccggggtacgttaaacgggttttccggggaccccgttacggttacccggtttaacccgggtttttacccgggggggaaccggggggggttaaacccgtaaagggggtttcgggtaaaacggtttaaacccggtaaaaaccggtaaacggtttcgggtacggggtaccttacggggaacctaacccgtactttaccgttacggtttaccgtttaaccttaccgtttaccccgttccccgtacccgttaaacg

SEQ ID NO: 284156 - DNA, 706 bp, Homo sapiens
  misc_feature: GYAE6OF01ERC65.14.57.F02.1.454.CMB.1.raw
  modified_base (184)..(184): a, c, t, g, unknown or other
  misc_feature (184)..(184): n is a, c, g, or t
  modified_base (473)..(473): a, c, t, g, unknown or other
  misc_feature (473)..(473): n is a, c, g, or t
  modified_base (504)..(504): a, c, t, g, unknown or other
  misc_feature (504)..(504): n is a, c, g, or t
tcagcgtctagtaccacgaccggtgctcgatttagctcgatatagttgggtttggggtacggatttgatgttacctgatgcttagaggcttttcctggaagcagggcatttgttgcttcagcaccgtagtgcctcgtcatcacgcctcagtccttgtattttccggatttgcctaggaaaaccngcctaacacgacttaaaccgggcaaccgtcgcccggaccaacatacgccttcctcccgtccccccttgctaacgtaaaccaccgaaagtacgaagtaactacgtttaacctgttttaccccataccgtactaccgtccgttttccggccctcgtaccgttaggggtccactccgaccctcgaccccgtaattacggtggacaacggtacccttggtccttccggcgagtcggtcttttccgacccgttatttacgtcgttacttagtgtcagtactactcgctacttgngtaactccctacgagtcaacgtcgtacctanacgactaccactacccgttacgacgtacgtacttaacgaacgtaccgtccctaaccccgtaaccaaaccgtaccgtaactaacgtaacgtccgtcgtactcgacccgtcacggttcgttacggttcacgtacgtttcggttaaccttcccggttactccttccgtaccccgtacttctacctggaccgttaacgtgaacccg

SEQ ID NO: 284157 - DNA, 489 bp, Homo sapiens
  misc_feature: GYAE6OF01D440I.14.57.F02.1.454.CMB.1.raw
  modified_base (470)..(489): a, c, t, g, unknown or other
  misc_feature (470)..(489): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgataccaatttggggagggtcctttcatgtcgtggggccaagggacgcgtggtcaccgtctcttcacgccctccaccaacgggcccatccggtccttcccccgtcggccacccctcctccaacggacgccaccctcggtcgggggccacgacggccggcccgtcggggctcggccgtggtaccaacgggtaccttaccgttccgtactacggacgtctggacggccgggctgggacgaacgggcgactagtagnnnnnnnnnnnnnnnnnnnn

SEQ ID NO: 284158 - DNA, 810 bp, Homo sapiens
  misc_feature: GYAE6OF01BRZUR.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggtccctgacactctcctgtgcagcctcaggtattttattttagcgtaatatgccatgagcgtcggtccgccaggcctccggaggggaaggggtcgtgggaggtgggtctcgagacaatcgagttcggttactaggtaggaacgtactagttcggacgtccgtcgtccggtaggacgggtccgttctaccatcctaccgagacgtaactaacttacccgaaaagtaacctactttacgtttaactttttacccgttaactaaaagttccgggaaacctacggtacccgttaaagggaaaaacgggtaaccggaaaacgggtaacccgggtaaccggggggttacgttttaacgggtttttaaacgttttttttagggaacggggtttaaaaggaaaaacgggttaacgttaaaccgggtaaaacggttttccgttaaaacggttaacgttaaaacccggtttaaaccccccggttaaaagggggtttttccgggggggaaacccgggggttttcccctttttaacgggaacggtttccgggggttacccgggttacggggggggtaaacccccggg

SEQ ID NO: 284159 - DNA, 697 bp, Homo sapiens
  misc_feature: GYAE6OF01D438E.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgttctttgtctccgaggggaaagacgcccaccctctcctgcgagggccagtcaggagtcgtaccaaaccacctaacttacgccttggttcagcagaacgccgtggccaggccctacccgaggtcctccgtacatcgtaatgatgacctactacccgacgaccgggcccaccggaccactccccgagcccgtaggttcgaggtcggcgtacggcggggtcgaggggacagtaccgttacacctccgtacacctacgtaccgacgtaccgacgtaccgtagtacgttacgtaggtaagtttagttttcggtacttaagtttttactacgttcgtacgaggtacggacggggtaccggggtatacgggttccggcccgtaccgttaccggtaccgggtttcgggggaccggggtacgtagggtacggtacgtaacgaaacggtacgtggtacggccgtagaccgtaccgtacgttccgttacgttaccttacgtacccgttcccgttacccgccgttacg

SEQ ID NO: 284160 - DNA, 733 bp, Homo sapiens
  misc_feature: GYAE6OF01EU0PV.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaanacgccaccctctcctgcgagggccagtcagagtgtacaacaccaacttacgccgttggtttcagcaagaacgccgtggccaggcctcccgagcctcctcatgtatgatcgcactcccgagaccgggccaccggcactcccgagcctaggttcgacggtcggacgaggtcgggtcgcgggacagtaccttccacgtcctaccgaacctatccgaacgacctacggtccgttaacggtacgttcgtagtaaacgtttagttttcgaactttaagttttacttacgtgtaccgtaggtcggaacgggtcccggggtataacgggttccggtacccgtccgttacgggttaacccggggtttccgggggggaaccgggggtaacccgttaagggggttccgggtaacgttaaacccggtaaaacggtaacggtttcggggtacggtacccggtacgtaaccccgtaacccgttagttccccggtttacgttttacccctttaacgaccccggttttcccttaccccccggtaac

SEQ ID NO: 284161 - DNA, 571 bp, Homo sapiens
  misc_feature: GYAE6OF01A8HOV.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtacaacaccaacttagcctggtttcagcagaagcctggccaggcctcccgaggctcctcatgtatgatgcactcccagacgggcccaccggcactcccagccgaggttcaggtgcgaggcgggtctgggacagacttcactctcaccatcagcacgctagagtctagtaagtatttgactagtttattactgttcgagcgaggcgggactaagttcggccgtctcgtacgtttccggggacgggggtaccaagggtacggaagttaacgaaacgtacgtggtacggtctagacctacctagttcgttcgttacttcacttcccgttcccgtctaacg

SEQ ID NO: 284162 - DNA, 789 bp, Homo sapiens
  misc_feature: GYAE6OF01BBP2G.14.57.F02.1.454.CMB.1.raw
  modified_base (374)..(374): a, c, t, g, unknown or other
  misc_feature (374)..(374): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaaagatgtccagtgtgaggtgcagctggttgggaggtccgggggagcttggtacgacgggcccgggggggtccctgacgacctcctccgtgtgcagcctctggattcgttctttagcagctatcgccatgagcgtgggctcgccgaggccgtccggaggggacgggctgggagtgggtctcgtgtcttattcccgngggctaggtggtgtaagttactacgaaattaccgtaacgccgtaagtacccgttccggtagggtaaccggggtcccgtttacgaccgtttacggtttacccaaaggtaacgtaaaccttaaaccgttaacccgaaacgaaacccgtacctaaccgtttcggtaaacttcgttacgaccgaaggtaacttaccgggaacccgtacggtaccccgttagggaaccggtaaccgggaccccgggaaagggtaaccccggtaaccgggttaccccgttaaaagtttaaccggtttaccggtacgggttaaacggaaccccgggttaaaaacccggtacccggttaaaaggttttacggttttttaaggggaacggtttttaacggtttttaaaccgttttaaccggttttaaaccccgg

SEQ ID NO: 284163 - DNA, 626 bp, Homo sapiens
  misc_feature: GYAE6OF01DDZQ3.14.57.F02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagcgtctagtaccacgaccggtgctcgatttagctcgatatagttggatttggggggaactgctcagttaggacccagagggaaccatggaagccccagctcagcttctcttcctcctgctactctggctccagataccaccggataaattgtgttgacacagtctccactcaccctgtctttgtctccgaggggaaangccaccctctcctgcagggccagtcagagtgtacaacaccaacttagcctggttcagcagaagcctggccaggcctcccgaggcctcctcatgtatgatgcactccgacgacgggccaccggcactcccgagccaggttcaggtggcaggcggtngggactagtcttcactctcactatcacgcacgtccgtagagttcgtagtaagttattttacgactttagtttacttacgttgtacgtagtacgtacgggcgggtactaacggttcggccgtaccgttacggtaccggtttcggggaccgggggtaacgtaggggttacggtaacggttacgaaaaccggttacgtacgggtacggtaccgtcggacctaccgtacgttccgttacgtttccttaccttaccgttcccgtccccgtaaccg

SEQ ID NO: 284164 - DNA, 704 bp, Homo sapiens
  misc_feature: GYAE6OF01E1IWK.14.57.F02.1.454.CMB.1.raw
  modified_base (374)..(374): a, c, t, g, unknown or other
  misc_feature (374)..(374): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcacctgtctttgtctccgaggggaaagagccaccctctcctgcagggccagtcagagtgtacaacaccaacttagccttggttacagcagaagcctggccaggcctcccgaggcctcctcattggtatgatgcactacccacgacgggcccaccggcaacgtcccagccctaggttcaggtcggcacggtcggggttcnggggaacacggtaacttccgaccttcgaccacctactacgaacggcaaccgtccttaaggacgttacctagggtaacgttacgtttttgacgtttagtttttaacttcgtacggttacacgacggtacgggcgggggtaactacggttcggccccgttcgttacccggtacgggtttcccggggggacgggggtaaaccgtaaggggtacgggttaacgtaaccgggtaaaccgggttaacgttggggtacggtcctagggaacccctaccgttacgttcttccgggttaacctttccgaccctttccccggtttccccgacgttaacgg

SEQ ID NO: 284165 - DNA, 718 bp, Homo sapiens
  misc_feature: GYAE6OF01CGNGI.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggagcgttggtacgaggccggggggtccctgacactcctcctgtgcagcctcgaggtattctaatttttagaccgtaattatgccagtgagtccgtcggggtcccgccgacggcctacccggtaaggggaacggggcgtcggggaaggtcgggtctcgagtacaatcgtagttcggttactaaggtagggaagtacgtacgttccggaaccgtcccgttcgtaccgggtaggtaaccggggtcccggtttacctcccgtaacttcccgtaccgaacggaacgtaactaaacctttaccgaaacgtaaaccgtaccttactttaacttttaccttaactaaagtcggaacacgtaccgtaaggaaacgtaacggaacgaccggtacgggttacgttagtttagtttttaggtaggtaagtaaagtactaaacggtagttactagtacgtaccgtaaccgtaaggtttacggggacgggtacctttagcgttgtcggtaaccgggg

SEQ ID NO: 284166 - DNA, 616 bp, Homo sapiens
  misc_feature: GYAE6OF01DCFBH.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggacagtcagagtgtcaacaccaacttagcctggtttcagcagaagcctggccaggctcccaggctcctcatgtatgatgcactcccacgacgggcccaccggcactcccagccgaggttcaggtcggcaggccgggtcgtcggggaacacggtacttcacctctcaccatcagcacgcctagacgtctagaagtagttttgacttaagtttacttacgttcgtacgtagcgagggtcgggactaagttcggcccgtcttaccggtacggtttccggggaccgggggtaccgtaagggtcgggtacgttaaccggaaacggtacggttaggtcgggtctacggcctaccgtacttcgttacgttccttactaccgtttcccgtccccgtccgtaccg

SEQ ID NO: 284167 - DNA, 683 bp, Homo sapiens
  misc_feature: GYAE6OF01CAKPX.14.57.F02.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcgagggccagtcagagtgtacaacaccaacttagccttggttcagcagaagcctggccaggctcccgagctcctnatgtatgatgcactcccgacgacgggcccacggcactccccgagcccgaggttcaggtcggacagggcgggttcgtacgggacacggtaccttcacttcctaccaacctattaccgaaggtccacgtacccgttaggtacgttacgtaggtaaagtttacgttttacggaactttaacgttttaacgtttacgttacgttacgtacggtacggtacgggaccggggtactacggtttcgggacccgtccgttaccggttaccgggtttaccggggacgggggtaaccgtaggggtacggtacggttaaccgaaacggttacgtagggtcggtacgtacgtacccaccgtagttccgttcgttcttaccgttacttcccgttcccgtaccg

SEQ ID NO: 284168 - DNA, 812 bp, Homo sapiens
  misc_feature: GYAE6OF01BYCMG.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaattgtgttgacacagtctccactcacctgtctttgtctcgaggggaagacgccacctctcctgcgacgggccagtcagagtcgtacaacacctaacttacgccttaggtttcagcaagaacgtccgtggaccaggcctcccgaggtcctcctacagttagtagtgagtcaccacctcccgacggaccggacccgaccggaccaccttcccgaacgtaccgtacggttacgacggtcggacgacgggtccggtcggtacggggaaccgtacggtacccttcgacccgttacctaccgtaaccgtactaccgaacggtcccgaagtacccgtagtaacgttaccgtaaggttaacgtttagttttacgttacgtttaacgtttttaacgttaccggtttacgttaaccggtacgtacggtacggggaccggggtaacgtaaccgggtttccgggtacccgttaccgttaaccgggtaccggggttttaccgggggaacccggggggttaaccggtaacggggttcggtaaaccgggttaaccggtaaaacggttaccgggttagggtaccgggtaccgttaccggacccgttaacctaccggttaccgtttccggttaccgtttacccgttaccgtttaccccttccccggtccgttaacccgg

SEQ ID NO: 284169 - DNA, 677 bp, Homo sapiens
  misc_feature: GYAE6OF01C12GQ.14.57.F02.1.454.CMB.1.raw
  modified_base (270)..(270): a, c, t, g, unknown or other
  misc_feature (270)..(270): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgtggaggtccgggggagcttggtacgaggccggggggtccctgaccactctcctgtgcagcctcaggtnttctagttttagacgtaatatgccatgagcgtgggtccgcctaggcctcggaggggaagggcgtagggagtcgggtctcgagacaatcgagttggttactaggtaggaatactagttccgaccgtcccgtcgtaccgaggtaacgggtcccggttactccgacttcccgtcgaagaacgtaactaacgttaccaaagaaacctacttaccttaacttttcttaaacaaagttcggaaacctagtacccgttaaggaaaaacgacggaaaacggacggtaccggggtacttagttttaagttttggtaggtaaagaaagtacgtaacgtaagttactaagttcggtaaacttaacccggttaaggtttcggggacgggttaccctttgacgttggtcggtaaccgggg

SEQ ID NO: 284170 - DNA, 772 bp, Homo sapiens
  misc_feature: GYAE6OF01C7KOV.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcacctgtctttgtctaccgaggggaaanacgccaccctctcctgcgacgggccagtcaggagtcgtacaacacctaacttacgtccgttggttacagcaagaacgccgtggccgacggcctcccgacggccttccgtacattcggtatggatcgctacctcccgaacgacggacccaccggccaaccgtcccgacgccgtaggttcgaggtcggacgacggtcgggtacgtagggactacggtaccttcgacctcctaccgtaacctagtaccaacgaccgacgtacccgtagtacgttactaggtaaagtttcgttttaggtacgtttaagtttttacgtacgttacggtacgaacgttccggaacggggtcccgggtaagtaaccggtttcccggggacccttaccggttaacccgggtttaccgggggttcccgggggggaaaccgggggtaaccgttaaacggggttcgggtaaaccttaaaccgggaaaacggtcggttacgggtaccggtcgtacccggtaaccgtccgttacggtttaccgttccgtttacccgttacttaacccgggttccccctttccggaccgttacg

SEQ ID NO: 284171 - DNA, 631 bp, Homo sapiens
  misc_feature: GYAE6OF01BUKAP.14.57.F02.1.454.CMB.1.raw
  modified_base (204)..(204): a, c, t, g, unknown or other
  misc_feature (204)..(204): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtcttgtctccgaaggggaaanagcccaccctctcctgcgagggccagtcagagtgtacaacacaacttagcctggttcagcagagcctggccaggctccaggcctcncatgtatgatgctacncccancgggccacggcactcccagccaggttcagtcggctaggcgggtcngggacagtaccttcactcncaacctnccagcacgccgtagacgtcgtagtaacgtattttcgacttagttattacgtgtacgagtcgagggtcgggaacttaacgtcgggacctccgttaccgtaccgggtttccggggacggggggtaacctaacggggttaggtaaacggtttaccgaaaaccgggtacttacggggtacggtaccttacggacctaacccgtacgttccgtttaggttaccttacctaacgtttccccgttacccgtaaccg

SEQ ID NO: 284172 - DNA, 895 bp, Homo sapiens
  misc_feature: GYAE6OF01DFJ6M.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtcctccactccacccttgttctttgtcctaccggaaggggaaacgacgcccaccctcctccgtgcgacgggccagtacgaggagtcgtaccaaccaacctaaacttcgtccgtttaggttcacgacaaggaacgtccgtcgggaccgtacggcccttaccccgacggtccctaccgtacgtaacgttggttaatacggtacgtcggaaccctaacccgttacccccgaaccggaacccgggggtacccccgtaacccgggacctaacccgtacccccgaacggaccccgttacgggttaccgtcgggacggacggaccgggtcgggtaccggtaggggaaccgtacggtaccttaccgtaccttacccaccgtaacctacgtaaccgacgggaaccgaaccggtacggttaacggtacgttaaccggttaaggttaaaccgttttagttttaacggtaaacctttttacgggtttaaactttaccgttacggtactaaaccgggtacggtaaccggggttacgggtaacgttaaccgggtttcccgggaaccgtttacccggttaacgggtttacccggggggtttacccgggggtaaccggggggtaccgttaaagggggttacggttaaaccggtttaccggaaaaccgttgggtttacggacggtacgaccgtacctacgttcttccggttattacccttacgtaccttcccgtccgaccgttacg

SEQ ID NO: 284173 - DNA, 640 bp, Homo sapiens
  misc_feature: GYAE6OF01EGY49.14.57.F02.1.454.CMB.1.raw
tcagcgtctagtaccacgaccggtgctcgatttagctcgatatagttgggtttgggggaggaactgctcagttaggacccagagggaaccatggaagcccccagctcagcttctcttcctcctgctactctggctcccagataccaccggagaaattgtgttgacacagtctccactcaccctgtctttgtctccgaggggaagagccaccctctcctgcagggccagtcagagtgtcaacacctaacttagcctggtttcagcagaagcctggccaggcctcccaggctcctcatgtatgatgcactccccacgacgggccaccggcactcccagcctaggttcaggtggcgaggcgggtctgggactagaccttcactcctcaccatcagccacgcctacgtagtcgtagtaagttagtttagtacgttaagttttattacgttgtacgaggcgtacgggtcggggtactaaggttccgggaccgtcgttacgttaccgggtttaccgggggaccgggggtaaccgtaggggttaggtaacggttaaccgaaacgggtaacggttgggtcggtacgtacggcccgtaccgttacgttaccgttcgtttaccttaccttacgttcccgttaccgtaccg

SEQ ID NO: 284174 - DNA, 712 bp, Homo sapiens
  misc_feature: GYAE6OF01BPEM9.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttggaggtccgggggaggcttggtacgaggccggggggtccctgacacctcctcctgtgcacgcctcaggtattctatttttagcgtaatatgccatgagcgtgggtccgcgaggctccgagggagggctgggagtggtctccgcaatcgtagtggttactagtaggaagtacagttccggaccgcccgtctccggtggaacgggtcccggttctccgacttcctaccgaaggacgaactaaacttaccccgaaagtaacctacttaccgttaacttttccttaacgtaaaagtcggaacctacggtacccgttaaaggaaaacgaaccggaaacggtaaccgaaccgggggtcgtttaacggtttattttttacgggagttaacggtaaaagtaacgttaaccggtaaaagtttcctaaagttacgtaaacgttaaccccgttaaaggtttacgggggaacggggtttcccttttacgagtttcgggttccggtcgggggtaaacccgg

SEQ ID NO: 284175 - DNA, 554 bp, Homo sapiens
  misc_feature: GYAE6OF01EKUIU.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccacggcatcccagccaggttcagtgcagcggtctgggacagacttcactctcaccatcagcagcctagagtctgaagtatttgctagtttattactgtcagcaggcgggacaagttcggccgtctcgtacgtttcggggacggggggtaccgaagggtcgggtaagttacgaaaaccggtaacgtaggttacgggtcgttagccgaaccactcttgttccttacacttccttcccgcctacg

SEQ ID NO: 284176 - DNA, 718 bp, Homo sapiens
  misc_feature: GYAE6OF01EO78E.14.57.F02.1.454.CMB.1.raw
  modified_base (650)..(650): a, c, t, g, unknown or other
  misc_feature (650)..(650): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctggttggaggtccgggggagcttggtacgaggcccggggggtcctgacactctcctgtgcagcctcaggtattctatttttagcgtaatatgccatgagtcgtcgggtccgccgaggcctccgaggggacgggcgtgggagtggtctcagcaagtcgagttggttacgtaggtaggtaaacgtactaacgttccggaaccgtcccgttaccgtcccgggtaggaaaccgggggttcccggtttaccttcccgtaacgttacccgttcccgaaaggaacgtaaaccgttaaattacccgaaaggtaaacctaccttacctttaagtttttaccttaccgtaaaagttacgggtaacctaacggtacccgttaaaggaaaacggaacggtaaacggaccggtacggggtcgtttaggttactttttaggtagtagtaaagtataaggaacttntaagtgtaaactaacccgtaaggtttacgggggacggttcctttacgagttcggttcggtacgggggg

SEQ ID NO: 284177 - DNA, 654 bp, Homo sapiens
  misc_feature: GYAE6OF01CDLUQ.14.57.F02.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaanagcccaccctctcctgcagggccagtcagagtgtacaacaccaacttacgccttggtttcagcaggaacgcctggccaggcctcccgaggccttcctnattgtatggatcgcactcccacgacgggcccaccggcactcccgagccgtaggttcaggtcggacaggtcgggtcgtagggacacggtcttccacttcctaccaaccgtatccgaggacctacgtacctaggtacgtacgtaggtaaattacgttttgacgtttaagttttacttacgttgtacgtagcgtacgggaccgggtactaacgttcggtacccgtacgttccggttacggtttccggggaccgggggtaacgtagggtcggtaacggttacgaaacggtacggttggtacggtctacggtccaaccgtcgttcgttcgttaccttataccgttcccctcccggtacc

SEQ ID NO: 284178 - DNA, 444 bp, Homo sapiens
  misc_feature: GYAE6OF01B7KKC.14.57.F02.1.454.CMB.1.raw
  modified_base (421)..(421): a, c, t, g, unknown or other
  misc_feature (421)..(421): n is a, c, g, or t
  modified_base (437)..(444): a, c, t, g, unknown or other
  misc_feature (437)..(444): n is a, c, g, or t
tcagcgtctagtaccacgaccggtgctcgatttagctcgatatagttgggtctcagcaatcagtggttctagtgtaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcacgcctccaccaacgggcccagtccggtccttcccccctggccacccctccctccaagacgccaccctcgtggggccacacggtccggccccgtgggcctgccgtggtcaaggactacttccgtactaacgactgacgcgggntggacaggcgcatagnnnnnnnn

SEQ ID NO: 284179 - DNA, 575 bp, Homo sapiens
  misc_feature: GYAE6OF01ES4LW.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtcttgtctccaggggaaagagccaccctctcctgcagggccagtcagagtgtcaacaccaacttagcctggttcagcagaagctggccaggctccaggctctcatgtatgatgcatcccacagggccaccggcatcccagccaggttcagtggcagcggtctgggacagacttcactctcacatcaagtcagcctagagtcgtagaagtattttgctagttttattactgtacagcgaggcgggactaagttcggccgcgttcgtaccgtttccgggacgggggtacctaaggggtcggtaacggttacgaaaccgtacgtaggtcgggtactggaccgtacccgtagtccttcggttaccttcgtaacgtttcccgttccccggccttaaccg

SEQ ID NO: 284180 - DNA, 728 bp, Homo sapiens
  misc_feature: GYAE6OF01AZOT5.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttaattttaaaagatgtccagtgtgaggtgcagctggttggaggtccgggggagtcttggtacgaggccggggggtccctgaccactcctcctgtgcagcctcgaggtattctatttttagcgtaatatgctatgagtcgtgggtccgcgaggcctccgaggggagggctagggaggtcgggtctcgagactaagtccgtaggttaggttacgtaaggtagggtaaacgttacgtagttccggaccgtcccgttccgtaccggtagggtaaccgggtcccggtttacctccgacttccgtacccgaagtaacgtaacctaaacttaacccgaaagtaacccttaaccgttaacctttacttttaaccgtaactaaagttcggaacctacggtacctaaggaaacgaacgggaacggaacggtaaccggggttcgttagttttagttttacggtaggtaacgtaaaggtactaacggttaacgttcgtaagtcggtaaaccttaaccggttaaggtttacggggacggtttacgttacgtagttcgggtcggtaaccggggg

SEQ ID NO: 284181 - DNA, 828 bp, Homo sapiens
  misc_feature: GYAE6OF01DBQWW.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttgggaggtccggggggaggtcttggtacgacgggcccgggggggtccctggaccactctcctgtgcagcctcaggtattctatttttagcgaaatatggccatgagctggggtcccgccaggcctaccggaggggaaggggctgggaggtggggtcctcagccaaatcgaaggttggttactagggtaggaagtactagtttccggaccgtcccgtccgttacccggtagggaaacggggggttccccggtttccttcccgtaacgttccccgtaccccgaagtaacggtaacctaaaaccgtttacccgaaaaacggtaaaccctaaccctttacctttaaactttttaccgtttaaccctaaagttaaccggggtaaccctaacgggtacccttaaacggggaaaaacgaaccgggtaaaaacggacccggggtaaccggggtcggtttaacgggtttttaacgtttttttttgggaggtttaaacggtaaaagggtaaattaaccggtaaagtttaccttaaggtacgttaaaccggttaaaccccgttaaagggttttacgggggggtaaacgggtttccccgttttagtaacggttcgggttcgggttaacccggggggg

SEQ ID NO: 284182 - DNA, 611 bp, Homo sapiens
  misc_feature: GYAE6OF01CN1NE.14.57.F02.1.454.CMB.1.raw
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagcccaccctctcctgcagggccagtcagagtgtcaacaccaacttagccttggttcagcagaagcctggccaggctcccgaggcctcctcatgtatgatgcatcccagacggcccaccggcactcccagccaggttcaggtgcgaggtcgggtntggggacagtacttcactctcaccatcgancacgcctagacgtctagtaagttagtttgacgttagtttattacgtgttcaggtcgacgggcgggtactaagttcgggacccgtcgttaccgtaccggtttcggggaaccgggggttacgaagggttggtaacgttaccgaaacggtaacgtggtacggtcgtacgaccgaccttacgtcgttcggttacctttaccgacgtttccccgttcccgtccgttaccg

SEQ ID NO: 284183 - DNA, 660 bp, Homo sapiens
  misc_feature: GYAE6OF01AE9IO.14.57.F02.1.454.CMB.1.raw
  modified_base (428)..(428): a, c, t, g, unknown or other
  misc_feature (428)..(428): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaacgcctggccaggcctcccgaggcctcctcatcgtatgatcgcactcccacgacgggcccaccggcactcccagccaggttcagtcggcaggcgggtctggggacaggtaccttcacgtcctacacccatcagccacgtacctaggacgttcgtagtaacgttnttttacggacttagttttaacttacgttgttacgacggtcgaacgggtccggggtactaacggttccgggtcccgtaccgttaccggtaccgggtttaccgggggaccggggggtaaccgtaacggggtcggtaacggttaccggaaacggtaccggttgggtacggtaccgtggacctaccgtacttccgttacgttcctttaccgtaccttcccgttacccgccgttacg

SEQ ID NO: 284184 - DNA, 762 bp, Homo sapiens
  misc_feature: GYAE6OF01CXZSS.14.57.F02.1.454.CMB.1.raw
  modified_base (200)..(200): a, c, t, g, unknown or other
  misc_feature (200)..(200): n is a, c, g, or t
  modified_base (300)..(300): a, c, t, g, unknown or other
  misc_feature (300)..(300): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccacggagaaattgtgttgacacagtctccactcaccctgtcttgtctccgaggggaaangccacctctcctgcgagggccagtcagagtgtccaaacaccaacttagccttggttcagcagaacgccgtggccaggcctcccaggcctcctacatgtangatgacactcccgacgacggccacggcactcccagcctaggtcaggtggacgaggcggtcagggactacggtacttcgaccttcgtacaccctataccgacgtccacgaccgtaggtaacgttacgtacggtaaagttacgttttcggtacgtttaaacgtttttaagttaccgttaggttaccgtacggtaccggtacgggtaccgggtacgttaacggttcgggtacccgttaccgttacccggttaacccggggttttaccggggggaacccgggggggttaaaccgggtaaacgggggttaccggggttaacgggtttaaaccggtaaaaccgggttaaaccgggttacgggtaccgggtaccggttacggtaccccgtaaacccggttaccgtttaccgtttacggttacccctttaccgtacccgtttccccgttacccggtacccgtttacccgg

SEQ ID NO: 284185 - DNA, 629 bp, Homo sapiens
  misc_feature: GYAE6OF01D8EBW.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcacctgtctttgtctcgaggggaaanagccaccctctcctgcagggccagtcagagtgtacaacacctaacttacgccttggtttcagcagaacgcctggccaggcctcccgaggctcctcatgtatgatgctactcccgacgcgggcccaccggcactcccgagtccgtaggtccaggtcggcgaggtccgggtcgtacgggacacggtacttccactcctacaacacgtcgaacgccacgtacctacggacgtacgtagtaagttagtttagacttagtttacttacgtagtcgtagcgtacgggtcgggtacgtaacgttcggccgtcgttaccgtaccgggtttaccggggacgggggtaacgtacgggttggtaacggtacgtaaaccggtaagtcgtcggtagtcgacgaccgtatcgttcgtacttctacgttccgttcccgtaccg

SEQ ID NO: 284186 - DNA, 799 bp, Homo sapiens
  misc_feature: GYAE6OF01EEPTN.14.57.F02.1.454.CMB.1.raw
tcagcgtctagtaccacgaccggtgctcgatttagctcgatatagtttggggtttgggggggaactgctcagttaggacccagagggaaccgatggaagccccagctcagcttctcttcctcctgctactctggctcccacgataccaccggagaaattgtgttgacacagtctccactcaccctgttctttgtctccaggggaaagagccaccctctcctgcgagggccagtcagagtgtcaacaccaacttacgcctggttcagcaagaacgccgtcggccacggcctcccgaggtccttcctactattacgtatagtgtcgactacctaaccccggacggacccggggacccgtaaccgggcctaccgttaccccgaaccggtcccgtaaacggggttttccgacgggtacgggccgtaacggggtccggggttacgggttacggggaaccggtaacgggtcctttaacccgaacccgttttccctaacccgtaacccaaacctttaccgaccggttaacggaccggtaacccgtaacgggtaaccgttaaccgttacgggttaaaggttttaacgtttagttaaccggtttaaggttttaactttaacgggtttcgtaacgttacggacgacggggtcgggtaacgtaacggtcgtccgtccgtcgttccgggttacggggtaccggggtacgtaggggacggtacgtaacgggaacgtacggtagtcggacggtacgccgtaacgtacgtccgttacgttccgttaccgtacgtttccctccggtccttaaccg

SEQ ID NO: 284187 - DNA, 782 bp, Homo sapiens
  misc_feature: GYAE6OF01DYVL0.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagacgccaccctctcctgcgagggccagtcaggagtgtaccaacacctaacttacgtccttggtttacagcaagaagcctcggccaggcctcccgacggtcctccgtcaagttcgtatggactcgacactacccgacggtacgggcccaaccggcaccgtcccgacgccgtacggttcgacggtcggaccgacgggtccgggtcggtacggggtaacgtacggtaccgttaccgtaccgttcctacccgacccgtactaccgtaacgacccgtacgtacccgtaagggttaccgttacggtaacggttaagttttaacgttttacgggtaacgttttaaggttttaacttttacgttcggttaaccgacggtacggtacgggacccgggtagttaacggttcgggaccctttaccgtccggttacggggtttacccgggggacgggggttaaacggaacgggttacgggtaaccggttaaccggtaaacgtacgggttacgggtacggtccgttacggaccttaaacgtctttacggttaccgttcttacctacccgtttccccgttcccgtacgtttaccg

SEQ ID NO: 284188 - DNA, 763 bp, Homo sapiens
  misc_feature: GYAE6OF01BO1GW.14.57.F02.1.454.CMB.1.raw
  modified_base (474)..(474): a, c, t, g, unknown or other
  misc_feature (474)..(474): n is a, c, g, or t
tcagcgtctagtaccacgaccggtgctcgatttagctcgatatagttgggtttggggggaactgctcagttaggacccagagggaaccatggaagccccagctcagcttctcttcctctgctactctggctcccagataccaccggagaaattgtgttgacacagtctccactcaccctgtctttgtctccgaggggaaagagccacctctcctgcagggccagtcagagtgtcaacaccaacttacgccttggtttacagtcagaacgccgtggccaggcctacccgaggcctacctcattgtatgatgcactcccacgacgggcccaccggcacgtcccgagcccgtaggttccaggtcggacgacggtccggggtcgtggggaaccacggtacgtttaccgacttcctaccgaaccctaagttcccgaggtaccacggtacccgtaaggtacgttccgtagggtaaagttntttttacggaacctttaagttttaacgttttaccgtagggtacctaaggacccggtagggtaccggggtacttaacgggttcggtaccccgtacggttacccggtttaaccgggtttacccgggggggaccccggggggtaaacgttaacgggggttacggggaaaccggttttacggaaaaacccgggttacggttacgggttcggaaccgtttgggacccttaccgtaccgtttcgttaccggttacccttacctacgggtttaccccttccccggacctttaccgg

SEQ ID NO: 284189 - DNA, 698 bp, Homo sapiens
  misc_feature: GYAE6OF01B5KMM.14.57.F02.1.454.CMB.1.raw
  modified_base (198)..(198): a, c, t, g, unknown or other
  misc_feature (198)..(198): n is a, c, g, or t
  modified_base (289)..(289): a, c, t, g, unknown or other
  misc_feature (289)..(289): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcacctgtctttgtctccaggggaangccacctctctgcagggccagtcagagtgtacaacaccaacttcgaccttggttcagcagaacgcctggccaggcctcccgaggcctcctnatgtatgatcgccactccccgacgacgggcccaccggtcaccgtccccaggtcccgtaggttcacggttggccgtacggccggggttactacggggaacctaggtacctttccaaccgtttcctaccaaccctaagtccgaaacgtccgaacggtacctaacggtacgttactaacggtaagttacgttttacgacgtttagttttaaccttacgttacgtacgtaggtacgtagggtaccggggacttaacggttcggtacccgtcgttaccgttaccgggtttacgggggacccggggggtaaccgtaaggggtacggttaacggtaaccgtaaacggtacgttaggtcggcgttagaccctacgtattccgttacgttactccttacgtttccctcccgtcgtacg

SEQ ID NO: 284190 - DNA, 881 bp, Homo sapiens
  misc_feature: GYAE6OF01CJCUM.14.57.F02.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagactaccaccggagaaattgtgttgacacagtctccactcaccctgttcttgtctcgaggggaaagcnccgaccctctcctgcgagggccagtcagtagtcgtacaaaccaccgtaacttacgtccgtttaggtttaccaggtacaaggtaaccncccgtaggcccgtaggtccctacccgaggtccttacccgtacgaacttggtaatcgtaagttcgacctaccgttccccgaacggaaccgggtcccgaaccggcctaacccgtccccgaaggtccccggttaggtttacccgagggttccggcgtaacggggtccggttaccggtaggggtaaccctaggttaccctttaccgtaaccgttaccctacgaaccctaagtcccgaacggtacccgtaacggtaccggtacggtaacgtttccggtaaagtttaaacgggtttacctttttaaggtaccgttttaaccggtttttttaaactccgggttttccgggtacctaacggggttacctaaacgggggtacccgggttaacgttaaacccgggtttccgggaccccggttcgtttaaccccgggggtttcggggtttaacccccggggggggaaaccgggttaaccggaacgggtttacgggtaaaaccgggttttacccaaaaacccggggttgtacggggtgaaccccggttgaaacccgtccctagtttcgtccgtttacccttgtacccttcccgttcccgta

SEQ ID NO: 284191 - DNA, 430 bp, Homo sapiens
  misc_feature: GYAE6OF01ADB5S.14.57.F02.1.454.CMB.1.raw
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
  modified_base (405)..(430): a, c, t, g, unknown or other
  misc_feature (405)..(430): n is a, c, g, or t
tcagcgtctagtaccacgaccggtgctcgatttagctcgatatagttgggtctcagcaatcagtggttcctagtggaagtacattcgaagccgtctccgtgaagggccggttctccatctccagagacaattccaagacactctattcttcaaatggacagcctgaaagacgaagacacgggcgtgtatttttgtgtgaaagatacgaagtctatgatacccaatttggggaggggcctttcatgtctggggccaagggacgctggtcaccgtctctcagcctcacaggccatcgcttccccngcaccctcctcangcacctctggggcacgagcggccctgggctgcctggtcaaggactacttccgtactagacgcgtgacgcggctggcaaggcgcatacgnnnnnnnnnnnnnnnnnnnnnnnnnn

SEQ ID NO: 284192 - DNA, 645 bp, Homo sapiens
  misc_feature: GYAE6OF01CPFEF.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagcccaccctctcctgcagggccagtcagagtgtcaacaccaacttagcctggtttcagcagaagcctggaccaggcctcccgaggcctcctcatgtatgatgcactcccacgacgggccaccggcactcccagccgtaggttccagtggcgaggccggggtcgtggggacacgtacttcactcgtcacctatcagacacgacctagtacgtacgtagaagttattttgacgttagtttacttactgttacagcgacggacgggtactaacgttcggtccgtacgttaccgtacgggtttccggggaccgggggtaaccgtaacggggttcgggtaacgttaaccggtaaacggtaccggttaggttacggccgttcggaccgtacctacgttccgtttcgttactttaccgtaccgtttccccgttccccggtcttaacccg

SEQ ID NO: 284193 - DNA, 800 bp, Homo sapiens
  misc_feature: GYAE6OF01E3576.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcgagggccagtcagagtgtcaacaccaacttagccttggttcagcagaacgcctggccaggcctcccgaggcctcctcatgtatgatgacactcccgacgacgggacccgaccgggaccaccgtccccacgcccgtacggttcgaggtcggcgacggtccggggtcgtcggggaacaggtaaccttcgaccttccctaccaaccctataccgacgaccgacggtacccgtaggtacggttacgtaggtaaacgttagttttttcgacgtttaaggtttttaactttaccgttcggttaccgaacggttcggaaccggggtcgggggtaaccgttaacgggtttcgggaccccggttaccgtttacccggttaacccggggtttttaccggggggggaacccgggggggtaaaccggttaacgggggttacggggttaaaccggtttaaaccgggaaaaccgggttaaaccgggttcggggttacgggtacccgttaccggaacccgtaacccgttacgtttcccggtttccggttaccttttaccgtaccccttttccccgttacccccggccctttaaccgg

SEQ ID NO: 284194 - DNA, 800 bp, Homo sapiens
  misc_feature: GYAE6OF01B85OP.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccagtggtagtttgggctgagttggcttctttcttgtggtcttaattttaaaagatgtccagtgtgaggtgcagtctggttggaggtccgggggagtcgttggtacgacggggtcccggggggtccctgacctactcctccgtgtcgcacgcctcgaggtatttaccgttaatttttacggacgtaaattacgtcgaccagtggacgtcggttcgggtcccgccgacggtccgtaccggaaggggacgggtcgtagggaggtcggtactcgagactaagtcgtaggttggttacgtaggtaaggtaacgtacgtacgttaccgaccggtcccgtaccgttaccgggtacggtacccggggttcccgttcctacccgtacgttcccgtaaccggaaggtaaccgtaaacctaaacttaacccgaaaacgtaaccttaaccctttctttaaacttttacccgttaaataaaaccggttcgaaaccgtacggttaacccgtaaaggaaacggtaaccggaaacggtaccgggtaccgggttagtttaggttttacgtttagaggttaaaacgtaagtacggtaaagtaacgttctagtaacggtaaccgttaacggttaagggttacggggtaccggtttaccttagtaccggttgggtccgggtaacggggg

SEQ ID NO: 284195 - DNA, 771 bp, Homo sapiens
  misc_feature: GYAE6OF01DIM8H.14.57.F02.1.454.CMB.1.raw
  modified_base (606)..(606): a, c, t, g, unknown or other
  misc_feature (606)..(606): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctgctcccagataccaccggagaattgtgttgacacagtctccactcacccttgttctttgtctccgaaggggaaagacgcccaccctctcctgccgacgggccagtcgagtagtcgtacaaccacctaacgttacgccgttaggttacagactaggaacgcccgtaggacccgaggcctaccccgaggtccttcccgtactacgttgtactgtacgtcgacctaccgtccccgaacggaccggggaccccaccgggtaccctaccgtacccccgaggtaccccgtaaggtttccggaaggtcgggacccggtaggtaccgggggttacgtaccggggaaccgtaacggttaacccttcccggtaacctttcccgtaacctaaccccgtagttacccgacgtaccgaccgtccgtaacggtacgttacgtaagggtaagtttacgtttagtacctttaagttttactacgttacgtacncgaccgtagggacggtacgttaacgttccgggaccgtacccgtggttaacccgggttccgggggaccgggtaacggtagggtacggttaacgtacggaaacgtcgtacggtcgacgtacgctacgtacgttccgttcgttacttcccgcttcccgtccccgtacg

SEQ ID NO: 284196 - DNA, 732 bp, Homo sapiens
  misc_feature: GYAE6OF01C5KMY.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgagtgcagctgttggaggtccgggggagcttggacgaggccggggggtccctgacactcctctgtgcagcctcaggtcttctatttttagcgtaatatgaccagtgagcgtcggggtcccgccgaggcccgtaccggaaggggaaggggcgtagggagtgggttcctagacgcaagtcgaaggttggttactaggtaggaacgttacgtaagtttccggaccgtcccggttccgtcccgggtaggtaacggggttcccgttcgtccctaacgtcccgtaccgaagacgtaacctaactttacccgaaagtaacctacttacctttaattttacccttaaccgtaaagttacggaacctacgtacccgttaagaaaaacggaaccggaaacgtaacggtacgggttacgttggtttaatttttggtaggttaacggaaaacgtacgttacggtaaacgttcgttaagtacgtaaacgttaacccgttaaaggtttcggggtaaacgggttcctttacggttacgtcggttcggtaaccggggg

SEQ ID NO: 284197 - DNA, 619 bp, Homo sapiens
  misc_feature: GYAE6OF01CLKEY.14.57.F02.1.454.CMB.1.raw
  modified_base (262)..(262): a, c, t, g, unknown or other
  misc_feature (262)..(262): n is a, c, g, or t
  modified_base (272)..(272): a, c, t, g, unknown or other
  misc_feature (272)..(272): n is a, c, g, or t
  modified_base (471)..(471): a, c, t, g, unknown or other
  misc_feature (471)..(471): n is a, c, g, or t
  modified_base (577)..(577): a, c, t, g, unknown or other
  misc_feature (577)..(577): n is a, c, g, or t
  modified_base (591)..(591): a, c, t, g, unknown or other
  misc_feature (591)..(591): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagcgccaccctctcctgcgacgggccagtcagagtgtacaacacaactagccttggttacngacagacgcnggccgaggcctccaggctcctcatgtatgatcgcactcccgacgacggaccaccggcacctaccccgacgtccgtaggttcgacggtcggcgacgggtacgggttcgtaggggacacgtacttcaccgtctaccactactacgacgcacgtactagacgttcgtagtaagttagtttacgactttagtttactacgttntacgagtacgacgggacgggtactacggtcgccgtcttaccggttcgggttaccggggacggggtaacgtaggtacggtaacgttacgaaacggtagttcggtcgngtacgaccgtacgnttctcgtacttcctacttccgtcctacg

SEQ ID NO: 284198 - DNA, 610 bp, Homo sapiens
  misc_feature: GYAE6OF01A3KWN.14.57.F02.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (361)..(361): a, c, t, g, unknown or other
  misc_feature (361)..(361): n is a, c, g, or t
  modified_base (549)..(549): a, c, t, g, unknown or other
  misc_feature (549)..(549): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagactaccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggcctcctnatgtatgatgcactcccaacgacgggccaccggcactcccagcctaggttcagtcggcaggcgggtcngggacagacttcacttcacgaccatccgagacacgtcctaggacgtctagtaacgttagttttcggacttagtttacttaactgtactagcgtaggccgggataacgttcggaccgtctacgtaccggtttccggggacgggggaccgtaagggtcggtaacgttacgaaaaccgtaacgtggtcggngttaccggctaacccgaagttccttacggttcttacccgtaacttcccgttccccgtaccg

SEQ ID NO: 284199 - DNA, 572 bp, Homo sapiens
  misc_feature: GYAE6OF01EL9F9.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacgaggcccgggggggtccctgacactcctcctgtgcagcctcaggattcatttttagcgaatatgccatgagctgggtccgccgaggctccgaggggaaggggctgggagtgggtctcgagcaatcagttggttctagtggaagtacattcgacgccgtctccgtggaacgggtccggttctccgatctaccagagactaattccaagacactctatttctacaatgacagcctagaaacgacgaagacgacgggcttgttattttgtgtagaaagtagtaacgtagtctaatgacttaacccgtaagtttcgggacgggttacctttagattgtcgtaccggggg

SEQ ID NO: 284200 - DNA, 611 bp, Homo sapiens
  misc_feature: GYAE6OF01EQDY3.14.57.F02.1.454.CMB.1.raw
  modified_base (374)..(374): a, c, t, g, unknown or other
  misc_feature (374)..(374): n is a, c, g, or t
  modified_base (456)..(456): a, c, t, g, unknown or other
  misc_feature (456)..(456): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttacgcctggtttcagcagaagcctggccaggctcccaggctcctcatgtatgatgcactcccacgcgggccaccggcactccccagccctaggttcaggtggcgaggcgggtcagggacagtccttcnctcctcaccatacgacgcacgctagagtcgtagtaagtattttgacttagtttaacttacgtgtcgagtcgaggtaccgggntaacgtcggccgtcgtccgtacggtttccggggacggggtaacgtacgggttggtaacggttaccgtaaaccggtaacgttcggtacggtcgtacggcccgaacctaccgttcgttacccgttctttaccgtacctttcccgttcccccggtacc

SEQ ID NO: 284201 - DNA, 642 bp, Homo sapiens
  misc_feature: GYAE6OF01CVQUC.14.57.F02.1.454.CMB.1.raw
  modified_base (365)..(365): a, c, t, g, unknown or other
  misc_feature (365)..(365): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaaggggaaagagcccaccctctcctgcagggccagtcagagtgtcaacaccaacttagcctggttcagcagaagcctggccaggcctcccgaggcctctcatgtatgatgcactcccacgacgggcccaccggcactccccagcccaggttccaggtcggcaggcgggtcngggacagcttcgactctcaccatcagcacgcccgtagacgttcaggtaattagttttgacttagttttattacgtgttcaggtctagggccggggtactaaggttccgggcccgtaccgttacccgtaccgggttttccgggggaccgggggggtaaccccgtaagggggttacgggtaacgtttaccggaaaacccggtagttcgggtaggtccgtacggtcccaaccgttacttccgttcggttacctttccgtacttcccgttccccggtaccc

SEQ ID NO: 284202 - DNA, 689 bp, Homo sapiens
  misc_feature: GYAE6OF01BKGV7.14.57.F02.1.454.CMB.1.raw
  modified_base (204)..(204): a, c, t, g, unknown or other
  misc_feature (204)..(204): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaaggggaaancgcccaccctctcctgcgagggccagtcagagtcgtacaaacacctaacttagcccttggttcagcaggaacgccgtcggccacggcctcccgaggcctcctcatgtatgaatcgcactcccacgacggacccaccggcactcccgagccgtaggtcagnggcgaggcggtntgggacagtacttcgactcctacgaccatcacgcacgtacgtagtacgtacgtagtaagttacgtttgacgttacgttttaagtttccgttaggttacgacgttacggacgggtacgggtacgtaacgttacgggtccgtaccggttaccggttacggggtttaccggggaaccggggggttaaccggtaacggggttacgggtaacggttaaaccggaaacgggtaacgtacgggttacggcggttacgaccgtaccgtaacgttccgttacgttacctttaccgtacgtttacccttcccgtcgttaaccg

SEQ ID NO: 284203 - DNA, 586 bp, Homo sapiens
  misc_feature: GYAE6OF01A99D5.14.57.F02.1.454.CMB.1.raw
  modified_base (293)..(293): a, c, t, g, unknown or other
  misc_feature (293)..(293): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcaggaagcctggccaggcctcccgaggcctccncatgtatgatgcactcccacgacgggcccaccggcactcccagcctaggttcaggtcggcgaggcgggtcgtgggacagccttcacttccacaccatcagcagcctaggacgtcgtagtaagttatttcgacttagtttattactgtctagacgacggcgggataacgttcggcctcgtccgtacgggtttccgggaccgggggtacgtaaggggtggtaacgttacgaaacggtacgtacggtcggcgtcgacacccgtattcgtcgttcttctacttccctcccgtctacg

SEQ ID NO: 284204 - DNA, 986 bp, Homo sapiens
  misc_feature: GYAE6OF01CXGGI.14.57.F02.1.454.CMB.1.raw
tcagcgtctagtaccacgaccggtgctcgatttagctcgatatagttgggtttggggctgagagaggagcccagtcctgggatcttcaggttgttttcatttggtgatcaggactgaacagagagaactcaccagtggtaggttgggctgagttggcttctttcgttggtggtacttaaattttaaaagatcgtcctagtggtggaggtgcagtcgttggttgggacgggtccggggggaggtcgttcgggtacggacggggtcccgggggggtccctgacctaccgtcctccgtggtcgccgacgtcctacgaggtactttcttaagtttttagacgtaatacgtcggactagtcggacgtcggtaccgggtcccgccgacggtaccgtaccgggaagggggtacggggacggtggggtacgggttcgggtaccgtacgtacgaacgtaacgttacggtggtttaacggttacggtaagggttaacgggaaacggttaacgtaaccggttacccggacccggtttaccccgttccggttacccggggtacggggtaaacccgggtttccccggttacctttaacccgacctccggtaaaccgaacggtaaacgtaaaacccttaaaccgttaacccgaaaaacggtaacccttaccgtttaacccttttaaaccgttttaccgttaaaccgtaaacggttaaccggtaacgaacccggttaaacccgggtaaaaacgggaaaaccgggaaaccggggtaaaccggtaaccccggggtaaggggtttaccggttttaaggttttttacggttttaacggagggtttaaaaggaaaccgggttaacctaaaccgggtttaagtttaaccgttaaggttaaacccgttaaacccggtttaaacccggggtttaaggggttttaacccggggggtacggtttacccgtttaaggtacgggttacccggggttaacggggtaaccggggg

SEQ ID NO: 284205 - DNA, 642 bp, Homo sapiens
  misc_feature: GYAE6OF01AYA4W.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctaattttaaaagatgtccagtgtgaggtgcagctggttggaggtccgggggagcttggtacagggccggggggtccctgacactctcctgtgcagcctgaggtacttctatttttagacgaatatcgaccagtgagcgtgggtcccgccgaggcctccggagggggacgggcgtgggaggtgggtctacgagcaatcaggttcggttacgtaggtaggaaagtacagtttcggaccgtcccgtcgtccggtaggtaacgggtcccgttctaccattccgtaccgagacgtactaacttaccaagtaacctacttcttaatttctaacaatacggaacagcctaagaaacgacgaacggaacgtacgggacttagtttagtttgtagtaagaaagtagtaacggtaagtctaagtagtaacttaacccgtaaggtttcgggtacggggtttccttagtacgttggtcgtacgggg

SEQ ID NO: 284206 - DNA, 689 bp, Homo sapiens
  misc_feature: GYAE6OF01ARQBU.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcagggccagtcagagtgtcaacaccaacttagcctggtttcagcagaacgcctggccaggcctcccgaggcctcctcatgtatgactgaccactcccacgacggcccgaccggcactccccgagcccgtaggttcaggtcggcgaggtccgggtcgtagggaccaggtaccttcacctctaccacctactaccacgaccacggtcctaaggtacgtccgtagtaagttacttttgactttaagtttaacttacgtgttacgacgtacggacgggtacggggactaacggttcgggtacccgtccggtttcccggttaaccggggttttacccggggggtaccgggggggtaaacccggttaagggggttacgggttaaacgggttaaccggaaacggttacggtagggtccgggtactcggtacctacccgagttcgttacgttccttactacctcccgttccccgtctaccg

SEQ ID NO: 284207 - DNA, 613 bp, Homo sapiens
  misc_feature: GYAE6OF01AFLMO.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccgggagaaattgtgttgacacagtctccactcaccctgtctttgtctccaggggaaagagccaccctctcctgcagggccagtcagagtgtacaacaccaacttagccttggtttcagcagaagcctggccaggcctcccgaggcctccgtcatgtatgactgcactcccacgcgggcccaccggcactcccagccaggttcaggtggcgtaggcgggtcgtggggacacgtacttcactctcaccatcacgcacgaccgtagacgtcgtagtaagttgtttagtacgttagttttacttacgtgtacgagcgacgggtcgggactagttcggccgtcgtcgtacgggtttcggggaccgggggtaacgtacgggtagggaacgttacgaaacggtacgtcggtggtcggtcgtcggaccctaccgtcgttcgttcgttacttaccgtacctttccccgtcccgtaccg

SEQ ID NO: 284208 - DNA, 621 bp, Homo sapiens
  misc_feature: GYAE6OF01E5TBH.14.57.F02.1.454.CMB.1.raw
  modified_base (341)..(341): a, c, t, g, unknown or other
  misc_feature (341)..(341): n is a, c, g, or t
  modified_base (420)..(420): a, c, t, g, unknown or other
  misc_feature (420)..(420): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtcctgacactctcctgtgcagcctcaggatttctatttttagcgtaatatgccagtgagctcgggtccgccgaggcctccgaggggaaggggctggagtgggtcncgagcaatcgagttggttactaggtggaacgtacagttccggacgtcccgtccgtccggtaggaacgggtcccgtttcncctatcctaccgagagacaacttaccaagaactactcttatttctacaagtcgaacagccgagaaagaacgaagacgacgggtcttagtttatttttaggagtagaaagtacgtaacgtaagttctaagtacgtaacgttaaccccgtaaaggttttcgggggaacgggttcccttttagatttcgggtcggtaccggggg

SEQ ID NO: 284209 - DNA, 595 bp, Homo sapiens
  misc_feature: GYAE6OF01ELXIL.14.57.F02.1.454.CMB.1.raw
  modified_base (198)..(198): a, c, t, g, unknown or other
  misc_feature (198)..(198): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcacctgtcttgtctccaggggaanagccaccctctcctgcagggccagtcagagtgtacaacaccaacttacgccttggttcagcagaagcctggccaggcctccaggtcctcctcattgtatgatgcactcccacacgggcccacggcactccccagcctaggtcaggtcggcaggcgggtntcggggacaggacttcactctaccacatcagcagctagacgtnagtagtatttagacttagtttacttacgtgtcgacgtacgagggtcggggactaacgttcggtcccgtacgttcggtaccgggtttccggggaccgggggtaccgtagggtacggtaggttacgaaacggtacgtaggtcggtcgtaggaccacctacgtcttacggtccttacgacttcccgtcccgtcctacg

SEQ ID NO: 284210 - DNA, 627 bp, Homo sapiens
  misc_feature: GYAE6OF01ETZGI.14.57.F02.1.454.CMB.1.raw
  modified_base (200)..(200): a, c, t, g, unknown or other
  misc_feature (200)..(200): n is a, c, g, or t
  modified_base (421)..(421): a, c, t, g, unknown or other
  misc_feature (421)..(421): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccagtcagagtgtacaacaccaacttacgccttgggtttcagtacaggtaacgcctggccagggcctcccgaggcctcctcattgtactggactgacctactcccgacgacgggcccaccgggcactccccgagtcccgtaggttcgaggtcggaccagggccgggtcgtaggggaacacgtacttccactctaccacctntccagcacgtacctacgtacgtcgtagtaagttatttagtacgttaagtttattacgtgttacagcgtaggcgggtactagttcggccgtcctcgtacgggttcgggacggggtacagggtcggtaacgtacgaacgtacgtcggtacggacgtgaccgtctacgttcgttacgttccttacgtaccttcccgttccctccgtacg

SEQ ID NO: 284211 - DNA, 863 bp, Homo sapiens
  misc_feature: GYAE6OF01AUYG9.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttgctcttcttgtgactattttaaaagatgtcagtgtgaggtgcagctggttgggacggtccgggggaggtcgttggtacgacgggcccggggggtccctgacctactcctcctggtgcacgcctacgaggtacttcgttaagtttttacgacgtaatagtcgacctaagtgacgtcgtcggggtcccgccgtacgggcctaccggaagggggtaggggtccgtgggacggttgggtctcgagactaacgtcgaggttcggttacgtaggtacggaacgttacgtacgtttccggaaccggttcccggtaccgttaccggtaacgggtaaccggggttccccggtttcccgtacccgtacttcccctaaccggacggtaaccgtaaaccgtaaaccgttaaccgaaaaccgtaaacctaacctttaccttttaaacttttacccttaacgtaaacggtccggtaaaccgtaacgtaaccgtaacggaaaacgtaaccgggaaacggaccgggttaaccggggtacgtttagggtttttaaggttttacggttaaggttaaacggtaaaagggttaacgttaaaccggttaaacggtttaccgttaaagttaccggttaaaccggttaaacccccgtttaaaggggttttacccgggggttaacggggtttaccctttaggtttacgggttcgggttccggggttaacccgggggg

SEQ ID NO: 284212 - DNA, 632 bp, Homo sapiens
  misc_feature: GYAE6OF01CV3FO.14.57.F02.1.454.CMB.1.raw
  modified_base (201)..(201): a, c, t, g, unknown or other
  misc_feature (201)..(201): n is a, c, g, or t
  modified_base (312)..(312): a, c, t, g, unknown or other
  misc_feature (312)..(312): n is a, c, g, or t
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggcctcccgaggcctcctcatgtatgatgcatcccacgngggccaccggnactcccagccaggtcagtggcnggcggtctgggacagacctnactctcaccntcagccagtaccgtagtacgtctacgaagttattttcgacttaagttttcgttacttggttaccagccgtagggcggggtactaaacggtttcgggacccgtcgttaccggttaaccgggtttccgggggaaccggggggtaccgtaaggggttcgggtaacggttaaccgaaaccggtaacgttcgggtacggccgttcggacctaccgtacgttcttacggttaccttctacgtttaccctccccgtcctaaccg

SEQ ID NO: 284213 - DNA, 607 bp, Homo sapiens
  misc_feature: GYAE6OF01ANL0X.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagcgccaccctctcctgcagggccagtcagagtgtcaacaccaacttagccttggtttcagcagaagcctggccaggcctcccgaggcctcctcatgtatgatcgcactccccgacgacgggcccaccggcacctcccaggtcccagggtttcaggtcggcgagggcgggtcgtcgggacacggtacttcacctcgtacaccatcaacgcacgtacctaggacgtctagtagttatttcgacttagtttacttacgtgtaccgagcggtacggtcgggtacttaacgttcgggccgtccgtacgtaccggttcggggaccggggaaccgtagggtacgtagttaacgaacggtacgtggtcggtcgtcggcctactgtccgtattccttacctctcccgtcccgtac

SEQ ID NO: 284214 - DNA, 568 bp, Homo sapiens
  misc_feature: GYAE6OF01BZPBI.14.57.F02.1.454.CMB.1.raw
  modified_base (202)..(202): a, c, t, g, unknown or other
  misc_feature (202)..(202): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (450)..(450): a, c, t, g, unknown or other
  misc_feature (450)..(450): n is a, c, g, or t
  modified_base (534)..(534): a, c, t, g, unknown or other
  misc_feature (534)..(534): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaangccaccctctcctgcaggccagtcagagtgtcaacaccaacttacgcctggtttcagcagaagcctggccaggcctcccgaggcctcctcatgtatgactgcactcccacgacgggcccaccggcactcccgagccgtaggttcaggtcggcgaggtcggtcgtggggacagtaccttcgactccgtacaccatcagcacgctagagtnagtaatntttgagtagtttatcgtntcngcgagggcggntagtcggccgtctcgtacgggttcgggacggggtaccgtagggtcggtaaggtaccgaaacggcgtggtacgtcgtacgcactntcgtcgttctacgtacttcccgtcccgtcgtacg

SEQ ID NO: 284215 - DNA, 940 bp, Homo sapiens
  misc_feature: GYAE6OF01EPJRS.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttaattttaaaagatgtccagtgtgaggtgcagctggttggaggtccgggggagtcgttggtacgacgggcccggggggtcctgacactctcctgtcgcacgcctcgaggtattctaagtttttagacgtaattatcgacctagtacggacgtccggttcggggtaccccgccggacgggtacccgtaccgggaagggggtaacgggggtccgtagggggtacgggttcggggttaccttacgaacggtaaccgtaacgttaccggtagggtttcggtttaaccggtaacgggttaaggggtaaacgtttaaccgtaacgtttcccgggaaccggtccccggtttacccggtacccgggtaccgggtaaaccggggttccccggtttacccttaccgtaaccttcccgtaacccgaaggaaccgtaaccgtaaacgttaacccgaaaacgtaaaccctaacccgtttacttttaaacttttaccttaaacgtaaacgtaccgggaaacctaaccgggtaccgtaaaggaaaacggtaaccgggaaaacggtaacccgggtaacggggtttccggttttaagggtttttaacgtttttacgggtaacggttaaacgggtaaaacgtaaacggttaaaacggttaacggtttaaccgtttaaagttaccggttaaaacccgttaaacccgggtttaaaggggtttacccgggggtaaccggggttttaccttttaacggtacggtttacggggttccggggttaaacccgggggg

SEQ ID NO: 284216 - DNA, 745 bp, Homo sapiens
  misc_feature: GYAE6OF01CIT6H.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctatttaaaagatgtccagtgtgaggtgcagctgttgggagtccgggggaggcgttggtacgaggcccgggggggtccctgacactcctcctgtgcagcctcaggtattctaatttttagacgaattatcgccatgacgcgtcgggtccgccgaggcctccggaggggaacggggctagggaggttgggtctcgagtacgaaattcgtaaggttggtttacgtaaggttacgggaaacgttactagtttccggaaccgtcccggtaccgtcccgggtaggtaaacccggggtcccggtttacccttccgacttcccgtacccgaagtaacgaaccgtaaactttacccgaaaacgtaacctaccgttacctttaacttttaccttacgtaaacttacgggaactaacgtaccgtaaggaaaaccggtaacggaaacggtaaccggtacggggtaccgtttaggtttacgttttaggttagtaaggaaaagtacgtaacgtaaagttacgtaagtaggtaaccttaaccgtaaggtttacggggacggggttaccctttagtacgttggtcggtacgggg

SEQ ID NO: 284217 - DNA, 892 bp, Homo sapiens
  misc_feature: GYAE6OF01BOIFI.14.57.F02.1.454.CMB.1.raw
  modified_base (190)..(190): a, c, t, g, unknown or other
  misc_feature (190)..(190): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaaccagtggtaggtttggctgtagttggcttctttcgttgtggtacttaaagttttaaaagnttcgtaccgtagttggtggaggtcgcagtcgttggttgggacgggtccgggggaggtcgttggaacggcggggtcccgggggtcctagacctaccgtcctccgtagtcgactacgccgtagaggttacttacgtttagttttacgacgtaagttacgtaccgtacttagtacggtaccggtccggttccgggtaccccgaccggtacggtacccgtaccgggtaaagggggtacgggtccgtagggtacggttcggttaccgaacggtacgtaactaaacgtcgttagggttcggtttaaggtaagggttacggtaaacgttacgtacgtttacccgggacccgttcccggttccgttacccgggtaacgggtaaccggttcccgttacctaccgtacttcccgaacgtaacgaacgttaactaaccttaaccgaacgtaaccttcgtttacttactttactaacgaacgtcgaacctacgaaccgtaagaaacgtaccggtaaccgtacgggttaacgggttcgttttacgttttaaggtttaggtaacggtaaagttaaaacggtacgtttaaaccggtaggttttaaaccgttaagggtacggttaaaacccccggtttaaggtttaaccgggtttacgggggttacccgtttacccgtttaaggttacggttaccggggttcggggtaaaccccgggg

SEQ ID NO: 284218 - DNA, 619 bp, Homo sapiens
  misc_feature: GYAE6OF01BV6U7.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggaaagagccaccctctcctgcagggccagtcagagtgtcaacaccaacttagcctggtttcagcagaagcctggccaggcctcccgaggctcctcatgtatgatgcactcccacgagggcccaccggcactcccagccgtaggttcaggtcggcacggcgggtcgtagggactaggtacttcgactcgtacaccatcagcacgtcgtaggacgtcgtagtaacgtagttttcgactttaagttttacttacgttggtactacgacgtacggcgggtactaagttcggcccgtacttccgtacggtttccggggacgggggtaaccaggggtacggtacgttaacgaaacgtacgtgggcgtcgtacggactaccgtagttccgttacgttaccttactacctttacccgtcccgtcccgtaacg

SEQ ID NO: 284219 - DNA, 646 bp, Homo sapiens
  misc_feature: GYAE6OF01ESPM9.14.57.F02.1.454.CMB.1.raw
  modified_base (203)..(203): a, c, t, g, unknown or other
  misc_feature (203)..(203): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaatttgtgttgacacagtctccactcaccctgtctttgtctccgaggggaaangcccaccctctcctgcagggccagtcagagtgtacaacaccaacttgcctggttcagcagacncngccaggctccgagcctctcatcgtatgatgacactcccgacgcgggcccaccggcactcccgacgtccaggttccaggtcggcgtaggcgggtcgtgggacagtaccttcgaactctaccacgtactcgacgacgtaccgtacgtacggtacgtacgtaagtaacgtttacgttttagaacgtttaagttttaacttacgttaggtacgtacggacggtacgggacgggtacttacggtcggtacccgtcgtaccggttacggggttccggggacggggtacgtaagggtacggtacgttaacggaaacggtcgtaggtcggtacgtgaaccgtcgtacttcgttacgttcttacgtacttcccgtaccgtcttacgg

SEQ ID NO: 284220 - DNA, 775 bp, Homo sapiens
  misc_feature: GYAE6OF01A05X0.14.57.F02.1.454.CMB.1.raw
  modified_base (727)..(727): a, c, t, g, unknown or other
  misc_feature (727)..(727): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagacgccaccctctcctgcacgggccagtcagagtgtacaacaccaacttagccttggtttcagcagacgcctggccaggcctcccgaggcctcctcatgtatcgatcgctactcccacgacgggcccaccggcacgtccccgagcccgaggtttccacggttcggaccgtacggtaccggggttcgtacgggggaacctaacggtacctttccgaaccgtttccgtacccgtaacccgtaacgtaccgtaacggacccgtaaggttacccccgtaaagggtaccggtttaccgttaaagggttaaaccggtttacgtttttacggaccgttttaaaggtttttacctttaacgttcgggttaccgtaacgggtccggtaacggggtaccgggtaacctaaggtttccgggacccttccgtaccggtttaccgggtttccggggggacggggaaccctaggggttacgggaaccgttaacgaaaccggtacggttcggtcgggtaccgttcggacccttaaccggtnttacccggttcgttacccttacgtcccgttcccgttccccgggtaacc

SEQ ID NO: 284221 - DNA, 891 bp, Homo sapiens
  misc_feature: GYAE6OF01EDGKD.14.57.F02.1.454.CMB.1.raw
tcagcgtctagtaccacgaccggtgctcgatttagctcgatatagttggggtttggggggaactgctcagttaggacccagagggaaccatggaagccccagctcagcttctcttcctcctgctactctggctccagataccacggagaaattgtgttgacacagtctccactcaccctgtctttagctccgagggaaatcgccctaccctctcctgccgagggccagtcagagtcgtaccaaacacctaacttacgcccttagggtttaccaggtcctaaaggtaacgtcccttagggacccgtaacggggtcccttacccccgaagggtccctttaccccgtacgtaagttagggttaaacctggttaacgtaccggtacctaacccgttacccccgaaacgggtacgggggacccccgtaacccgggacctaaccgtttacccccgaacggtacccgtaacgggtttacccgaaggttcgggaccgtacggtcggggttaccgtacgggggtaccaaggttacccgtttaccgaccgtttacgtacccgtaaacccgtagttaacccgaagtcccgtaacgtacccgtaaggtaccgttacgtaacggtaaacgtttcgttttacgggaacttttaacgggttttaacgttaccgtttaccgttacgtaaccggtacggtaaccgggttcgggttaaccgttaaaggttttccccgggaaccggttaccgttacccggttaaacggggtttcccggggaaccggggggttaaccctaagggggttcgtaaccgggtttaaccgaaacggtacgtacggttacgggtactacggacctaacgtacgttcctgtttacccgtactaccgtttacccttccgcgttaaccg

SEQ ID NO: 284222 - DNA, 610 bp, Homo sapiens
  misc_feature: GYAE6OF01A0BSA.14.57.F02.1.454.CMB.1.raw
  modified_base (417)..(417): a, c, t, g, unknown or other
  misc_feature (417)..(417): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggaagagccacctctcctgcagggccagtcagagtgtcaacaccaacttagcctggtttcagcagaagcctggccaggctcccaggcctcctcatgtatgatgccactcccgacgacgggcccaccggcactccccagcccgaggttcaggtcggcgaggtccggggtcgtaggggaccaggtcctttccgacttcctaccaccaatcagcacgcctagcttntagtagttatttcgacttaagtttacttacgtgttaccagtcgagggcgggtataacgttcgggcctcgtacgttccgggttcgggaccgggggtactaaggggtcggtaacggttaccaaacggtacggttgtcggtcgtacgccgtaacctgttcgttacttcttacctacttcccgtacccgtcttaccg

SEQ ID NO: 284223 - DNA, 692 bp, Homo sapiens
  misc_feature: GYAE6OF01CMCG9.14.57.F02.1.454.CMB.1.raw
  modified_base (307)..(307): a, c, t, g, unknown or other
  misc_feature (307)..(307): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcagggccagtcagagtgtacaacacctaacttagcctggtttcagcagaagccgtggccaggcctcccgacggcctcctcagtgtatgatncactcccacgcggacccaccggcactcccacgccgacggttacacgtggcgtacggtccgggtcgtagggaccacggtaacttccgaccttacctacccacctaactaccgaacgaccgtacggtcccgttaaggacgttaccgtaaggtaaacgttagttttacgtacgttaagttttacgttttaccgtacgttacgtacggtcgacgggtaccggggtacgttaacgttccgggtacccgtacgttcccgttacgggtttcggggaccggggggtaacctaaggggtaggtaacggttacgaaaccggtacgtcggtacggccgtagaccgtaccgtacgtacgttcgttaccttccgtcttacccttcccgtacgttaccg

SEQ ID NO: 284224 - DNA, 785 bp, Homo sapiens
  misc_feature: GYAE6OF01BP32S.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcacctgtctttgtctccgagggaagcgccaccctctcctgcaggccagtcagacgtgtacaacaccaacttacgcctggttcagcaagaacgccgtggccgacggcctccccgaggtcctccctctagttgttagtacggtacgtcggaccctaccgtaccccgaaccggaccggggacccccgaccgggaccacctaccccggtaacggtcccgtaacggttccgacgggtccggacgcgggtccgggtcgtacgggactacgtactttcgaccgttacctacacctacgtacgacgtactacgtaccgtacggacgttacgtacgtaagttacgtttagtacctttaagttttacgtttacgtccgtacgtacgtaccggtaacgggtcgtacgtaacggttccgggtacccgttaccggttcccggttaccgggtttacccggggggaacggggttaacccgggtaaagggtttcccggtaaagggttaacccggtaaacccgggttaacggttccgggtcggtaccggtaccgacccggttaactccggtttacccgttacggtttcccttaaccggttaccctttccccggtcccgttaacccg

SEQ ID NO: 284225 - DNA, 614 bp, Homo sapiens
  misc_feature: GYAE6OF01DAH1U.14.57.F02.1.454.CMB.1.raw
  modified_base (201)..(201): a, c, t, g, unknown or other
  misc_feature (201)..(201): n is a, c, g, or t
  modified_base (294)..(294): a, c, t, g, unknown or other
  misc_feature (294)..(294): n is a, c, g, or t
  modified_base (327)..(327): a, c, t, g, unknown or other
  misc_feature (327)..(327): n is a, c, g, or t
  modified_base (389)..(389): a, c, t, g, unknown or other
  misc_feature (389)..(389): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaangcccaccctctcctgcagggccagtcagagtgtccaacaccaacttagcctaggtttcagcagaagcctggccaggctcccgaggtcctcctnatgtatgatgctatcccagcgggcccaccgggnactcccgagccaggttccaggtcgcaggcggggtctggggacagtacttcactcgtcaactntcagcacgactagagttctagtaagtagttttgacgttaagtttacttacgtacggttacgacgcgtaggcgggtactagtttcggccgtacgtccgtacgggtttccggggacgggggtaaccggtagggtcggttaggtaccgtaaacggtacgtaggtacgggcgtacgtaccgtacgtacgttctcggttaccttactaccttcccgtcccgtccgtaccg

SEQ ID NO: 284226 - DNA, 617 bp, Homo sapiens
  misc_feature: GYAE6OF01DBSMZ.14.57.F02.1.454.CMB.1.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
  modified_base (386)..(386): a, c, t, g, unknown or other
  misc_feature (386)..(386): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaangcccaccctctcctgcagggccagtcagagtgtacaacaccaacttagccttggtttcagcagaacgcctggccaggcctcccaggcctcctcatgtatgatgccactcccacgacgggcccaccggcactcccagcctaaggttcagtggccaggtccgggtntcgggacagacttcactcncaccatcacgcacgtcctagagtctagaagtagttttacgcttaagtttacttacgttcgtacgtagcgagggacgggtactaagttcggccgtcgttccgtaccggtttcggggaccgggggttaacctaggggtacggtaacgttacgaaaccggtacgtacgggtcggtaccgtacggcgtaacccgtattccgttacggtccttacgtccttcccgtccccgtaccg

SEQ ID NO: 284227 - DNA, 809 bp, Homo sapiens
  misc_feature: GYAE6OF01CS2F8.14.57.F02.1.454.CMB.1.raw
  modified_base (186)..(186): a, c, t, g, unknown or other
  misc_feature (186)..(186): n is a, c, g, or t
tcagcgtctagtaccacgaccggtgctcgatttagctcgatatagttgggtttgggctgagagaggagcccagtcctgggatcttcaggtttgttttcatttggtgatcaggactgaacagagagaactcaccagtggtagtttggctgagttggcttctttcttgtggtacttaattttaaaagntgtccagttgtgaggtgcagtcgttggttgggacgggtccggggggaggtcgttggtacggacggggtccggggggtccctggactcctctccgtgtcgcacgcctacgaggttactttacttagtttttacgacgtaatagtcgaccgtagtggacggccggttccggggtcccgaccggacggtcccgtaccgggaagggggaacggggtcgtagggtacgggttcgggtctacgacgacgtaagtcgtaggtttacggttagtaagggttagggtaaacttaccgtaacgtttcccggaaccggtcccggtttccggtacccgggttagggtaaacccggggtttcccggtttacctacccgtaacgttccgtaacccgaaggtaacgtaaacctaaacttaacccgaaaagtaaccttacttactttaactttacgtaaactaaagtccggaacacgtaaccgtaaaggaaacgaacggaaacgaccgggtacgggttagtttacgtttaagttttacggaggtaaggtaaacgtagtaaacgtaagttaactattaacggaacttaaccggttaggtttacgggtaccggttacttacgagtttcggcggtaaccggg

SEQ ID NO: 284228 - DNA, 752 bp, Homo sapiens
  misc_feature: GYAE6OF01BDPGY.14.57.F02.1.454.CMB.1.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
tcagcgtctagtaccacgaccggtgctcgatttagctcgatatagttgggtttgggggaggaactgctcagttaggacccagagggaaccatggaagcccagctcagcttctcttcctcctgctactctggctcccagataccacggagtaattgtgttgacacagtctccactccacctgtctttcgtctcgaaggggaancgcccaccctctccgtggcgacgggccagtcgagagtcgtacaaccaaccaacttacgccgttggtttcagcgagacgtcgtcggccgacggcctaccgacggtctacctacagttcgtatcgagtcgactacctaccgacgacgggtccaccggctaaccncccgacgcccgtaggtccaggtcggaccgtaggtccgggtcgacgggaccagtaccttcaccgttccacgtacctacgcgaacgtccaaccgtacggtacggactttaccggtaagttaacggttagtttttacgtacgtttaaacgtttttacgtaccgtttaggtaccgagggtaaccggtaaggggttcgggtaaccttaacgggttccggcccgtttaccggtacccgggttacgggtttaccgggggggaccggggtaaaccctagggggggttacaaccgggtttacccaaaaccgggtttaggtcgggtaaccgggtactaccggtaacctacgtacggttccgttttacgacctttaccgcgttttcccacccggttacg

SEQ ID NO: 284229 - DNA, 667 bp, Homo sapiens
  misc_feature: GYAE6OF01DZL2Z.14.57.F02.1.454.CMB.1.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctattttaaaagatgtccagtgtgaggtgcagctggttggaggtccgggggagcttggtacaggccggggggtccctggacactctcctgtgcagcctnaggnttcatttttagcgtaatatgccagtgagcgtcgggtccgccgaggcctccgaggggaaggggctgggagttgggtctcgagcaatcgagtggttctagtaggaagtactattcgacgtccgtctcgtggaacggtccggttctccagtcctaccgaagacgaacgtaaacttaccgaaacgtaacacctttacttattttccgtaacctaaagtcggtaacagtaccgtaggaaaacgacgaaacggtaaccgcgggtacgttaggttaatttttggtagtaaggtaaagtaagtaaccgtaaaggttaccgtaatacggtaacttaaccccgttaaggtttacgggggtaacggggttacccttttaggaacgtttcgggttcgtaacccgggggg

SEQ ID NO: 284230 - DNA, 699 bp, Homo sapiens
  misc_feature: GYAE6OF01BUDXN.14.57.F02.1.454.CMB.1.raw
  modified_base (241)..(241): a, c, t, g, unknown or other
  misc_feature (241)..(241): n is a, c, g, or t
  modified_base (299)..(299): a, c, t, g, unknown or other
  misc_feature (299)..(299): n is a, c, g, or t
  modified_base (379)..(379): a, c, t, g, unknown or other
  misc_feature (379)..(379): n is a, c, g, or t
tcagcgtctagtaccacgaccggtgctcgatttagctcgatatagttggggtttgggggggaactgctcagttaggacccagagggaaccatggaagccccagctcagcttctcttcctcctgctactctggctccagataccacggagaaattgtgttgacacagtctccactcaccctgtctttgtcctccgaaggggaaagacgcccaccctctcctgcgagggccaggtcagaggtnacaaacaaccaattagccttggttcagcagaagctgcaggctccgagctctcatgtangatgcactccgacagggccacggcactcccagccaggttcaggtgacgaggcgggtctaggacagacttcgacttccganaacctatccgaagcgaacgccgtagacgttacgtaggtaaagttactttagactaagttttaacgttacgtagttacgaacggtcgaacgggggtcgggtaacgtaaaggttccggtacccggtaccgttaccgttaaccgggtttacccggggggaaccgggggggtaaccggtaaacggggtacgggttaaacggtaaacccggtaaaaccggtaaacggttcgggtaacgggtcgttaacgtacccgtaaccgtacgttaccttaccggtttctttacccggtaactttccccgttttacccccggaacttaaccgg

SEQ ID NO: 284231 - DNA, 747 bp, Homo sapiens
  misc_feature: GYAE6OF01BHW7Z.14.57.F02.1.454.CMB.1.raw
  modified_base (145)..(145): a, c, t, g, unknown or other
  misc_feature (145)..(145): n is a, c, g, or t
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
tcagcgtctagtaccacgaccggtgctcgatttagctcgatatagttgggtttgggggaactgctcagttaggacccagagggaaccatggaagcccagctcagcttctcttcctcctgctactctggctccagataccacgganaattgtgttgacacagtctccactcacctgtctttgtcctacgagggaaancgccacctctcctgcgaggccagtcagagtntacaactaccacttacgcctggttacagtcaagtagcctggccaggcctccgaggtcctcctctagtggttactgtacgttcgacctaaccgtcccgaacggcgggacccaccgggacctaacgtccccgaggacccgttaggttccgagtacggcgtacggtcgggtcgtacgggaccaacgtaccgttcacctcgtaccaaccgtataccgagtacctacggtacctaggtacgttacgtacgttaacgttacgttttacgtaacgtttaacgttttaacgttaccgttggttaccgtacgggtacgtaaccgggtacgggtacgttaacggtcggtacccgtcgtttaccggtaccgggtttacggggacccggggtaacggttaacgggttacgggtaacttaaccgtaaaccgggtaccgttacgggtaccggtcgttacggtcccgtaaaccgtcgtttaacccgttccgtttaaccggtccttaacccgttcccgttcccgtacgttaacccg

SEQ ID NO: 284232 - DNA, 761 bp, Homo sapiens
  misc_feature: GYAE6OF01DYGSV.14.57.F02.1.454.CMB.1.raw
  modified_base (183)..(183): a, c, t, g, unknown or other
  misc_feature (183)..(183): n is a, c, g, or t
  modified_base (305)..(305): a, c, t, g, unknown or other
  misc_feature (305)..(305): n is a, c, g, or t
  modified_base (623)..(623): a, c, t, g, unknown or other
  misc_feature (623)..(623): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccagtggagtttgggctgagttggcttctttcttgtggtctaattttaaaagntgtccagtgtgaggtgcagtctggtggaggtccgggggagtcttaggtacgagggcccggggggtccctgacctactctccgtgtgcagcctcaggtacttctagtttttagacgtaaattntcgcctatgacggtccgttacggggtcccgcccgtaagggcccgtaccggaacggggggaaggggccgttaggggtaggttcgggtactaccgagtactaagtcgtagggttcgttacgtaggtacgggtaaatcgtacgtttaccggaccggtccgttccgtaccggtacgggtaacgggtccccgtttactacccgtacttcccgtaccgaagtacgaaacctaacttacgaaagtaaccctacttacttactttactaaccgtaagttacgaacctacgtaccgtaaagaaacgtagaacggtaccggtacgggngtttaacgtttagttttgtagtaacgtaaacggttagtaaccggtaagttacgttaagtaacggtaaaccgttaaccccgtaagggtttacccggggtagggttacccgtttactagggttccgtggtaacccggggg

SEQ ID NO: 284233 - DNA, 774 bp, Homo sapiens
  misc_feature: GYAE6OF01EO2YX.14.57.F02.1.454.CMB.1.raw
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggcccggggggtcctgacactctcctgtgcacgcctcaggtatttcctatttttagcgtaatatgccagtgagcgtcgggtccgccgacggtcgtaccggaggggtaacggggcgtgggtaggttgggtctacgagactaaacgtccgtaaggttcggtttacgttaaggttagggtaaacgtttaaccgagtttcccggtaaccggtccccggttaccgttacccgggttacgggaaaccggggttccccgggttttcctacccgttaacgttcccgtaacccgaaggtaaccgaaaccttaaaaccgttacccgaaaaacggtaaacccttaaccgtttactttaacttttttacctaaccgtaaacgttacggacctaccggtacctaaggaaaacgtacgaaacggaccgtaaccggggtcgttagttttacgttttggtacgttaaggaaagtacgtaacgtaacgtcttaagtcgtaaacgtaacccgttaaggtttacgggggtacggtttacctttacgacgttggtaccgggtaccgggg

SEQ ID NO: 284234 - DNA, 586 bp, Homo sapiens
  misc_feature: GYAE6OF01AUF7A.14.57.F02.1.454.CMB.1.raw
  modified_base (536)..(536): a, c, t, g, unknown or other
  misc_feature (536)..(536): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggttcagcagagcctggccaggctcccaggcctcctcatgtatgatgcactcccgacacgggcccaccggccactccccagccaggttcagtggcacggcgggtctgggacaggaccttcgactcctacacccatcaagcacgcctagtacgtctagtaagtatttgactagttttatactgtacagcaggcgggactaagttcgggccgtctccgtacggtttcggggaccgggggtactaagggtcggtaacgttacgaaacggtacgtaggtcggcgtgaccnccgtacgttccgtcggttccttacgtactttcccgttcccgccttaccgg

SEQ ID NO: 284235 - DNA, 758 bp, Homo sapiens
  misc_feature: GYAE6OF01B7JI4.14.57.F02.1.454.CMB.1.raw
tcagcgtctagtaccacgaccggtgctcgatttagctcgatatagttgggtttggggggaggaactgctcagttaggacccagagggaaccatggaagccccagctcagcttctcttcctcctgctactctggctcccagataccaccggagaaattgtgttgacacagtctccactcaccctgtctttgtctccgaggggaaagacgccaccctctcctgcgacgggccagtcagagtgtacaacaacctaactagccttggtttcagtcagaacgccgtggccgacggcctcccgaggcctcctcattgtatcgatcgcactcccacgacgggcccaccggccacgtcccgagccgtaggtcgacggtggcgtagggccgggtcgtagggacctacggtaccttaccgacctccgtaccaaccagtaccgacgtaccgaccgtacccgtaaggtacggttaccgttaaggtaaaggtttaacgtttttcggaacttttacgggtttttaattaccgttacggtactaacggcggtaaccgggacggggaccttaacggttccgggtacccgtccggttaccggttaacccgggttttccggggggaaccggggggtaaccgttaagggggttcgggttaaaccggttaacccgtaaaacgggttaacggttcgggtacgggtacctacgggacccacccggttaatttcccggttcgttaccctttcccgtaactttccccgttaccccgtacccg

SEQ ID NO: 284236 - DNA, 615 bp, Homo sapiens
  misc_feature: GYAE6OF01CDUTE.14.57.F02.1.454.CMB.1.raw
  modified_base (389)..(389): a, c, t, g, unknown or other
  misc_feature (389)..(389): n is a, c, g, or t
tcagcgtctagtaccacgaccggtgctcgattttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcaggccagtcagagtgtacaacaccaacttagcctggttcagcagaagcctggccagggcctcccaggcctcctcatgtatgatgcatcccagcggccaccggcacgtccccgagccgtaggttcagggtcggcgcggtcggggtctaggggacagtacctttcacttcnccaccatcagcacgccgtagtcgtctaaggtaagttatttgactttagttttaacttacgtgtcacgggtcacgggtcgggactaaggtcggccgtgtaccgtacgggtttaccggggacggggtaaccgtggggtacggaaggttaccgaaacgtacggttggtacggtcgtgaccgttacacgttacgttgttcctacgtacctttcccgtcccggtactacgg

SEQ ID NO: 284237 - DNA, 783 bp, Homo sapiens
  misc_feature: GYAE6OF01CXLLQ.14.57.F02.1.454.CMB.1.raw
  modified_base (182)..(182): a, c, t, g, unknown or other
  misc_feature (182)..(182): n is a, c, g, or t
  modified_base (264)..(264): a, c, t, g, unknown or other
  misc_feature (264)..(264): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagntgtccagtgtgaggtgcagctggttggaggtccgggggagcgttggtacagggccgggggtccgtgacactctcctgtgacncgcctacgaggtacttacttaagttttagtacgtaataatcgccaatgacgtcgtcgggtccgccgaggcgtaccggaaggggaacgggcgtagggtaggtcggtcgcgtaggactaatcgtacgttggttacgtaggtaggtaaacgtatacgttacggacccgtaccgtccgtacgggtacggtaacggggtccccggttctacccgtacttccgtacctaacggaacgtaaaccgtaaaccgtttaaccgaaaaccgtaaccgttaaccctttacctttaacttttaccgttaaacaaagtaacggtaaccgtaacgtaacccgaagggtaaaacgaaccggtaaaacggaaccggtacgggtaccggttagttttaacggtttggttaaggtaaagtaaaacggtaacgttaaaggtacgttaaacttacggttaacgtaacgttaaacccgttaaagggttttggggtaacccggggttacctttacgaacgtttgggtaccgggttaccgggg

SEQ ID NO: 284238 - DNA, 721 bp, Homo sapiens
  misc_feature: GYAE6OF01BV872.14.57.F02.1.454.CMB.1.raw
  modified_base (200)..(200): a, c, t, g, unknown or other
  misc_feature (200)..(200): n is a, c, g, or t
  modified_base (338)..(338): a, c, t, g, unknown or other
  misc_feature (338)..(338): n is a, c, g, or t
  modified_base (709)..(709): a, c, t, g, unknown or other
  misc_feature (709)..(709): n is a, c, g, or t
tcagcgtctagtaccacgaccggtgctcgatttagctcgatatagttgggtttggggggaactgctcagttaggacccaaagggaaccatggaagccccagctcagcttctcttcctcctgctactctggctcccagataccaccggataaattgtgttgacacagtctccactcaccctgtctttgtctcgaggggaangccacctctcctgcagggccagtcagagtgtacaacacaacttagcctggtttcagcagaagcctggccaggcctcccgaggcctcctacatgtatgactgcactcccgacgacgggccctaccggcaccgtacccgngacccgtaggttccaggtcggcagggtcgggtcgtggggacacgtaccttaccgaacttccgtacaacccgtatccgaggacctacgtaccgtaaggtacgttccgttaagtaagtttacttttacggaactttaacggttttaactttaccgtacgttaccgaagggtaccgtacggggtaccgggtaacgtaacggtttccgggccccgttacttacccgggttaaccgggtttccgggggaacccggggggttaaccgtaacggggttcggtaacggttaaccgaaaccgggttaacgttcggtaccgggtcttacgacccgtaactcgttccttaggttccctttaccgtacttccccggttacccncgttacgttacg

SEQ ID NO: 284239 - DNA, 551 bp, Homo sapiens
  misc_feature: GYAE6OF01EKH3Y.14.57.F02.1.454.CMB.1.raw
  modified_base (357)..(357): a, c, t, g, unknown or other
  misc_feature (357)..(357): n is a, c, g, or t
  modified_base (370)..(370): a, c, t, g, unknown or other
  misc_feature (370)..(370): n is a, c, g, or t
  modified_base (525)..(525): a, c, t, g, unknown or other
  misc_feature (525)..(525): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaacgcctggccaggcctcccgaggcctcctcatgtatgatgcactcccgacgacgggcccaccggcactcccagccaggttcagtgcaggcggtcngggacagacttcnctctcacatcagcacgcctagacgtctagtaagtattttgacttagtttacttacttgtcagcgaggcgggactagttcggccgtactcgtacggttcggggacggggtaccgaagggtcggtacgttacgaaacgtacgtgtggcgtagctacnctctcgttctactntcctcccgntac

SEQ ID NO: 284240 - DNA, 609 bp, Homo sapiens
  misc_feature: GYAE6OF01A6UEV.14.57.F02.1.454.CMB.1.raw
  modified_base (199)..(199): a, c, t, g, unknown or other
  misc_feature (199)..(199): n is a, c, g, or t
  modified_base (282)..(282): a, c, t, g, unknown or other
  misc_feature (282)..(282): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagcgtctagtaccacgaccggtgctcgatttagctcgatatagttgggtttggggggaactgctcagttaggacccagaggaaccatggaagccccagctcagcttctcttcctcctgctactctggctcccagataccaccggagaaattgtgttgacacagtctccactcaccctgtctttgtctccaggggaangccacctctcctgcagggccagtcagagtgtcaacaccaacttagcctggtttcagcagagcctggccaggctccaggctccncatgatgatgcatcccacagggccaccggcagtcccagccaggttccagtcggcacgcgggtctggggacagacttcactcncaccntccagcagctagacgtctagagtagtttcgacttacgtttacttactacgtacgaggtacgtacggacggggtactaacgtacggcccgtacgtccgtaccggtttccggggaccgggggtacccgaacgggtacggtacggttaaccgaaacgtaccgtagggtcgggtcgtacggtacctacccgtaacgttcgttacgttaccttacgtactttccccgttcccgtccgttaacccg

SEQ ID NO: 284241 - DNA, 838 bp, Homo sapiens
  misc_feature: GYAE6OF01CFCRD.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgtggaggtccgggggaggcgttggtacgacgggcccgggggggtccctgacactctcctgtgcacgcctcaggtattctagtttttagcgtaaattatcgacctagtcggaggtccgttcgggggtccccgaccgacggggtccttacccggaaaggggggtaacgggggtccgttaggggtaacgggtttcgggggtcctaccggtaaggacctaaaacgttccgtaaggggtttcggtttaccgtaaggggtttaaggggaaaacgtttaaccgtaacggttttaccgggaacccggtaccccggttccgttacccgggttagggaaacccgggggttccccggtttaccgtccctaacgttcccgtaacccgaaggtaaccgtaaacctaaacgtttaacccaaaacggtaaaccttaacccgttacctttaacgttttaccttaaccgtaaaagttccggaaacctacgtaacccgtaaggaaaacgtaaccggaaacggaccgtacgggttacgttagtttaagtttttcggtagtaacggtaaagacgttaaaggaacgttctaagtacgtaacgttaacccgttaaggtttacggggtacggttcctttagacgttgtcggtaccggggg

SEQ ID NO: 284242 - DNA, 917 bp, Homo sapiens
  misc_feature: GYAE6OF01BPRO5.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtgaggtgcagctggttgggaggtccggggggaggtcgttgggtacgacggggcccgggggggtccctcggacctacctcctcctggtcgccgacgccctcgaggtactttccttaagttttttacgacgtaaattacgtacgaccaagtcggaacggtccggttcgggggtccccgacccgtaacggggtcccgttacccgggaaaagggggggaacggggggtccggttagggggtaacggggtttcgggggttaccttaccggaacggtaaccgtaaaacgttccggtaaagggtttcgggtttaccgtaagggttaggggtaaacgttacgtaacggtttccggaacccggtcccggtttccgtacccgggttaggaaccgggggttccccggtttccctacccgtaacgttcccgtacccgaaggtaccgtaaaccgttaaacgttaacccgaaacggtaaacccttaccgtttacctttaacgtttttacccttaacgtaaacggttaccggaacctaacgtacccgtaaaggaaaccgaacggaaacggaaccggtacggggtacgtttagttttacgtttttaggtaggttaaggtaaagtacgttaaacggtaacgttacgttaagttaacggtaacccgttaaacccgttaagggttttaccggggaacgggtttacccgtttaacggtacggttcgggttccggggtaaccggggg

SEQ ID NO: 284243 - DNA, 718 bp, Homo sapiens
  misc_feature: GYAE6OF01CLZ5W.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgagtgtagctgttggagtccgaggggagcttggtacaggccggggggtccctgacactctcctgtgcagcctgacggtattctatttttagacgtaattagtgccatggagctcggggtccgccaggccgtccggaggggaacggggtctgggaggttcgggtctacgagaccaagtcgaaggttcggttactaagggtggaaatacgtaattccggaccgtcccgtcgtcccggtggaacgggttccggtttcctcctactccgtccgaagacgaaacctaattaccgaaacgtaacgtacctcttaactttacttaactaagtacgaacgacgtaccgtaaggaaacgtaaccggaacggaaccggtacgggtacggttacgttttacgtttttaggtacgttaaggtaaacggtagtaaaccggttaagttacgtttaagtacgttaaaccgttaaccccggttaaaggttttacgggggaccgggttacccgttttacgtacggttcggttcggtaaccgggggg

SEQ ID NO: 284244 - DNA, 774 bp, Homo sapiens
  misc_feature: GYAE6OF01CPJ6J.14.57.F02.1.454.CMB.1.raw
  modified_base (199)..(199): a, c, t, g, unknown or other
  misc_feature (199)..(199): n is a, c, g, or t
  modified_base (278)..(278): a, c, t, g, unknown or other
  misc_feature (278)..(278): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccagtggagtttgggctgagttggctctttcttgtggacttaattttaaaagatgtccagtgtgaggtncagtcgtggttgggacggtccggggggagtcttgggtaacgcggggcccggggggtcctgacactctctgtgcagcctnagtacttctagttttagagtaatgtcgcctancgngtggttccgggccgaaccgcgtccggcgaaggggacggggcgttgggaggtcgggttccacgagtactaaagtcgtaagggtttgttaaccggtaagttagggaaaacgtttcgaacgtttaccggaccggtcccgttcgtacccgggtacgggaacgggttcccggtacttcccgagttacccgaccgaaggtaacaacccttaaattaaccccggaaataaacccttcgttaacctttacttttaccgttaaccgtaaaagttccgggaacctacgtaccgttaaaggaaaccgaacgttaacgggaaccggtagggtaccggtttagtttatttagggtagtaaagggtaaataaccgtaaggtaaaccgtgttaacgtaacgtaaccgttaaccggttaaggttcggggttaaaccgggttactttggaaacgttcgggtaccgggtaacccggggg

SEQ ID NO: 284245 - DNA, 871 bp, Homo sapiens
  misc_feature: GYAE6OF01CQT8O.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttgggaggtccgggggaggtcttggtacgaggccggggggtccctgacactctcctgtgcgagcctcgaggtattctatttttagacgtaaatatcgaccagtggacgtccgtcggggtcccgccgtaggccgtacccggaaggggaacgggcgtgggaggttcgggtctacgagacaagtcgtaaggttcggttactagggtaggtaaacgtacgtagtttaccggaccggtcccgttccgttacccgggtaggtaaaccggggttccccgggtttactacccgtacttacccgtacccgtaacgggtaacgtaaaccgttaaaccgtttacccgaaaacggtaaacccttaaccttactttaaactttttacccgttaaacctaaaacggttaccggtaaccgtaaccggtaaccgttaaacgggaaaacggtaaacccgggaaacggtaaaccggtaccgggggttacgttttacggttttaacggttttttacggttaagggttaaaggtaaaacggtaaccgttaaacggtaaacggtttaaccgttaacgttaaccggttaaaccgttaaacccccgttaaagggttttaccggggggtaaaccgggtttacccgttttacggaacgggtttccccgggggttacccggggtaaaccccgggg

SEQ ID NO: 284246 - DNA, 785 bp, Homo sapiens
  misc_feature: GYAE6OF01A4RUG.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcacctgtcttgtctccgaggggaaacgacgccaccctctcctgcgacgggccagtcagagtcgtaccaacacctaacgttacgtccttggtttacagacgaagaacgccgtcggccacggcctcccgaggtcctcctcattgtatgactcgaccgacctcccgaacggtaccggacccgacccggctaccgtacccacgtacccgtaggttcgaacgggtcggacgtacgggtcggggttacgacgggaacgttacggtacctttaccgacccttccgacccgtaaccctataccggacgacctaaccggtcccgtaaggttacgtaccgtagggttaacttttaagttttcgtaagttttaaggtttaacctttacggttagtaccggaacggtcccggttaacggggaccgggttaccttaacgggttccggtaacccggtccggttacgggttccgggtttaccggggggaccggggttaacggtacggggttaggtaaacccgttaacggtaaaccgtaagggttcggcgggttacccgtcggaaccttcccgttacggttccgttacgtttacccgtacgtttaccgtttcccccgtccgttacg

SEQ ID NO: 284247 - DNA, 719 bp, Homo sapiens
  misc_feature: GYAE6OF01AGRCP.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcgagggccagtcagagtgtcaacaccaacttagccttggttcagcaggaacgcctggccaggcctcccgaggcctcctcatgtatgatgcactcccacgacgggcccaccggcacgtccccagcccgtaggtttcgaggtgggacgtacggcggggtcgtggggactacggtaccttcgaacttccaccaccgacttaccgacgtaccaccgggttcctaaggtacggttaccgtaggtaaacgtttagtttttaggtaacttaagggttttttactaccgtttggttaccgagggtccggaggggtccgggtactttaacgggttcccgggtccgtaccggttaccggttaccgggggttttcccggggggaacccggggggttaacgggtaagggttacgggtaacgggttaaccgaaacggttacgggttcggtacgggtaccgtagtacctccggttattcgttacgttcttacgttaccttcccgtccgtccgttacg

SEQ ID NO: 284248 - DNA, 743 bp, Homo sapiens
  misc_feature: GYAE6OF01AWYFL.14.57.F02.1.454.CMB.1.raw
  modified_base (723)..(723): a, c, t, g, unknown or other
  misc_feature (723)..(723): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctattttaaaagatgtccagtgtgaggtgcgagctggttggacggtccgggggaggtcgttggtacgacgggcccgggggggtccctgaccgactctcctgtgcacgcctacgaggatttcctagtttttacgacgaaattatcgccgatgagtcgtcggggtcccgccgagggtccgtccggaaggggacggggcgtagggacggtgggtctcgaggacaagttcgaggtcggtttactaaggtaggtaacgttaactcgtttaccgaccggtcccgtccgttacccggtagggaaccggggttcccggtttaccctcccgtacgttccctacccggaagtaacggtaactaaaccctttaccaaacggaaccttaccgttaacctttacttttacgttaacctaaagttacgggacacgtaccgtaagaaacgacgaaacgaccgtacggggtacgtttagtttagttttaggtcggtaaggtaaataagtaaccggtaaggttctaagtaggtaccttaacccggtaaagtttcggggacggttacccgttanagttcgtcgggtaaccgggg

SEQ ID NO: 284249 - DNA, 793 bp, Homo sapiens
  misc_feature: GYAE6OF01EH7JH.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctggagttggcttctttcttgtggcttaattttaaaagatgtccagtgtgaggtgcagcgtgttgggaggtcccgggggaggcgttggtacgacgggtcccggggggtccctgaccactcctcctgtcgcacgcctgaggtattctatttttagacgtaattatgaccagtgagtccggtcgggtccccgaccgagggcccgtaccggaagggggaacggggtcgtagggtggtcgggtctcgagacgaagtacgtagttcggttcgttaggtacggtaagtactacgttccggaccgtcccggttccgtccggttagggaaccgggtcccgggtttacctcctacgttccgtaccgtagtacgtaacctaaacgtttaccgaaacgtaacctaacgtttacccttttaacctttttactaccgtaaaacgttccggaccgttaacggtaacctaaggaaaccggaaccggtaaacggaccggtacggggtttacgtttaggttttaagtttttacggaggttaaacgaaaggttaacctaaacggtaaacgttaccgtttagtaacggtaaaccttaacccggtttaagggtttacggggggtacggtttacccgtttagtacggttcgggttcccgggtaacggggg

SEQ ID NO: 284250 - DNA, 847 bp, Homo sapiens
  misc_feature: GYAE6OF01ESV01.14.57.F02.1.454.CMB.1.raw
tcagcgtctagtaccacgaccggtgctcgatttagctcgatatagttgggtttggggctgagagaggagcccagtcctgggatcttcaggttgttttcatttggtgatcaggactgaacagagagaactcaccagtggtaggttgggctgtagttggcttctttcttgtggtacttaattttaaaagatcgtaccaggtgtgaggtgcgagtcgtggttgggacgggtccgggggagtcgtcggtacgcggggtcccggggtcctgactccgtcgtcgtgtcgacgtacgcctacgtagtactttacgttaagttttagacgtaattagacgtacgtagtagacggtcggttaccgggtccgccgtaccggtccgtaaccgggaaggggtacggggtcgtagggtacggttcgggtcttaccgacgaacgtaaacgtcggtaggttcggttaagttacggtaaggtaacgtaaccgtacgttacccggacggtcccgttaccggtccggtaacgggaccggttcccgttaccttccgaccgttccgtaacgaagtaacgaacctacgttaaaccgaatactttaactaccgttttacgtttaacctaacgtaacggtacgtacgtaataaccggaaacggaaaccggtaaacgtaaacccgggtacggtaccgggtttgttttaacggtttaagtttacgggtaagtaaaaaggttaacgtaaccgttaaaggtaacgttaacttaacgggtaaccttaaaccggttaccgggttttaaagggttacccggggaacccggtttttacacggtttaacgggttccgggtaaccggggttaaccggggg

SEQ ID NO: 284251 - DNA, 920 bp, Homo sapiens
  misc_feature: GYAE6OF01DUA4Z.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctccttcctcctgctactcgtcggcctccagactaccaccggagtaattgtgttagacacgacgtcctccactccacccgttgttctttcgtccgtaccggaaggggaaacgccacccacccttcgtccgtcgccggacgggcctaggtacgaggtacgttacgtaaccaaaccgtaaccttaacgttaccggttcccgtttacggttaccgacgaaccggtaacggtaaccgtccccggtacggggacccgtacgggtacccctacccggtacggtccctaaccgtctacggttagttacgtagtacgtccgactacccgacccgacgggacccggacccgtccgaccaccgtcccggaacgtccggttacgtacggtcggaccgggacggtccggggtacgggtacggtaacggacgtacgttaccctacgtaccttaccctaccgaccgtaacgtaccggaccgtaaccgtacggtaaccgttacggtacgttaacggttaacggttaacgttttacggtttacgtttagggtttaacgttttacgttaacggttcgtaacgtacgggacgggtagggtaccgggtacgttacgggttccgtacccgttaccggttaccccggggttcggggtaccgggggttaacccggggtacgggttaacggggtaacggttaaccgggtaaacggtaccgggttaaccggttcgggtaccggttaccgggtaaccttcccgggttacccgttagtttacccggttccggtttaccctttaccgttccccgtttcccgtcccgtttaacccgg

SEQ ID NO: 284252 - DNA, 769 bp, Homo sapiens
  misc_feature: GYAE6OF01CUAB6.14.57.F02.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccactcacctgttcttgtctccaggggaangccaccctntcctgcagggccagtcagagtgtcaaccgaccaacttagccttggtttacagcagaacgccgtggccaggcctcccgaggcctcctcatggtattgatcgctactacccgagtaccgggcccgaccggctactccccgaggtcccgtaggtttccgagggtcggccgtagggtccggggtacgtacggggaactacgtaccgttccgaacctcctaaccgacctagtcccgaacgtccgacgtacccgttaacgtacgttaccgtaggtaacgtttacgttttacggtaaccgtttaggtttttaacgttaccggttacgttaccgtaacgtacgggtacgggtaccgggggtaaccttaacggttccggacccggttccgttaacccgggttaccgggtttacccgggggaccggggggttaaccgtaacgggggttacgggtaacggttaaccggaaaaccggttacggttacgggttacggtaccgttaccggacctaacccgttagttccgttaccgtttaccttaccgtacccgtttccccgttcccgtacccg

SEQ ID NO: 284253 - DNA, 756 bp, Homo sapiens
  misc_feature: GYAE6OF01EDMLR.14.57.F02.1.454.CMB.1.raw
  modified_base (183)..(183): a, c, t, g, unknown or other
  misc_feature (183)..(183): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccagtggagtttgggctgagttggcttctttcttgtggcttaattttaaaagntgtccagtgtgaggtgcagcgtggttgggacggtccgggggagtcgttggtacggacggggtcccggggggtccctggacctctccgtccgtggtcgccgacgtcctcgaggtacttacttagttttacgacgtaatactcggacctatggacggtcggttaccggggtcccgaccggacgggtccgtaccgggaaggggggaacggggtcggtaggggacggttcgggtcacgacgtacgtagtacgtaggtttcggttacgtagggtacgtaacgtacgtacggttacgaccgtcccgttccggtaccggtacgggtaccgggttccgttcctacctacgttcctaccgaacgtaacgtaactaacggtaaccaacgtaactccttactttactttactaacgtaagtcgtaccgacgtactaacgaaacgaacgacgtacggtacggttacgttagttaacgttttggtagtaaacgtaagtacgtaagtagtacgttagtgttaaacccgtaacggtttacggggtagggtaccggttaccttaggtattcggggtcggtaaccggggg

SEQ ID NO: 284254 - DNA, 659 bp, Homo sapiens
  misc_feature: GYAE6OF01D9MK7.14.57.F02.1.454.CMB.1.raw
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctaattttaaaagntgtccagtgtgaggtgcagctggttggaggtccgggggaggcttggtacagggccgggggggtcctgacacctctcctgtncacgcctcaggtattctaattttagctaaatatcgccatggagtcgtgggtccgcgaggcgtcggaggggagggctgggaggtggtctcagacatcgagttggttacgtagggtaggtaagtacgtacttcggaccgtcgttaccgtacggtaggaaccgggtcccggttactaccgactccgtacccgaagtaacgaacttaaacgttaccaaagtaacctacttacttactttaccttactaaagtcgaactacgacctaaggaaagacggaagacgtacgggtcttagtttagtttgaagtagaaactagtaagtagttactaagacgttaaattaacccgtaagggttcggggtacggttacttacgtaggttcggttcgggtaacccggggg

SEQ ID NO: 284255 - DNA, 616 bp, Homo sapiens
  misc_feature: GYAE6OF01A7STW.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccagctccagctcctcatgtatgatgcactcccacgacgggcccaccggcactccccagcccgaggttcaggtcggcgacggtccgggtcgtggggacacgtaccttcacgtctacaccatcagcacgcctagagtctagtaagtagtttgacttagtttattacgtgtcgagcgtagggcgggtactagttcgggtaccgtcgttaccgtaccggtttccgggggaccggggggtacccgtaaggggttacgggtaacgttaaccgaaaacggtaccgtgggtacggacgttacgaccgaccgtagttcgttacggttccttacttcttccccgtccccgtaccg

SEQ ID NO: 284256 - DNA, 832 bp, Homo sapiens
  misc_feature: GYAE6OF01DRV9O.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtcttgtctccgaaggggaanacgccaccctctcctgcgacgggcagtcagagtgtacaacaccaacttacgccgttggtttcagcaagaacgccgtggaccgacggcctcccgacggtcctaccgtctagtgtatgactcgacacgtccacgacgggcccacggccactcccagcctaggtcagtgcgtaggtcgggtcgtcgggactaggtaccttccgactccgtacaacccagtaccagcctaacgtacccgtaagtacgttaccgtaaggttaacgttttacgttttaaggtacgttttaacgtttttaacgttacgtttaccggtaccgtaacgggttaccgggtaacgggggttacccggggtaacgtttaaaccgggttcccggggtacccccgttacccggttttaacccggggtttaccccgggggttttacccggggggggaaacccggggggtaaaccccggggtttacggggttaacgggggtttaaacccggtttaaaaccgggaaaaccccgggttaagggttaccggggttacggttaccgggttacccggacccgttaacccgttacggtttaccgttttaccgtttccccgtttaaccgttaccggtttccccccgttcccccgggttaacc

SEQ ID NO: 284257 - DNA, 1022 bp, Homo sapiens
  misc_feature: GYAE6OF01BP3XP.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtgaggtgcagtctggttgggaggtccggggggaggtcgtttgggtacgacgggcccgggggggtccctggacctacctcctccgtgtgcacgtcctcgaggtactttactagtttttacgacgtaattagtcgcctagtggacggtccggttcggggtccccgccggacgggtcccgtaccgggaaggggggaacggggtcgtgggggtacggttcggggtaccttacgaacggtactaacgttccggtaaggtttcgggtttacggttaagggtaacggggtaaacgttaaccgttaacgggtttcccgggaacccggttcccccggttaccgggttacccgggttaacgggggtaaacccggggggtttcccccggtttacccgttacccccgttacgtttaccccgttacccgtaaagggtaaaccggtaaaccctttaaaccgtttacccggaaaaacgtaaacccctaactttacccgttttaactttttaacccgttaaaccgtaaaacgttacgggaacccttaacgggtaacccgttaaagggaaaaccggaaaccgggtaaaaccgggaaacccgggtaacccggggggtttacggttttacggtttttaaggtttttttacgggtaagggtttaaacggtaaaaaggttaaccggtttaaaccggggtaaaacgtttcgttttaaaacgtacgggtttaaaacccgtttaaacccccgggttaaaggggtttttacccggggggggtaaaccggggttttacccctttttaacgggtaaccggttttcgggggttaccccggggtttaaaccggggggggg

SEQ ID NO: 284258 - DNA, 655 bp, Homo sapiens
  misc_feature: GYAE6OF01CAHKQ.14.57.F02.1.454.CMB.1.raw
  modified_base (258)..(258): a, c, t, g, unknown or other
  misc_feature (258)..(258): n is a, c, g, or t
  modified_base (384)..(384): a, c, t, g, unknown or other
  misc_feature (384)..(384): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccagccaccctgtctttgtctccaggggaaagcgccaccctctcctgcagggccagtcagagtgttagcacctcttagcctggtaccaanagaaacctgccaggctcccagcctcctcatctctgatgcttccaacgacgggccacgtcggcactcccagccgtaggttcagtcggctaggtcgggtctgggacagtacttcgaactcgtacaccnttacacgcctcccgtaagacgtccgtaggtacgttatttttagttaagttttacttacgttcgttacgacggtactaagttaacgtacgtcaagtccgtacggtccccttaccgttaccggtttaccgggacgggtaacgggtaccgaagggtcggaacggtacgtacccgaaacggtacgttcgggtacgggtcctacggtaccccaccgttattcccgttacggtttccttacctaaccgtttccccgtttcccgacctcggtttaccg

SEQ ID NO: 284259 - DNA, 1005 bp, Homo sapiens
  misc_feature: GYAE6OF01D1N11.14.57.F02.1.454.CMB.1.raw
tcagcgtctagtaccacgaccggtgctcgatttagctcgatatagttgggtttgggctgagagaggagcccagtcctgggatcttcaggtgttttcatttggtgatcaggactgaacagagagaactcaccagtgggtagtttgggctgtaggttggcttctttcttggtggtacttaattttaaaaagagttcgtacctaggtttgaggtgcgagtcgttggttaggggcgggtaccggggggaggtcgtttagggaccggacgggggtcccgggggggttaccctggacctaccttccgtcccgttggtcggcgaacgtccgttacggaaggtttacctttacgttaagttttttaacggacgtaaaacgttagtaccgtaccgtagtacggtacggtccgggttccgggggtaccccgtaaccgggtaaccggggtcccggttaaacccgggggaaacggggggtaaaccgggggttcgggttaagggggtaacgggttttaccggggttaccttaaaccgggacgtaaacccggttaacggttacccgggttaggggtttaccggggttttacggttaaacgggtttaaggggttaaaccgttaaaccggttacggttttaacccgggaacccggtttcccggttaaccggtttaaccccggggtaacgggttaacccgggggttcccccggtttacccgttaacccgttacccggttacccgtaacccggtaaacggtaaaccgtaacccgttaaacccggtttaaacccaaacggttaaacctaaccgtttacgtttactttaagtaacgtaagtaggatacgaacgtaagaaacgtaccgaacggacggtacggttacgttagttttaacgtttggaacggttaaacgaaaggtaacgtacggtaattacggtaacttaaccggtacgttaacgggttacggggttaacggacggttttcctagtaacggttcggtaacccgggtgggtaaacccggg

SEQ ID NO: 284260 - DNA, 765 bp, Homo sapiens
  misc_feature: GYAE6OF01EA6KJ.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtgaggtgcagctggttgggagggtccgggggagtcgttggtacgacgggcccggggggtccctgaccactctccgtgtgcacgcctcaggtattctatttttagacgtaaattatcgacctagtggacggtccggttcggggtccccgaccggtaacgggcccgtacccgggaagggggggtaacggggtccggtagggggtacgggttcggggtaccgtacgaacggtacgtaaacgttcgtaaggtttcggtttacgttagggtacgggaaacgttactacgttaccggaccggtcccgttaccgtaccgggtagggtaaccgggtccggtttcctaccgtactccgtaccgaaggtactaaccgtaaacttaccgaaacgtaacctaccttactttactttaccgtaactaaagtcgaactacgtaccgtaaggaaacgaacgaacgtaaccggacgggttacgttagtttaggtttgtaggtaagtaaacgtacgtaacgtaagttcgttagtacgtaacttacccgttaaggttcgggacgggttaccttagtgttcgtcggtacgggg

SEQ ID NO: 284261 - DNA, 892 bp, Homo sapiens
  misc_feature: GYAE6OF01CN38R.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgttctttgtctccgaggggaagacgccaccctctcctgcgagggccagtcagagtgtacaacaaccaacttagccttggttcagcagaacgccgtcggccacggcctacccgaggtcctccgtcacgtgtactagatgcctactacccgacgaccggggacccaccggtaccacctaccccgacgtacccgtacgggttcgaacgggttcggaccggacgggtccggggttcggtacgggggaccgaacggttaaccgtttacccgtaccgtttaccctcccgtaaacccgtacgttaccgaaccgtaccgtaaccggtacccgtttaacgggtaacgttaccggttaaggtaaaaccgggttttcgttttttacggaaccgtttttaaaggtttttactttaccggtacggtttaaccgagggtaaccggacggggtaccccgggggtattaaccgggttcgggggcccccttaccgggttacccggtttaccgggggtttaccccggggggggacgggggggttaaaaccgttacggggggttacgggttaaaaccggttaaccggtaaaaacccgggtaccggggtttgggtaacggggttacccgtacgggtaaccccttaaacccgggttacgtttcccgtttttacggtacccgttttaccgtaacccgttttacccccggtttcccccggacccgttttaacgg

SEQ ID NO: 284262 - DNA, 691 bp, Homo sapiens
  misc_feature: GYAE6OF01DBEKH.14.57.F02.1.454.CMB.1.raw
  modified_base (202)..(202): a, c, t, g, unknown or other
  misc_feature (202)..(202): n is a, c, g, or t
  modified_base (679)..(679): a, c, t, g, unknown or other
  misc_feature (679)..(679): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctcgaggggaaagngccaccctctcctgcagggccagtcagagtgtacaacacctaacttagccttggttcagcagacgcctggccaggcctcccgaggtcctcctactacgttgtagtgagtcgaccacgtaccccgacggaccgggtacccgaccggccaacctaccccgaggtacccgtacggttaccgaggtcggtcgacgggtccggggttcgtagggggacctacggtacgttcgaccttcctaccgacctacgtccgaacgcgtaccgtaccgttagaccgtttacgagtaaagtttgttttcgagttagttttactcgtagtccgtaggcgtacgggtcggtactacgggtcgccgtacgttcccgttacggggttccgggggccggggtaacttaagggtcggttaacgttaccgaaacggtcgttgggtaccggcgttacgaccgtccgtagttcgttccgtacttacctaccgtttcccnccggtccttacg

SEQ ID NO: 284263 - DNA, 702 bp, Homo sapiens
  misc_feature: GYAE6OF01CYLT5.14.57.F02.1.454.CMB.1.raw
  modified_base (250)..(250): a, c, t, g, unknown or other
  misc_feature (250)..(250): n is a, c, g, or t
  modified_base (477)..(477): a, c, t, g, unknown or other
  misc_feature (477)..(477): n is a, c, g, or t
  modified_base (567)..(567): a, c, t, g, unknown or other
  misc_feature (567)..(567): n is a, c, g, or t
  modified_base (646)..(646): a, c, t, g, unknown or other
  misc_feature (646)..(646): n is a, c, g, or t
tcagcgtctagtaccacgaccggtgctcgatttagctcgatatagttggggtttgggggggaactgctcagttaggacccagagggaaccatggaagccccagctcagcttctcttcctcctgctcgctcgcgccacagacaccgacggaaattagttgtgtacacacgtactccacctactccctcgttctttcgttcgtaccgaacgggaaagggaactccaccctacctctacgcgacggacgacgngagagtcgtacaacaacctaacctaagtcgtacgttcgacgacagaagccgtcggacgcggacgtaccaccggtctcctacgatagttagagagtacgccaacctaccaccggagggacccgacactctaacccgccgaacgggttacgtaggtacgaggaccggcggtaaccgggggttcgacgggaactaacggaccttacctcctaaccgtacaacccgaatanaccggaacgtccgtacgaccgtaggtacgtagtaaagttcgttttagttactaagtttacttacgtactagacgaggaggtaccggggtntaacgtacggtccgtactcggtacggtcggggtaccggggagtaacgtaggtacgtacgaaacggtacgtggcggtacncggactaccgtacgtagtttccgttacgtacctaccgttactacccggtctaacgg

SEQ ID NO: 284264 - DNA, 1076 bp, Homo sapiens
  misc_feature: GYAE6OF01AIYKU.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggcttctttcttgtgacttaattttaaaagatgtcagtgtgaggtgcagctgttggaggtccgggggagtcgttggtacgacgggtcccggggggtccctggacctactctccgtgtgcagcctcgaggtacttctagttttttagacggtaaattatcggtaccaagttggaacggtcgttccgggggtaccccgtccggaacgggcctttacccgggaacggggggtaaacggggggtacggttacggggtaaggggttcggggtacccgttaggaaccggtctaaacggttcccgtaggggtttacgggttttaccgttaacgggttagggtaaacggttaaccggtaacggttttaccggaacccggtccccggttaccgttaccccgggtttaaggggaaccgggggtttcccccggttttaccgtacccccgttaacgttacccgtacccggtaaggaaccggtaaaccttaaacccgttaacccgtaaaacggtaaacccttaaccgttacgttttaaaccgtttttacctttaaaccgtaaaaacggttaccggggtaaaacctaacccgggttaacccgtttaaacgggaaaaaccggtaaaaccgggtaaaccgggtaaacccggggtaaaccccgggggtttaaccgggtttttaacgggtttttaaccggtttttttacgggtttaacgggttaaaaacgggttaaaacggttaaaaccgggtttaaaaccgtaaaacgggttttaccgttaaaaacggtttaaaccgggttaaaacccgttttaaaacccccccgggtttaaaaaggggggtttttcccgggggttaaaaccggggggggttttacccccctttttaaccggggtaaccgtttttacccgggggtttcccggggtttaaaccccggggggggg

SEQ ID NO: 284265 - DNA, 618 bp, Homo sapiens
  misc_feature: GYAE6OF01CUZO9.14.57.F02.1.454.CMB.1.raw
  modified_base (178)..(178): a, c, t, g, unknown or other
  misc_feature (178)..(178): n is a, c, g, or t
  modified_base (318)..(318): a, c, t, g, unknown or other
  misc_feature (318)..(318): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctatttaaaagntgtccagtgtgaggtgcagctgttgggaggtccggggggaggtcttggtacgacgggcccgggggggtccctggaccacctctccgtgtcgcagcctcaggtattctatttttagcgaatatgccatgagcgtgggtccnccgaggcctccgaggggaggggcgtgggaggtgggtctcgagcaatcgagttggttactagtaggaagtacagttcgacgtccgtcgtccgtggaacgggtccgttctctactctccgagacgacaacttacaaagactactacttatttactacaatcggacagacctaaggaacgaacgaacgacgtacgggtcgttagtttatttcggtagtagaaacgtagtagtaacgttacgtatagtaactaacccgttaaggtttcggggacgggttctttacgacgttggtcggtacgggg

SEQ ID NO: 284266 - DNA, 785 bp, Homo sapiens
  misc_feature: GYAE6OF01ANIJ1.14.57.F02.1.454.CMB.1.raw
  modified_base (265)..(265): a, c, t, g, unknown or other
  misc_feature (265)..(265): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggcttctttcttgtggctattttaaaagatgtccagtgtgaggtgcagctgttggagtccgggggagcgttggtacaggccgggggggtccctgacgactctcctgtgcagcctnaggattctatttttagcgtaatactgcctatgagcgtcggggtcccgccgaacgggcctaccggtaagggggaacggggccgtaggggagggttcggggttcctcgaacggcaaacgtccgtaaggttcggttactagggtaggtaagtaccgaacgtttccggaacggtcccggtaccttcccgggttcggaaaccgggggtcccggttttacctacccgtaacgtttcccgtacccgtaacggaacgtaaacccgtaaacgtttaacccgaaacggtaaacccttaacctttaccctttaactttttacccgtttaacctaaaacggttacggtaacctaacggtacccttaaaggaaacgaaccggaaacgaacggtaaccggggtacgtttacggtttaagtttttcggtaggttaaggaaacgtagtaaacggtaagttaaccgttattacggacttaaccccggtaagtttacgggggtacggttaccctttagacgttgtccggttacggggg

SEQ ID NO: 284267 - DNA, 757 bp, Homo sapiens
  misc_feature: GYAE6OF01BL2CS.14.57.F02.1.454.CMB.1.raw
  modified_base (749)..(749): a, c, t, g, unknown or other
  misc_feature (749)..(749): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcacctgttctttgtctccgaggggaaagacgcccaccctctcctcgcgacgggccagtcagagtcgtacaaccaacctaacttacgccttggtttcagcgaggacgccgtggaccgacggccctcccgacggtcccttaccgtactagttagtacgtgtacgtcgacctaccgtaccccgaccggaccggggccccgaacccggtccacccgtaccccgacgtacccggtacggttaccgacgggtcggaccgtacgggtccgggttacggtacggggacctacgtacccttacctaccgtcctaccgacctactacgaccgacgtaccgtaccgtaggacgttaccgtaaggttaagtttacgttttacggtacttttaaaggttttaccttacggttacggtccgtaacggtccgggtaacggggtccggtaacgttaacgggttcccggtccgtaccggtttaccggtaccggggttacgggggaccggggtaacgtacgggtacgtacggtaacgaacgtcgtaggtcgacgtcgacgtcagttccttacgttcctacgtaccgtttcccnccgtctcg

SEQ ID NO: 284268 - DNA, 733 bp, Homo sapiens
  misc_feature: GYAE6OF01ACY7G.14.57.F02.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagcgtctagtaccacgaccggtgctcgatttagctcgatatagttgggtttgggggaggaactgctcagttaggacccagagggaaccatggaagccccagctcagcttctcttcctctgctactctggctcccagataccaccggagaaatttgtgttgacacagtctccactcaccctgtctttgtcctccgaggggaaacngcccaccctctcctgcgagggccagtcaggngtgtcaacacctaacttacgccgttggtttcagcgagaacgcctggacccaggcctcccgaggtcctcctcatgtatcgatcgctactccacgacggcccacggcacgtccacgtccgaggttccgagtcggacgcgggtcgggttcgagggacagtacccttcgacctccgtaccaaccgtacgtcaacggtccacgtacccgttaagtacgttacgtacggtaaagtttaacgttttcgactttaacggttttacttaccgtttacgacgtacgtacggaacgggtacgggaacttaacggtccggacccgttccgttaccgggtaaccgggtttaccgggggaccgggggttaaaccgtacggggttaccggttaacggttacccggtaaaaaccgtacggttaccggtacgggtcccttaaccgggaccttaccgtacgtttaccgttaccggtttacttacccgtaccctttcccggttcccccgtaaccg

SEQ ID NO: 284269 - DNA, 852 bp, Homo sapiens
  misc_feature: GYAE6OF01DYS1T.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcagggccagtcagagtgtcaacaccaacttagcctggttcagcagagcctggccaggcctcccgaggcctcctcacttgtactgagtgcctactcccgaacgacggggacccaccgggacactccccgagtcccgaggtttaccagggtcggccgtaggcggggtactaggggaaccaggtaaccttcgaccgtttccgacccacccgtaacgtaccacggaccgtacggtaccccgttaagtacggttccgtaacggttaaacgggtttaacttttttacggaaccgttttaaggtttttaaccgtttaaccgtttacgggttacctaacggtcccgggtaacgggtacccgggggtaacttaaaccgggtttcggacccccggttaccgttacccgggttaaacccggggttttttccccggggggggaaccgggggggttaaccccggtaaacgggggtttacggggttaaaccgggtttaaacccggaaaaaccgggttaccggttacggggttaccgggtaccggtaacccggtacccggtaacccgtttaaacgtcccggttttaccgtttaacccgtttacccgttaccggttttcccccccgtttccccggacccttttaacccggg

SEQ ID NO: 284270 - DNA, 834 bp, Homo sapiens
  misc_feature: GYAE6OF01C1I48.14.57.F02.1.454.CMB.1.raw
  modified_base (269)..(269): a, c, t, g, unknown or other
  misc_feature (269)..(269): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcacatggagtttgggctgagttggctctttcttgtggctaattttaaaagatgtccagtgtgaggtgcagctgtggaggtccgggggagtcttggtacgacgggccgggggggtccctgaccactctccgtgtcgcagccnaaggatttactattttagacgtaaatatgccatgagtcgtcgggtacccgaccaagggtccgtaccggaagggggaaggggtccggttagggtagggttacggggttactaccgaggaactaactcgtaaggttggtttacgtaaggtaaggtaagtacgtaaagtttccggaaccgtcccgtccgttaccggtaggggaaaccgggttcccgggtcctaccgtaacgttaccctaccgtaaaggaacgaaaccgtaaacttaacccggaaaaagtaaaccctacgtttacctttaattttaccctaactaaagttccggaacgtacgtaccgtaaacgaaaacggaaaccgaaacggaaccggtaacgggggtacgtttacggtttaagttttttaggtaaggttaaaggtaaaaagtaaacgttaaacggttaaacggttacttaaaggttaacggttaaaccttaaaaaccccggtttaaagggttttaacgggggggtaaccggggtttaaccccgttttaggtaaacgtttcggggttaacccggggttaaccggggggg

SEQ ID NO: 284271 - DNA, 856 bp, Homo sapiens
  misc_feature: GYAE6OF01AB83Q.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccacggagaaattgtgttgacacagtctccactcaccttgtctttgctaccgaggggaancgccaccctctcctgcgacggcctagtcaggtagtcgtaccaacacccgtaattacggccttgggttacacgtcgaacgaacgtccgtcggaccgtacggtcccgtaccgtacgtccctacctacgtagtcgtagtacgtacgtcgtacctaccgtacccggaaccggacccggacccgacccgtacctacccgtaccgacccgtaccggttacgtacggtacggtaccggacggtacgggtccgggtacggtacggtaaccgtaaccgtaccgttacccgtaccgtacccgtaaccctaacgtaccgtacccgtaccgtaccgtaaccgttacggtaacgtaacggttaacggttaacgtttaacgtttacgtttaacgttaacggtttaacgtttaaccgttacggttaccgttacggtaccggtacgggacgggttaccggtacgttaaccgggtcccggtccggtacccggttaccgggttaccgggggtaccgggggtaaccgggttaaccgggtaacgggttaaccggtaaccggttaaaccggtacggttaaccggtcgggttaccggtacccgtaccggtaacccttacgttaccgttaccggttacttaccccgtttacgttacccgtacccttccgtacgttaccg

SEQ ID NO: 284272 - DNA, 758 bp, Homo sapiens
  misc_feature: GYAE6OF01EJ7CR.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaattgtgttgacacagtctccactcacctgtctttgtctccaggggaaagcgccacccttctccgtgcgacgggccagtcagagttcgtaccaaccacctaacttacgccttggtttcagcaagaacgcctcggccaagggtcctccccgaggtcctcctcaagttgtatcgtatcggccactccccgaacgccgggacccgacccggcacctccccgagtacccgtacggttacacggtcggacggtaggtccgggttcggtaacgggactaggttaaccccgtttctaaccgttcctaccaccctataccgtacgacctacggtacctaaggtacgttaacgtacggttaactttacggtttttacgactttaagggtttttacttaccgtttgtaccgtaaggtcccgggtacggtaccggggttacttaaccgggttccggtcccggttacttaccggtccggggtttaccggggaccggggggttaactacgggggtacggttaacgttaacgggtaaaccgtcgggttacgtcggtacgtacgtaacccgtctacgtttccgtcgtttaccttaccgttacctttcccgtcccgtcgttaccg

SEQ ID NO: 284273 - DNA, 631 bp, Homo sapiens
  misc_feature: GYAE6OF01CJJZA.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggcctcccgaggtcctcctcatgtatgatgcactcccacgacggccaccggcactcccgagccgtagttcgaggtggccgaggccgggtcgtggggactacgacttcgaccttcaccaccactcacgcgacgccgtagacgttctagtaagttattttcgactttaagtttattactgtacgagtccgagggcgggtactaacggttcgccgtcgtccgtaccgggtttccgggggacgggggtaaccctaggggtacggtaaggtaaccgtaaacggtacggtgtcgggaccgttgaccctaccgtagtttcggttaccgtttccttaccgtactttccccgttcccgcttaccgg

SEQ ID NO: 284274 - DNA, 589 bp, Homo sapiens
  misc_feature: GYAE6OF01EH8O2.14.57.F02.1.454.CMB.1.raw
  modified_base (420)..(420): a, c, t, g, unknown or other
  misc_feature (420)..(420): n is a, c, g, or t
  modified_base (431)..(431): a, c, t, g, unknown or other
  misc_feature (431)..(431): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttacgcctggtttcagcagaagcctggccaggctcccaggctcctcatgtatgatgcatcccacgacggcccaccggcactaccccagccgaggttcaaggtcggcacggcgggtcgtgggacaacggcttacactcgtcaaccatcagcagacctagagtctagaattatttgntatttattctnacgagcgaggcggacgtaacgtggaccgcgtcgtacggtttcgggacgggggaccgaagggtcggacgttaacgaaacggtaacgtggtcggtacttggaccgaaccctacgttccgttacgttaccttaccgttacttcccttaccccggtaacccg

SEQ ID NO: 284275 - DNA, 846 bp, Homo sapiens
  misc_feature: GYAE6OF01BHFJ6.14.57.F02.1.454.CMB.1.raw
  modified_base (794)..(794): a, c, t, g, unknown or other
  misc_feature (794)..(794): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctaattttaaaagatgtccagtgtgaggtgcagtctggttggacggtccgggggagtcgttggtacgagggcccggggggtccctgacctactcctccgtgtcgcacgcctcgaggtattctagtttttagcgtaatatcgcctaatggacgtccgtcggggtccccgaccgtacgggtccgttcccgggaaaggggggtaacgggggtaccggttagggggtaaccggggtttcgggggttcccttaccggaacggtaaccgtaaagttcccggtaaggggtttcgggtttaccgttaaggggttaacggggtaaaacggttaaccgtaaacggtttacccgggaaacccggttccccggttacccggttccccggggttaacggggtaaacccgggggttccccgggttttaccccttaccccgtaaccgtttccccgtacccggtaaacggtaaccgtaaacccgttaaacgtttaacccgaaaacgtaaacctaccgtttaactttaacgttttaccttaaacgtaaacgttacggaacgtacgtacccgtaaggaaacgaacgtaaggaccgtacgggtcgtttagttacgttttgacgtagaatagtaacgtagtatagtntacctaacgttaaggttacgggtcggttccttagcgttcggtgggtaccggg

SEQ ID NO: 284276 - DNA, 640 bp, Homo sapiens
  misc_feature: GYAE6OF01AKPQM.14.57.F02.1.454.CMB.1.raw
  modified_base (432)..(432): a, c, t, g, unknown or other
  misc_feature (432)..(432): n is a, c, g, or t
tcagcgtctagtaccacgaccggtgctcgatttagctcgatatagttgggtttgggtgcccaagctgctggagggcacggtcaccacgctgctgagggaggcttggtacagccgggggggtcccctgacactctcctgtgcagcctcaggattcatttttagcgaatatgccatgagctgggtccgccaggctccgaggggaacgggctggagtgggtctcagcaatcgagttggttctagtggaagtacatttccggacgccgttctccggtgaacggggccggttctccatcctccagagaacaacttccaagaacctactctattttacctacaaatggacacgcctagaaagacgaagaccgacgggtctgttagttttgtagtagaaagatacgaagtctatgactacccagtttgggacggtcttnagtgtcgtcggggacgaagggcgtcgtaggtccacccgttcgtccttcgaccgtccctaccaccgaacggtccccagtcccggttacccttcccccgtcggccctaccccctaccgtaccaacgtcgtcccgaccgtcggtccggggacaccggcgggcccggtcccggtcggtccgtacgtcccgtcggtaccgtaacggttacccg

SEQ ID NO: 284277 - DNA, 754 bp, Homo sapiens
  misc_feature: GYAE6OF01CT1SP.14.57.F02.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (291)..(291): a, c, t, g, unknown or other
  misc_feature (291)..(291): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (695)..(695): a, c, t, g, unknown or other
  misc_feature (695)..(695): n is a, c, g, or t
tcagcgtctagtaccacgaccggtgctcgatttagctcgatatagttgggtttggggggaactgctcagttaggacccagagggaaccatggaacgcccagctcagcttctcttcctcctgctactctggctcccagataccaccggagaaatttgtgttgacacagtcctccactccacccttgttctttgtcctccgaagggggaaancgcccaccctctcctgcngggccagtacaggagtcgtacaacacctaacgttcgcctttggtttccagcaggaacgtcccnggacccaggcctcccgaggtccttaccgtcaattggtanggtactcgtacactacccgnggaaccggcccgacggcacctaccccgaagtccgtcggttacgaggtcggacgagggttccggttaacggcgggaactcgtaacttcgtacctacgacctacgtacacgaacgctaacgtaccctaagggttcgttacgttaacgggtaaactttaggtttttaccgtaagttaaccggtttttatttactcgggttacgtaccgaccgggtaacgggtcgggtacttaacggttcccgggtaccgtaacggttccccgggttttacgttacccggggggacggggttaccgtaaggggttcgttaaacgggaccgtaaaacgtggttacggaccgtcggtaacncccgtaacgttcggttcttagttccccgttaacgtccgttaccgtccccgtaaccgtag

SEQ ID NO: 284278 - DNA, 605 bp, Homo sapiens
  misc_feature: GYAE6OF01DKB02.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctatttttaaaagatgtccagtgtgaggtgcagctgttggagtccggggagcttggtacaggccggggggtccctgacactctcctgtgcagcctcaggtattctatttttagcgaaatatgccatgagcgtgggtccgccgaggcctccgagggagggctgggagtgggtctcagacaatcagttggttactagtaggaagtacattcgacgtccgtcgtcgtggaacgggtccgttactccactcctaccagagactaattccaaagaactacttctatttctacaaatcgacacgcctagaaagacgaaacgacgacgggtcgttagtttagttttgtagtaagaaagtacgtaacggaagttactaagtagtaaccgttaacccgttaaggtttacggggtacggggttacctttgaacgttgtcggtacggggg

SEQ ID NO: 284279 - DNA, 737 bp, Homo sapiens
  misc_feature: GYAE6OF01AUYRF.14.57.F02.1.454.CMB.1.raw
  modified_base (257)..(257): a, c, t, g, unknown or other
  misc_feature (257)..(257): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggctctttcttgtggactattttaaaagatgtccagtgtgaggtgcagctgttggaggtccgggggagcgttggtacgcggccggggggtcctgaccactctcctgngcagcctcgaggtattctattttagacgtaatatgaccatgacgcgtcgggtccgccgaggccgtaccgagggggaacgggcgtagggtaggtcgggtctacgagactaacgtcgtaggttcggttacgtaaggtaggtaagtacgtagttaccggaaccgtcccgttccgtaccggtaggaacgggttcccggttacctcctaacgtccctacccgagtaacgaccgtaaactttaacccgaaagtaaccctacttacctttatttactaacgtaaagtacggactaaggacctaaggaaacgaacgaacgaccgtacgggtagtttagtttacgtttttagggacgttaggtaaaacggtagttaaaacggttaacggttacttaaggtaaccgttaaccgttaaccgttaaaacgggtttcgggggtaacgggtttacccctttgttaacggtttccgggtagggtaacccgggggg

SEQ ID NO: 284280 - DNA, 895 bp, Homo sapiens
  misc_feature: GYAE6OF01E5WZH.14.57.F02.1.454.CMB.1.raw
  modified_base (185)..(185): a, c, t, g, unknown or other
  misc_feature (185)..(185): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggcttcttttcttgtggtacttaattttaaaaagntgtccagtgtgaggtgcagtcgttggttggacggttccgggggagtcgttgggtacgacggggtcccggggggtccctgacctacctccttccgtggtgccacgcctcgaggtactttcgttaagtttttacgaccgtaaatagtcgacctagtcggacggtccgttccggggtccccggccgacggccgtaccggaaggggggtaacggggtcgtaggggtacgggtttcgggtacccgtacgacgtacgtaacgttaccgtagggtttcggtttaacgtaagggttacgggtaaacgttaccgtaacggtttcccggtaacccggtccccggtttacccgttacccgggttacgggtaaccggggttccccggtttacctacccgtacgttccccgtaaccgaacgggtaacgtaaacccgtaacgtttaaaccccgaaaacgtaacccttaaccttttacccgttttaaactttttaacccttaaacccgtaaacgttaccgggtaaaccacgttaacccgtaaggaaaaccggtaacgaaccggtacgggtaccgggttacggtttagtttttaggttttaggtaagtaaaggtaaagttaacgtaaacggtaagttccgtaagttaaccgtaaaccgttaaccggttaagggtttacggggtaccgggtttcctttaaggcggtttcggtcggggtaacccgggg

SEQ ID NO: 284281 - DNA, 688 bp, Homo sapiens
  misc_feature: GYAE6OF01BIR7M.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaacttacgcctggttcagcagacgctggccaggcctcccgaggctcctcatgtatgatgcactcccgacgtacgggcccaccggcaacgtccccgagcccgtaggttccgaggtcggacgacgggtccggggttctacgggggaactacggtacctttaccaaccgttcctaccgacctatcgaacgtccaaggtccctaggtacgtcgtaggtaacgttagttttcggacttaaggtttttacttacgtagttaccgaacggtcgtagggtccggggtaactaacgttccggcccgtcgtccgtacgggtttccgggggaccgggggtacgtaaggggtcggtaacgtaccgaaaacggtacgttgggtaacggtccgtacgacccgtaacccgtacgttccgttaggttaccctttcgtacctttccccgttacccgtctaaccg

SEQ ID NO: 284282 - DNA, 878 bp, Homo sapiens
  misc_feature: GYAE6OF01DMG48.14.57.F02.1.454.CMB.1.raw
  modified_base (833)..(833): a, c, t, g, unknown or other
  misc_feature (833)..(833): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcacccttgtctttgtctaccggaaggggaaagcgccctacccttctccgtgcgacgggccagtcgaggtagtacgtacaaacctaaccaacgtttaacgtccgttggttttaccaaggacgaacggaaacggtcccgttacggggacccgtaacggggcccttaccccgggaagggtcccctttacctaccgtaaggtttaccggttaacgttagggtaactttccggaacccttaaccccggtccccccgtaaacgggacccgggggtacccctaacccggggacccacccgttaccccgacgggtacccggttaaacgggggtttaccgaacggggttcgggacccggtaacggggttccggggttacgggtaacgggaacgtacggtaacctttaccgaactttaccccgtacgtaaccacgttaccgaacggtaccgtaaccggtacgttaacggtcggttaaccgtaaggttaaacggttttaacgtttttacggtaccgtttaaagttttaccgttaacttcggttaccggtaggaccggttacggggaccgggtacgttaacggttccggaccgttccgtacggttaccgggttaccggggacggggtaacgtagggtacggtaaggttaccgaaacggtcgtcggtacgngtaccgtcacgtactcgtacttcctatcccttaccgtccctaccg

SEQ ID NO: 284283 - DNA, 745 bp, Homo sapiens
  misc_feature: GYAE6OF01BX9PC.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaaaccacctaaacttagccttggtttacagaccgaggaagcctggaccaggcctcccgacggcctccgtacagtagtagtgatggcctactccccaagacgggcccaccggcacgtcccacgaccgtaggttacaggtcggacacgggcggttcggtaggacacggttaaccttccgaacgttccctaccaacctaagtacgaacggacaaccggtaccgttaaggacgttacgtaggtaaacgttaagtttttacggaactttaacgttttaacgtttacgttacggttacgtaacggtaccggaacgggtaccggggggtaactaaggtttccgggacccgttcgttaccggtacccgggttttaccgggggaccgggggggtaacccgtaaggggttacggaacgggtttaacggaaaaccggaaggtttcggaggggtactacggtccaaaccgttagtccgtttacggttacttaccgtaccttaccggttcccccgtaaccgg

SEQ ID NO: 284284 - DNA, 847 bp, Homo sapiens
  misc_feature: GYAE6OF01A74FU.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtcctccactcctaccctgttctttgtcctccgaaggggaaagacgccaccctctcctgcgacgggccagtcagagtcgtacaaccacctaacttacgccgttaggttcacgtacaaggaacgtccgtcggaccacggtccctacccgacggtccctccgtactagtgtaatgactcggacctacgtaccccgaacggacccgggcccaaccggtccctaaccgtacccccgaaggtcccgttaaggttaccgtacgggtccgggtaccggacgggtccggggtacggtacggggtaaccctacggttaacccgttaccctaaccgttccctaccctaacccgttactaccgaacgtacccgtaacggtaccgtaacggtaacggtacgttaagttaacgtttagttttcgtaacgtttaacgttttacgttaccgttacggttaaccgacggtaccggacgggtaccgggttaactacgggttcccggccgtttaccgttaccgggttaccgggggttacccgggggtaccgggggtaacgtaggggttacccggtaacggttaaccggtaaacgttcgggtacgggttccgtaaccggttccgtaaccggtaccgttacgttccgtttaccgtttaccgttttacccgtaccccgttttccccgtacgttacgtttaccg

SEQ ID NO: 284285 - DNA, 625 bp, Homo sapiens
  misc_feature: GYAE6OF01ANYUN.14.57.F02.1.454.CMB.1.raw
  modified_base (202)..(202): a, c, t, g, unknown or other
  misc_feature (202)..(202): n is a, c, g, or t
  modified_base (583)..(583): a, c, t, g, unknown or other
  misc_feature (583)..(583): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagngccaccctctcctgcagggccagtcagagtcgtcaacaccaacttacgccttggtttcagcaggaacgcctacggccagggtccaccccgacgggccttccctcagttgtatgatcggtcactcccgacgacgggacccaccggcacctcccgacgccgtaggttccgaggtcgcgacggtcgggtcgtagggacacggtacttccacgtctaccaccactcgacgtacacgtctagacgtctagtacgtatttgacttagtttactagtgtcgagcgtgggaccggtatacggttcggcccgttcgtacgtacgggtttaccgggggacggggtaacctaggggtacgaacgttacgaacgtacgtggtacgctcgaccnctattccgttagtccttactaccgttccgtcccgtccttacg

SEQ ID NO: 284286 - DNA, 641 bp, Homo sapiens
  misc_feature: GYAE6OF01A7ST3.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagctgggttttcctcgttgctcttttaagaggtgtccagtgtgaggtgcagctggttggacggtccggggggaggcgttggtacgagggccgggggggtccctggacacctctcctgtgcacgcctcaggattcatttttagcgaatatgccatgagcgtgggtcccgcaggctccgaggggaagggctggagtcgggtctcgagcaatcgaggttcggttactaggtcggaagtaccatttcgacgtcccgtcgtccggtgaacgggtccgttctccatctccagacgactaacttccaaagaactactctatttctacaaagtggacagcctaagaaacgacgaagaccgacggggtcgttagtttacgttttaggtagtaggaaaagttcgtaaacgtaacggttacgtaacgtagtaacccttaacccgtaaggtttacggggaaccggttccctttacgaagttcgggtaccgtcgggggtaaacccgg

SEQ ID NO: 284287 - DNA, 587 bp, Homo sapiens
  misc_feature: GYAE6OF01DAXNB.14.57.F02.1.454.CMB.1.raw
  modified_base (504)..(504): a, c, t, g, unknown or other
  misc_feature (504)..(504): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtccctgacactctcctgtgcagcctcaggattctatttttagcgtaaatatgccaatgagcgtcggggtccgccaggcctaccgaggggaacgggctggaggtgggtctcgacgacaagtcagtggttctagtaggaagtacagttcgacgtccgtctccggtggaagggtcccgttctccatctccaagacgacaacttaccaaagtaaccacttactattttcctacaaattggaacacgcctagaaagacgaagaccgacgggtntagttattttgagtaagaagatacgaattcgattgacttaaccgtaagtttcggggacggttccttagactggtcgtacgggg

SEQ ID NO: 284288 - DNA, 624 bp, Homo sapiens
  misc_feature: GYAE6OF01AR118.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctttcctcctgctactctggctcccagactaccaccggagaaattgtgttgacacagtctccactcaccctgtctttgtctccaggggaaancgccaccctctcctgcagggccagtcagagtgtcaacaccaacttagccttggttcagcagaagcctggccaggcctcccgaggcctcctcagtgtactgatgcactcccgagacgggtccaccggcactcccagccaggttcaggtggcaggcggtcgtgggacagtcttcgcttctaccacatcagccagtcctagacgtctagagtatttgacttaagtttacttactcgttacgtacgcgtaggaccgggtcgtaacgttggacccgtcgtaccgttaccggtttccggggacgggggtacccggtaagggttacgggtaacgtaccgtaaaccggtaccgttaggtcgggtacgttaccgtgaacccgtcgtaccgttcgttacctttacgacccttaccgtcccgtcctagtacccg

SEQ ID NO: 284289 - DNA, 816 bp, Homo sapiens
  misc_feature: GYAE6OF01ETYZ7.14.57.F02.1.454.CMB.1.raw
  modified_base (296)..(296): a, c, t, g, unknown or other
  misc_feature (296)..(296): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcacctgtctttgtctccgaggggaaagagccaccctctcctgcagggccagtcagagtgtacaacaccaacttacgccttggtttcagcagaacgccgtggccaggcctcccgagcctcctnatgtatggatcgcactcccacgacgggcccaccggctaccgtcccgacggtaccgtaggttacgaggtcggcgacggtccggggtacgtacggggacctaggtaccttaccgaccttaccgtacccaacccgtataccgaacgaccgaacggtcccgtaagggttacgttaccgtaagggttaaacggtttagtttttacggtaaccgttttaaaggttttttaactttaacgtttcggttaaccggaacgggtccgggtaacggggtaccggggttaaccgttaacgggtttcccgggggccccgttaccggtttacccggtttaaccgggggttttccccggggggaacccgggggggttaaacccgttaaggggggttacgggttaaccggttaaccggtaaaaccgggtaccgggttaggttaccgggaccgtttacggaacccgtaccgttacgtttacccgttacggtttacctttaccgtacccgtttccccgttaacccgcccgtttaccgg

SEQ ID NO: 284290 - DNA, 454 bp, Homo sapiens
  misc_feature: GYAE6OF01BG249.14.57.F02.1.454.CMB.1.raw
  modified_base (436)..(454): a, c, t, g, unknown or other
  misc_feature (436)..(454): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaaggggacgctggtcaccgtctcttcagcctccaccaacgggcccatcggtccttccccctggccaccctcctccaagacgccacctcgtggggcacgagccggcccgtgggctcgccgtcggtacgaacggtactaccttccgtactacgacgctgagcggctggacaaggcgacagtagnnnnnnnnnnnnnnnnnnn

SEQ ID NO: 284291 - DNA, 775 bp, Homo sapiens
  misc_feature: GYAE6OF01B8NBI.14.57.F02.1.454.CMB.1.raw
  modified_base (381)..(381): a, c, t, g, unknown or other
  misc_feature (381)..(381): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccgggagaaattggtgttgacacagtctccactcaccctgtctttgtctcgaaggggaaagacgccaccctcgtcctgcgagggccagtcagagttgtaccaacaaccaacgttagccgttggtttcaagcaacggtaagccgtacggccaagggcccttaccccgacggtcctcctacgaagttcggtatggatcggaccactcccgaacggaccggggcccacccgggactaccncccgaacggccgtaacgggttcgacggtcggacgtacgggtcgggtcgtacggggactaacgtccttacaccgttcgacctaccagtcccaacggtacacgtaccgtaggtaacgtacgtaaggtaagtttacgtttcgtacgtttaaggttttaacgttacgttacggtacgtagggtccggtaacggggtcgggttaacgtaacggttcgggacccttacggtccgttacgggggtttacccggggggaccgggggttaacggtaacggggtacggttaacgtaacggtaaaaccgggttcgtacgggtacggtccgttacgaccctaaaccgtacgttacctttcggttaccctttaccttaccggtttcccgtcccgtaacccgttacgg

SEQ ID NO: 284292 - DNA, 715 bp, Homo sapiens
  misc_feature: GYAE6OF01B370C.14.57.F02.1.454.CMB.1.raw
  modified_base (158)..(158): a, c, t, g, unknown or other
  misc_feature (158)..(158): n is a, c, g, or t
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (315)..(315): a, c, t, g, unknown or other
  misc_feature (315)..(315): n is a, c, g, or t
  modified_base (549)..(549): a, c, t, g, unknown or other
  misc_feature (549)..(549): n is a, c, g, or t
  modified_base (593)..(593): a, c, t, g, unknown or other
  misc_feature (593)..(593): n is a, c, g, or t
tcagcgtctagtaccacgaccggtgctcgatttagctcgatatagttgggtttgggggaggaactgctcagttaggacccagagggaaccatggaacgccccgagcctcagcttctcttcctcctgctactctggcctcccagactaccgaccggaanaaattggtagttgaacacagtccgtccactccacccttgtctttgtccaccgagggaaancgccaccctcncctgcgaggcctagcaggatgtaccaaacaccctaagttacgccgttggttacaagccgaagaacggtcgtaccggcgacggtccncccgaacggtccttccctacgtagtttacgtagtgaacgtttcgaaccgacccttacccgaaccggaccggggacccctacccgggaccttttaaaccgccccgggaacgttacccccgtaaggggttaccaaggggtttccggaacaacgggggttccgggtacgtaccgggacacggttcttacgacctctaacaaccgtgtacccgaagttccgaccgacgtaacgtagtntaacgtagtagtttacgactttaagtttacttacgtagttacgngaccgacgggtacgacgtacggtcgccgacggttcgacgggttcgggacggtacggacgtacggacttacgaacgtgtacgtgatacggcacgtctcgtcgttctaccgcttcctccggtac

SEQ ID NO: 284293 - DNA, 769 bp, Homo sapiens
  misc_feature: GYAE6OF01DNUER.14.57.F02.1.454.CMB.1.raw
  modified_base (204)..(204): a, c, t, g, unknown or other
  misc_feature (204)..(204): n is a, c, g, or t
  modified_base (329)..(329): a, c, t, g, unknown or other
  misc_feature (329)..(329): n is a, c, g, or t
tcagcgtctagtaccacgaccggtgctcgatttagctcgatatagttgggtttggggggaactgtctcagttaggacccagagggaaccatggacgtccccagctcagcttctcttcctcctgctactctggctcccagataccaccggagaattgtgttgacactagtctccactcacctgtctttgtctaccgaggggaaancgccaccctctacctgccgacgggccacggtccagacgtcgtaccaacacctaacttagcctttaggtttaccagtcaggaacgtcccgtcggaccctacgggccttccccgagggtcctcctanacttacgtatcgaattcggaccactacccgacggtcggggacccaccgggctacctaccccgaagtcccgttacggttaccgacgttcggccgtacggtccggggttcacggggaactacggttaccttcaccttacctcgtaaaccccgattacccggacgtaccgtacggtaccgttaacggaccgttaccgtaagtaaacggttacttttcgaaccgtttaagttttacgttacgttacgttacaacgggtcctaccgggtaccgggtactaacgttccggaccgtacgttacgttaccggggttcggggaccgggggtaacctaacgggtcggtaacggttaaccgaaacggtacgttcgggacggttaccgtacgtaccgtaccgttacttccgttcgttacccttaacgtccgtttcccgtaccgtccgtaacg

SEQ ID NO: 284294 - DNA, 940 bp, Homo sapiens
  misc_feature: GYAE6OF01D6GX5.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggtagtttgggctgagttggcttcttttcttgtggcttaattttaaaagatgtccagtgtcgaggtgcagtctggttgggacgggtccgggggaggtcgtttggtaccgacggggtccccgggggggtcctcgacctactccgtccgtgtcgacgacgcctacgtaaggtatttacttagtttttaacggaccgtaaattactcgtacctaagtacggtacggtcccggtttacgggggtccccgtaacccggacggggtcccggttaacccggggaaagggggggtaaacggggtcggttagggggtaagggtttcgggttacctacggtaacggtaacctaagttccggtaaggttcgggtttacgtaaggggttaacggtaaacggttaccgtaacgtttacccgggacccggttccccggttaccggttaccccgggtaggggtaaacccgggggtttccccgttttaacccgtacccgtaccgtttacccgttaccccggaaaaggtaccgtaaacccgttaaaaccgtttaacccaaaaacggttaaaccctacccttttaacgttttaacttttttaaccgtaaaaccgtttaacggttaacggaacccgtacggtacccgttaaaggaaaaccggtaccgggaaacgtaccgggtacggggtttacgttttaggtttagttttacgggtaagtaaagtaaaggtacttaacgggtagtaacgttagtaccggttaacctaaaccggttagggttacgggtacggttacctttaggaacggttcggtcgggtaaccggg

SEQ ID NO: 284295 - DNA, 774 bp, Homo sapiens
  misc_feature: GYAE6OF01DJTQZ.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctcgaaggggaaancgcccacccttctcctgcgagggccagtcagtagtcgtacaaaccaccaaacttacgaccgttggttcagcaagaacgccgtggacccgtaaggccctacccgacggtcctccgtactaagttcgtaatcgatcgactactaccccgacgtaccgggacccaccgggacctaccgtaccccgaggacccgtaagggttaccgtacggcggaccgacgggtccggggttagaccggggtaacctaacggtacctttacctacccttcgtacctaacctaacgtccaacgggcaacggttcccgtaaaggttacggttactaaggttaaagtttcgttttacgtacgtttaacgttttaagttaccgttagttaccggaccgttacggtacggggaacccgggtacttaaccgggttcccgccggttaccgttacgggttacccgggttacgggggaccggggtaaacgtgggtaacgtaaccgtaacggaaacgttaggtcggacggtaccctgaacccgtaacctgttaccgttactttaacttacccgtttcccgtcccgtacgtaccg

SEQ ID NO: 284296 - DNA, 720 bp, Homo sapiens
  misc_feature: GYAE6OF01E45AC.14.57.F02.1.454.CMB.1.raw
  modified_base (188)..(188): a, c, t, g, unknown or other
  misc_feature (188)..(188): n is a, c, g, or t
  modified_base (208)..(208): a, c, t, g, unknown or other
  misc_feature (208)..(208): n is a, c, g, or t
tcagcgtctagtaccacgaccggtgctcgatttagctcgatatagttgggtttggggctgagagaggagccccagtcctgggatcttcaggtgttttcatttggtgatcaggactgaacagagagaactcaccatggaggtttggctgtagttggtcttctttcgttgtggtacttaattttaaaagntgtcctagtgtgaggtgacngtcgtggtggacgggtccggggagtcgttaggaccgcgggtcccgggggtcctagaccacctcgtcctgtcgaccacgtcctagagtactttattacttttagacgtaatgacgacgagtcgcgtaccgtccgggtccgccgtacggacgtaccggaaggggaccgggtggtacgggtgtacggtctacgacgtacgtaacgtgtacggttagttacgtaaggtacggtaacgtaacgtcgtaccggtccgtcccgttccggtacggtacggtaccggttcccttacctacgtacctaccgacgaacgtaactaaccgtaaccttaaccgtaaacgtaccttaccttactttagttacctaacgtaaacggctaaccgacgtacgaacgaacgtaaccgaacgtagggtccggttagtttagtttacgttaggaagtaaagtaacgtagtaaacgtgtactagtactacgttaacgtaggttcggtacgttctaagcggtcgtgggtaccgg

SEQ ID NO: 284297 - DNA, 723 bp, Homo sapiens
  misc_feature: GYAE6OF01CT4XN.14.57.F02.1.454.CMB.1.raw
  modified_base (255)..(255): a, c, t, g, unknown or other
  misc_feature (255)..(255): n is a, c, g, or t
  modified_base (330)..(330): a, c, t, g, unknown or other
  misc_feature (330)..(330): n is a, c, g, or t
  modified_base (377)..(377): a, c, t, g, unknown or other
  misc_feature (377)..(377): n is a, c, g, or t
  modified_base (572)..(572): a, c, t, g, unknown or other
  misc_feature (572)..(572): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccagtggagttgggctgtagttggcttctttcgttgtggacttaattttaaaagatgtccaagtatgaggtgcagctgtggaggtccggggagtctggacagggccggggggtaccctgaaccncgtcctaccgtgtcgcgacgccctgaaggtattaccgttagttttacgaccgtaaattatcggacctaagtaggngtccgttcgggaccccgccgaaggcccgtacggaagggggaaccggngttagggaggttcggtataccgagtacaagttccaggttgttacgtaaggtaggaataccgtagtacccgacggtccgtacgtccggagaacggttccccgtataccgataccgtaccgagacgtaacaacgtaaccgaagtaacctacttctttacgttactaacaaaggtcgaacagtacctaaagaaaccgngtaaaccggacgagggttaccgttgtttaacgtttggtaagtaacggtaaaactagtaaacccggaagttacgtaaactgtaacccgttaaaccggtaggtttaccggggaaccggtttacttacgaaacggtgggttacccggaacgggg

SEQ ID NO: 284298 - DNA, 652 bp, Homo sapiens
  misc_feature: GYAE6OF01D8T0K.14.57.F02.1.454.CMB.1.raw
  modified_base (228)..(228): a, c, t, g, unknown or other
  misc_feature (228)..(228): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtcttgtctccagggaagagccaccctctcctgcagggccagtcagngtgtcaacacaacttagccttggttcagcagaagcctggccaggcctcccgaggctcctcattcgtatgatgcctactcccgaagacgggcccaaccggtcaaccgtcccgaagtccgtaaggttccaggtcggctagggcggggtacgtggggaacaggtaccttcaacgttccactaccatcaacgcacgtacctaggacgttcgtaggtaaacgttagttttacgactttaacgttttattacgtcgttacgacgtacgtacgggtacgggtactaacgttccggtacccgacgttaccgttaccgggtttaccggggaccgggggtaacgtagggtcggtaaacgttacgaaacgtacggtagtcggtactacggtaccacgtattaccgtacgttactacgtacttcccgtcccgtacg

SEQ ID NO: 284299 - DNA, 773 bp, Homo sapiens
  misc_feature: GYAE6OF01CT0J0.14.57.F02.1.454.CMB.1.raw
  modified_base (198)..(198): a, c, t, g, unknown or other
  misc_feature (198)..(198): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgctcaggggaangccaccctctcctgcagggccagtcagagtgtacaacaccaattacgccttggttcagcaagacgcctggccaggcctcccgaggcctcctcagtgtactgatcgcctacgtcccacgaccgggacccaccggctaccgtccccacggccgtaggttcaaggtcggacgtaggccgggttcgtacggggactacggtacctttcgacctttccgacctaacccgacgttaccgaaccggtccgtaaccggtacccgttaaggtaccgttacgttaacggtaaacgtttagtttttaccgtaacgtttaacgtttttaacttaccgttacggttaaccgtacggtacgggaccggggtaccggggtaacgttaaacggttccgggtacccgttacgttacccggtttaccggggttccgggggggaccggggggttaaccgtaaaggggttccgggttaaacgttaaccggtaaaaccggtacggttcgggacgggtaccgtccggaacccgtacgtacgttaccgtttcgttaccccgttaacttcccggtttccccgtccccgtaacttaccgg

SEQ ID NO: 284300 - DNA, 726 bp, Homo sapiens
  misc_feature: GYAE6OF01CG04X.14.57.F02.1.454.CMB.1.raw
  modified_base (237)..(237): a, c, t, g, unknown or other
  misc_feature (237)..(237): n is a, c, g, or t
  modified_base (578)..(578): a, c, t, g, unknown or other
  misc_feature (578)..(578): n is a, c, g, or t
  modified_base (717)..(717): a, c, t, g, unknown or other
  misc_feature (717)..(717): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtagttgacacagtctccactccacctgtctttgtcctcgaggggaagagccaccctctcctgcgacgggcctagtcagtagtntacaacaacctaacgttacgcctttggtttcaggactaacggaacgcccttggcctaacgggccctaccccgagcctccctacgacttacggtatcgacttcgaccgtacctccccgaccgaccggggaccccgaacccggtacctaccgtccccgtacgaccccgtacggtactacggtcggtaccgacggtccgggtacgtacgggaccgtacggtaccgttactacccgttaccttaccgacccgtaactcgaacggcctaacggtaccctagtaacgtacgttaggtaaccgttaagttttcgtacttacgttttagtttacctgtaccgtgaccgngggtaccggactacgttcggccttgccgtaaccgggttcgggaacggggacgtaggtcgtacgttacaaacggtcgtagggttcgacgttgacccgtactcgttaccgttgttaccgttaccttactccccggttcccnccgttaacg

SEQ ID NO: 284301 - DNA, 887 bp, Homo sapiens
  misc_feature: GYAE6OF01AF8R2.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttattttaaaagatgtccagtgtgaggtgcagctggttgggaggtccgggggaggtcgttggtacgacggcccgggggggtccctgacactctcctgtgcacgcctcgaggtattctagtttttagacgtaattatcgccagtggacgtcgtcgggtcccgaccgacggcctaccggaaggggacggggtccgtagggacggttcgggtctcgacgctaatcgtaggttggttacgtaaggtaggtaaacgttactaacgttccggaccgtcccgttaccgtccggttacggtaaccggggtcccggtttacctacccgtacgttcccgtacccgaacggaacgtaaacctaaacgtttaacccgaaacgtaaacccttacccgttttaccctttaacgttttttaaccccgttaaacgtaaaacggttaccgggaaacccgtaacggtaaccccgttaaagggaaaaaccggtaaacccgggtaaaacgggaacccgggttaaacggggttccggtttaaaggttttttaagttttttacgggtaaggtttaaaaggtaaaacggttaaaccgttaaaccgggtaaacgtttccgttaaaggtttaccggtaaacccgtttaaaacccccgggttaaagggtttttaccggggggtaaccggggttttaccccttttaaggaacggttttccggggtacccgggttaacccggggggg

SEQ ID NO: 284302 - DNA, 880 bp, Homo sapiens
  misc_feature: GYAE6OF01DQ54O.14.57.F02.1.454.CMB.1.raw
tcagcgtctagtaccacgaccggtgctcgatttagctcgatatagttgggtttggggctgagagaggagcccagtcctgggatcttcgaggtgttttcatttggtgatcaggactgaacagagagaactcaccatggagtttgggctgagttggctctttcttgtggctaattttaaaagatgtccagtgtgaggtgcagctgttggaggtccgggggagcttggtacgaggccggggggtccctgacactctccgtgtgcagtcctacaggtactttcttaacttttttaggaccgtaaattacgtcgaccctaagttcggaacggtccgttcgggggttccccggacccggtacgggtcccgttacccgggaaagggggggtaaacgggggtccgttagggggtaacgggtttcgggggttaccttacggaacggtacctaaaacgtttccgtaacgggtttcggtttaccgttaaggggttaacgggtaaaccgttaaccgtaaccggttttacccgggaacccgttccccgggtttaccgttaccccgggttaagggtaaacccgggggttccccggtttaccgttaccctacgtttaccccgtacccgtaaagggaacgtaaaccgtaaactttacccgaaaacgtaacctacctttactttatttacctacgaaaagttcggaacctacgaccgttaaaggaaaccgaacggtaaaccgtaccggtacgggttcgtttagttttaacggttttggtagttaacggaaaatacgtaaacgtaacgtaccgttagtaggtaaccttaacccggttaaaggtttcgggggtaaaccggtttccctttaggaacgttcgggttcccggtaaccggggg

SEQ ID NO: 284303 - DNA, 1118 bp, Homo sapiens
  misc_feature: GYAE6OF01D2F1F.14.57.F02.1.454.CMB.1.raw
  modified_base (193)..(193): a, c, t, g, unknown or other
  misc_feature (193)..(193): n is a, c, g, or t
tcagcgtctagtaccacgaccggtgctcgatttagctcgatataggttgggtttggggctggagagaggagcccagtcctgggatcttcaggtgttttcatttggtgatcaggactgaacagagagaactcactagtggagtttggcttgtgttgtctttctttgttggttagtactttaaagttttaaaagngttcgtccgtaaggttggtaggtagggttgcggtacggttcggtacgggttacggggtcgggggttaccggggggtacggttcgggtttaacgggtaccgggtcccggggggtccccgggggttactaccggtaccttccgttcccgttacgtcggaccgtaccggaccgttacgttaccggttagttaacgttttaaccgtttttaacgggtttaaccaacgttaacgttacggtccgtaacgtacgggttacggtaccgggttaccggggtaccccgggtccggacccggggtaaccggggttacccgggggaacgggggggttaaaggggtccggggtttacgggtaggggtttccggttaacggttcccgaagttaacggttaccgtaacggttaacggggttacggtttaaccggttaaggggttaacccgtaagggttaaacccggtttaacccggtccccggttaaacccggggtcccccggtttagggtttaaaccccccggtaggggggtttaaccccgggttacccgggttttacccgtaacccgttaacccttaaccggtaaccgttaacccgggaaaacttaacccgtaaaccgtttaaaccccgtaaaacgttaaacccttaacgttttaacccgtttaacgtttttaaccctaaaccggtaaaaggtttaaccccggcggtaaacccggttacgaaaaggggtaaaccggtaaggtaacccggtttaccgggaacgttttaggttaaccgttttttaagtacggtaaaggtaaaccggtggttaaacgtaacgttaacgttagttaacgggaacctttaaacccggttagttttaaaccggggggtggggtttacccccgttagggttaacccgtaggtttggtaccccgggggtaaggtaaacccggggg

SEQ ID NO: 284304 - DNA, 776 bp, Homo sapiens
  misc_feature: GYAE6OF01CA544.14.57.F02.1.454.CMB.1.raw
tcagcgtctagtaccacgaccggtgctcgatttagctcgatatagttggggtttggggggaactgctcagttaggacccagagggaaccatggaagccccagctcagcttctcttcctcctgctactctggcctccagataccgacggagtaaattgtgttgacacagtctccactccacctgtctttgtctccgaaggggaagacgccaccctcctcctgcgacgggccagtcagagtcgtacaacacctaacgtcgtaccttggttcagacgtagaacgccgtcggaccgacggcctcccgaacggtcctcctactaacgttgtacgtgtacgtacgacctaccacccgaaccgacggccccgaccggaccctaaccgtccccaacggtaccgtacgggttacgacggttggaccgagggtccggggttacgtacggggaacgtacgtaccgttaccgaccttaccctacactacgtacgacgaacgtacgtacccgtaaggtcgttacgagttaacgttgtttagtaagtttaacgttttacttacggtacgtacggacgtaccgagggtaccgggttactacggttccggtccgttaccgttacccgggttaccgggttacggggggacccggggtaaacgggttaaccgggtaacgggtaaccggttaaccggaaaacggttccggtagggttccgtccggtagtaaccccgtggttacctacggtttcgttaccctacgtttaccttaccccggttccgtacttacccgg

SEQ ID NO: 284305 - DNA, 727 bp, Homo sapiens
  misc_feature: GYAE6OF01BCSNC.14.57.F02.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctccagataccaccggagaaattgtgttgactacagtctccactcaccctgtctttgtctcaggggaangccacctctcngcgcgcngnagtgtcgacacacctaatcgtcgttgttacnacgagacncgtcgacggacgtcctaccgagtcctccagttagtacgtatagtacgtacgtacctaccgtaccggaccggaccggttacccaccggtacacccgtccgaacgtaccggtacggtactacgggtcgtacggtcggtacgggtacgtacggtaccgtacggttccttaaccgtacgtacccctaacgacctggtaccacggactacgtacggtacgtacgttaaggtacggttaaactttcgttaacgtaacgttttaagtttaccgtacgttggaaccgagggtaccggtaacgggacggtttaccggtaaacgttccggaccgttacgttaccgggttacggggttaccggggggaaccgacgttagggtacggtataaaccggtaacgtcggtggtacggtcctacggcccttacggtaccctttaccggttcttaacccgtacgtacccgtttacctccgtactagg

SEQ ID NO: 284306 - DNA, 928 bp, Homo sapiens
  misc_feature: GYAE6OF01DODE7.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggtctaattttaaaagatgtccagtgtgaggtgcagctggttggaggtccgggggaggtcgttgggtacgacgggtcccgggggggtccctggacctaccttccgtccgtggtcgaccgacgtccccgtagaacgggttactttaccgttaagttttttaacgaccggtaaattaagttccggaccttaagtcgggaacgttccggttccggggggttccccgacccggaggggtcccgttaccgggaaacgggggggtaaacgggggtccgttaggggtacgggttcggggttcctacgtaacggtacctaaagtccgtaagggtttcgggtttactaaggggttacggtaaacgttactaacggtttcccgggaaccgttcccggttaccgtaccggttaggggtaaaccgggttccccggtttacctcccgtacgttccctacccgtaaggtacgtaaactaacccgtttaaccgaaaacgttaaacccgttacctttaccgtttaacttttacccttaaacgtaaacggttacggaaacctcggtaaccttaacggaaaacgacgggaaaccggtaaccgggtacggggttacgttttacgttttaacgttttgggtaaacggttaaggttaaaagtaccgttaaacgggtaacggtttactaagttaaccggtaaccggttaaccccgttaaggggtttaccgggggtaccggtttacgttttaccgaagggtttccgggttaagggtaacccggggg

SEQ ID NO: 284307 - DNA, 713 bp, Homo sapiens
  misc_feature: GYAE6OF01BSVN4.14.57.F02.1.454.CMB.1.raw
  modified_base (217)..(217): a, c, t, g, unknown or other
  misc_feature (217)..(217): n is a, c, g, or t
  modified_base (482)..(482): a, c, t, g, unknown or other
  misc_feature (482)..(482): n is a, c, g, or t
tcagcgtctagtaccacgaccggtgctcgatttagctcgatatagttgggtttgggggggaactcgctcagttaggaccctagagggaaccatcggaaggcccccagctacgagtcgttctccgttcctccttgctactctggcctcccagaactaccaccggaagaaacttgtgttgacacagtctccactcacctgtctttgtctccgagggaangccacctctctgcagggccagtcagagtgtacaactaccacttacgcctggttcagcagacgcctggaccaggcctccgaggtcctcctcctagttcgtatgtatggacctacgtcccaacggtcgggaccctaccggactacctcccgacgtccctaggttccgaggtcggaccgacggtccgggtcgagggaccctagtaccgttcacctccactacctagtccacgtaccacgtaccgttagaccgttgtaagtaacgtttnttttacgacttagttttacttacgtacgtcgacgtacggagggtacccgggtaataccggttcgggccgtacgttaccggtacgggtttacccggggggaccggggttaactaggggttacgggttaacggtaacccaaacgggttacgtcggggttacgaccgttaccggacctaaaccgtcgttacgttccgttaaccttccgtaaccgtttcccctaccggacttccg

SEQ ID NO: 284308 - DNA, 783 bp, Homo sapiens
  misc_feature: GYAE6OF01BHKMP.14.57.F02.1.454.CMB.1.raw
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggcttctttcttgtggactaattttaaagatgtctagtttgaggtgcagctggttggacggtccgggggaggtcgttggtacgacgggcccgggggggtccctggacacctctccgtgtcgcacgcctcgaggtacttcgttaagtttttagacgtaaattgtcgcctatggacgtcgtcggtcccgcgacggtcctaccggaaggggagggcgtagggtacggttcggtccgtagacgtaccgtaagttccggtaggtttacggtttacggtaacgggtaaggttaaacgtacgttacgttcccggaccggtcccgttccgttacccgggtagggtaaccggggttcccggtttacctacccgtacgttcccgtaccgtaacgaaccgtaaactaaccgttaaccgaaaacgtaacccttaccgtttaactttaactttaccttaagtaacgtacgggtaacacggttaacaaacggaaacgtacggaaacgaccgggtaggtaccgtttagttttacggtttggtacgtaagaaacgttataaagggttattaacggtatagtaaccgttacccgttaagggttcgggtaaccggttctttacgtagttacggtcgggttaccgggaacgg

SEQ ID NO: 284309 - DNA, 751 bp, Homo sapiens
  misc_feature: GYAE6OF01A4IYB.14.57.F02.1.454.CMB.1.raw
  modified_base (200)..(200): a, c, t, g, unknown or other
  misc_feature (200)..(200): n is a, c, g, or t
  modified_base (296)..(296): a, c, t, g, unknown or other
  misc_feature (296)..(296): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacactagtctccactcaccctgtctttgtctccaggggaanagccacctctcctgcagggccagtcagagtgtcaacaccaacttagcctggttcagcagaacgcctggaccaggcctcccgaggcctcctcatgtntgatgccactcccacgacgggccaccggcactcccgagcccgtaggttccaggtcggcgtaggtccgggtcgtaggggactaggtaccctttccgaaccttcctaccgaaccctataccgacgtaccgacgtacccgttaaggtaccgttcgtaaggtaacgttacgttttacggtacgtttaacgttttaacgttacttacgtacgtacgtcgtacgggtaccggggttactaaaccgtttcgggaccgttaccgttaccggttaccggggttttacccggggggaccggggggttaacccgtaagggggttaccgggtaacggtttaaccggtaaaaccggttaacgttcgggttaccggtaccgttcgggtaacccgtaccgtaccgtttacccgttacggttccgtttaacccgttacctttaccccgtttccccggacccgtttacccgg

SEQ ID NO: 284310 - DNA, 805 bp, Homo sapiens
  misc_feature: GYAE6OF01DZVFZ.14.57.F02.1.454.CMB.1.raw
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
tcagcgtctagtaccacgaccggtgctcgatttagctcgatatagttgggtttgggctgagagaggagcccagtcctgggatcttcaggtgtttcatttggtgatcaggactgaacagagagaactcaccatggagtttgggctgagttggcttctttcttgtggtcttaattttaaaagatgtccagtggtgaggtgcagtctggttgggacggtccgggggagtcgttggtacgacgggtcccggggggtccctgaccnctctccgtgtnctacgcctgagtattcttagttttacgacgtaatgtgcctatggacgcgttcgggtcccgacgaggtccgtacggaaggggtaacgggcggtgggtaggtcgggtactacgagtacaagtcgtaggtttggttacgtaagggtacggtaacgtacgtacgttaccgtcccgggtaccttcccggtacgggttacgggtaaaccggggttcccggtttacctacccgtacttaccccgacgtaacgtaaaggtaacccctaaacgtttaaccgaaaacgtttacctaaccctttactttaacttttacccgtaataaacggtcggtaaaccgacggtacgtaaaccggaaagtaaccggaacgggtaacggtaaccgggtttggttaacctttttaagtttggggtaaactaaggtaaaagtaacgtacggtaaacgttctttaaacgtcgtaaacggtttaaacccggtaggggtttaccggggttaccgggtttactttaacggcggtttcggggacgggttaacccggggg

SEQ ID NO: 284311 - DNA, 727 bp, Homo sapiens
  misc_feature: GYAE6OF01A68ZV.14.57.F02.1.454.CMB.1.raw
  modified_base (206)..(206): a, c, t, g, unknown or other
  misc_feature (206)..(206): n is a, c, g, or t
  modified_base (699)..(699): a, c, t, g, unknown or other
  misc_feature (699)..(699): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaatttgtgttgacacagtctccactccaccctgttctttgtctccgaaggggaaancgcccacctctcctgcacgggccagtcagagtgtacaacacctaacttagccgttgttcagacagacgccgtggccaggcctacccgaggtcctcctacgagttcggtatcggtatcgacaccgtccccgaacggaccgggacccaaccggcctacccgtaccccgacgacccgtacggtttacgagggtcggccgtaagggtccggggttacgtaggggaacctacgtaccctttaccacccgttaccgtaccacccgtagtaccgacgaccgtacgtacccgtaaggtacttcgttaaggtaaagtttgttttaccggtacgttttaaacgtttttacttacgtacgttacgaacggttcggtaacgggaccggggttaacttacgggtccggtccttaccggttaccgtacggggttccggggggacggttaacgtagggtacgtaacgtacgaaacggtgttgacggctgacctacgtctaccggtttntaccttccgtaccttcctcccgtatacg

SEQ ID NO: 284312 - DNA, 756 bp, Homo sapiens
  misc_feature: GYAE6OF01B4CM9.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgctccaggggaancgccaccctctcctgcagggccagtcagagtgtcaacaccaacttagccttggttcagcagacgcctggccaggcctcccgaggcctcctcatgtatgatgccactcccacgacgggcccaccggcacctccccgagtcccgtaggttcagggtggaccgacgggtcggggtcgtaggggaaccacggtacctttaccaccttccgttaccacccagttaccacgaccgaacgtacccgtaaggtacgttactacggtaaaagtttcgtttttacggacgtttaaggtttttaactttacgtttcggttaccgaacggtacgtacggggtcggggtaaccttaacgggtttccgggacccgtccgtttacccgggttaccggggttttacccgggggggaacgggggggtaaaccccgtaaggggggttcggttaaaccggttaaccggtaaaccgggtaaaccggtttcgggtacgggtacctaccggacctacccgttacgttccgttacgtttccttaccttaccgtttccccgttacccccggctttaccgg

SEQ ID NO: 284313 - DNA, 723 bp, Homo sapiens
  misc_feature: GYAE6OF01ARTGA.14.57.F02.1.454.CMB.1.raw
  modified_base (199)..(199): a, c, t, g, unknown or other
  misc_feature (199)..(199): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccaagtcagagtgtacaaccacctaacgttacgccgttggttttacagtacgaagaacgcccgttggacccagggccctaccccggaggccttccgtaccaagtcggttaactggtagtcgtaccgactaccccgagtaccggggcccctaccggccaccgtccccgacgtaccgtacggttcgagggtacggtccgacggtcggggtcggtacgggaactagttaccgttaccgacctccgtaaccctaccctatccgaacggaccgtacggtaccgtaaggtacgtacgtaaggtaacgttaagtttcgtacgtttagttttaattacgttcgtacgtaagtccgtagggtgggactaggttcggtccgtcgttaccggtaccggtttaccggggaccgggggtaacgttacggggtacgtacggttaacgtaacgtacgttcggtagcggtacgcaccgtagtccgttcgttcttcgttacctccctccgtaccgttaccg

SEQ ID NO: 284314 - DNA, 724 bp, Homo sapiens
  misc_feature: GYAE6OF01ASXUR.14.57.F02.1.454.CMB.1.raw
  modified_base (319)..(319): a, c, t, g, unknown or other
  misc_feature (319)..(319): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctcgaggggaagagccaccctctctgcagggccagtcagagtcgtacaaccacctaacttacgtccttggtttacagtacgaagtaacgcccgtaggcccgacgggtccctacccgacggtcctaccctnacgttgtatggatcgcactcccgacgacgggccaccggcacgtcccgacgtaccgtacggttcaggtcgcggtacggtcgggtacgtacgggacacgtaccttctacgtcctaccgacctactccgacgtcaaccgtaccgtagtacggtcctaaggtaagtttagttttacggactttaagttttactacgttgtaccggaagtacggacgggtcgggtacttaacggttcgggcccgttacgttacccggttacgggggtttacccgggggacgggggtaaccgttaggggtaccggttaacggtaaaccgtaaacgggtacgtacgggttcggacgtacggtacctaacccgtgttaaccgttcgttcccgttactacccgtcccgttccccgcttaaccgg

SEQ ID NO: 284315 - DNA, 667 bp, Homo sapiens
  misc_feature: GYAE6OF01BG5XO.14.57.F02.1.454.CMB.1.raw
  modified_base (200)..(200): a, c, t, g, unknown or other
  misc_feature (200)..(200): n is a, c, g, or t
  modified_base (269)..(269): a, c, t, g, unknown or other
  misc_feature (269)..(269): n is a, c, g, or t
  modified_base (485)..(485): a, c, t, g, unknown or other
  misc_feature (485)..(485): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgagggaangccaccctctcctgccgagggccagtcagagtcgtacaacaccaacttacgccttggttcagcagaacncctggccaggcctcccgagctcctcatgtatagtatcgcctactcccgacgacgggcccaccggctaccgtccccgaggcccgtaaggttcgacggtcggacgacgggtcgggtccgtaggggactacgtacgttccaccttctaccactatccgagactacgcctaggtacgtctagtacgttaatttcgatttacgttatacgtatcgtaggcngggtacgggtactaggttcgggccgtacgttccgtacggggttaccggggaccggggtactaacggggttcgtaaccgggttactaaaaccggtgtcgggtacgtaccgtacgccgtaccccgagtttacccttcgggtaaccctttctacccgtttcccggttaccccgccgttaaccggg

SEQ ID NO: 284316 - DNA, 968 bp, Homo sapiens
  misc_feature: GYAE6OF01CKJWX.14.57.F02.1.454.CMB.1.raw
  modified_base (230)..(230): a, c, t, g, unknown or other
  misc_feature (230)..(230): n is a, c, g, or t
tcagcgtctagtaccacgaccggtgctcgatttagctcgatataggttgggtttgggggagaactgctcagttaggacccagagggaaccagtggaacgcccagctcagcttctcttcctctgactactcgtgctcccagactaccgaaccggagtaattgtagttcgaacactacgtacctccacttccgacccttgttctttacgaccgtaccggaagggtaaacgcnccctaaccccttcttccgacgacggacgggaccctagtaccgaaggtcggttctaaccaaaccgaaccgttaaacgtttacgtaccgttggtttacacggtacgaaacggaaccgcccggttagggaacccgacgggtacccttacccggaacgggtcccttacccttaaacgtcggttagttaacggttcgggaaaccttcggacctaaccgttacccccggaaccggacccggggtaacccgtaccccggaacgtaaccccgttaccccgtaacgggtaacccggttaacgggtttacccggaaagggtccggtaaccgggtacgggtacccgggggtttaacgttaggggaaaaccctttcggtaacccctttaccgtaccttaacccgaaccgtttaacccgcgttacgaacccggtactacggtacgtaacggttacggtaacttaaacgggtttagttttacgtttcggtaaaccgttttagtttaacgttcgggtactaacggtcggtaaacgggtccgggtaaggtttaccgtaccgggttcgaccccgttacgttaaccgggggttccggggttaaccgggggacccgggttaaacgggttacgggtaacggttaaacccgttacggaaaccggttcggtcgggtaacggtctaaccggttccaaacccgtttggttccccggttacttacccgttttaccggccctttttaacccgggccctttacgg

SEQ ID NO: 284317 - DNA, 619 bp, Homo sapiens
  misc_feature: GYAE6OF01E0A3L.14.57.F02.1.454.CMB.1.raw
  modified_base (578)..(578): a, c, t, g, unknown or other
  misc_feature (578)..(578): n is a, c, g, or t
tcagcgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggattttgcctggaaaaccagcctacacgcttaaaaccgggacaaccgtcgcccggccaacatagccttcctcccgtccccccttcgcacgtaacaccaagtacaggaatattaacctgttcccatcgactacgtccttcggcctcgccgttagggtcgacctcaccctgccccgtattaacgtggacaggaacccttggtctccggcgagcggtctttcaccgtctttatcgttacttatgtcagctattcgctacttctgactccctcagccatcgcctcacagccacaccttacactagaccttaacgaacgtaaccgtccctaaccccctaacccaaaccacgaacctaactaacggccgtccgccgtcgcccgacacgtacgtcgtcgctagttcgttaccgtcccctttcnccttcccttcccgacctacttctagacgtaacctggtaccg

SEQ ID NO: 284318 - DNA, 891 bp, Homo sapiens
  misc_feature: GYAE6OF01EDIW6.14.57.F02.1.454.CMB.1.raw
  modified_base (189)..(189): a, c, t, g, unknown or other
  misc_feature (189)..(189): n is a, c, g, or t
tcagcgtctagtaccacgaccggtgctcgatttagctcgatatagttgggtttggggctgagagaggagcccagtcctgggatcttcaggtgttttcatttggtgatcaggactgaacgagagagaactcaccagtggtagtttggctgtagttggtcttctttcttggtgtacttaagttttaaaagnttcgtccaggttgtggtaggtgcgagtcgttggttgggacgggtccgggggagtcgttacgggtacggacggggtcccgggggttacctagaccgtaccgttccgttccgttggtacggcctaacggccttacggaggttacttttaccgttaagtttttacgacggtaatacgtcgacctagttacggacggtaccggtccggggtacccgccggtacggtaccgttaaccggggaaggggggttaaccgggtccggtttaggggtaacgggtttcgggttaccctacggaacgtacgtaaggtaccggttaggggtttacgtttacggtaaaggggtacggttaaacggtccgtaacggttccgggacccgtcccggttacgtaccggggtacggtacgggtttcccctcgttacgaccttaccgccgaaagtacgtaaccttaacggtaaccgaaacgttaaccttcgttaacttttactttaaccgtaagtaacgtaccggactaacgtaacgtaaacggaaacgttaccggaacgtaccgggtaacgggttcgttagttttaaggttttacggaacggtaagtaaacgttctaaacgggttaagtcctaaaggttacgtaaacccggtttaaccggttagggtttacccggggtacgttttaccttccggtaagttccgggttagggtaacccgggg

SEQ ID NO: 284319 - DNA, 644 bp, Homo sapiens
  misc_feature: GYAE6OF01B4UJ4.14.57.F02.1.454.CMB.1.raw
  modified_base (266)..(266): a, c, t, g, unknown or other
  misc_feature (266)..(266): n is a, c, g, or t
  modified_base (321)..(321): a, c, t, g, unknown or other
  misc_feature (321)..(321): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (422)..(422): a, c, t, g, unknown or other
  misc_feature (422)..(422): n is a, c, g, or t
  modified_base (463)..(463): a, c, t, g, unknown or other
  misc_feature (463)..(463): n is a, c, g, or t
  modified_base (477)..(477): a, c, t, g, unknown or other
  misc_feature (477)..(477): n is a, c, g, or t
  modified_base (564)..(564): a, c, t, g, unknown or other
  misc_feature (564)..(564): n is a, c, g, or t
tcagcgtctagtaccacgaccggtgctcgatttagctcgatatagttgggtttgggctgagaaaggagcccagtcctgggatcttcaggttgttttctatttggtgatcaggacgtgaacagagagaactcacagtggtgttggctgagttggtctctttcgttgtgtacttaattaaaagatgtcagtgtaggaggtgcagtcgttggttaggcgggtccggggtagtcgttacggacggacgggtccccgggggttcaacgacnccgtcgtctggtacgcgacgtcctagagtattattagtttagacaatacgtgacntcggacgcgtcggcccacgaggctaccgggagggtacggcggtagggnggtaccggctagganacgtaagtcgtaaggttcgttagtaaggagtaaacgtntacggtccgtacgtccgtacgcggttaggacgttccgtacncctatactaccganacgtaatacgtaaccaagtaactacttacttcgtactaacaagtacgacgacacgtaagaagtacgaagtacgagtcgttaagtttntagtactagtaacgatgtaaacctgtactaaggtataccggtagttacgggtacgtatcggtaatcggagttcgggaacg

SEQ ID NO: 284320 - DNA, 708 bp, Homo sapiens
  misc_feature: GYAE6OF01ADBQC.14.57.F02.1.454.CMB.1.raw
  modified_base (477)..(477): a, c, t, g, unknown or other
  misc_feature (477)..(477): n is a, c, g, or t
  modified_base (502)..(502): a, c, t, g, unknown or other
  misc_feature (502)..(502): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (535)..(535): a, c, t, g, unknown or other
  misc_feature (535)..(535): n is a, c, g, or t
  modified_base (556)..(556): a, c, t, g, unknown or other
  misc_feature (556)..(556): n is a, c, g, or t
  modified_base (578)..(578): a, c, t, g, unknown or other
  misc_feature (578)..(578): n is a, c, g, or t
  modified_base (674)..(674): a, c, t, g, unknown or other
  misc_feature (674)..(674): n is a, c, g, or t
tcagcgtctagtaccacgaccggtgctcgatttagctcgatatagttgggtttgggtgcccaagctgctggagggcaccggtcaccacgctgctgagggagcttggtacaggccggggggtccctgaccactcctactgtcgcacgtcctcgaggtacttcttaagtttttagacgtaattagtcggacctaagtggacgtcggttacgggtcccgaccgacggtccgtaccgggagggggaacgggccgtaggggtaggttcgggttactacgacggtactaacgtcgtacgggttcggtttacctaagggtacggtaaacgtacgtacgttccggaccgtccgttcgtccggtagggaccgggttccccgttctcgtagtccctcggaagtacgactaacgttaccgaaagaccttacttacgtacttttacaacgaagtcgtacacgtacgtagaaacgtcgaagcggcggttnttgtttattgagtaagaatcggtanaagtntanagactactaggttggacgttctacngtgtcgacggcgaacggtcgngtcggtcctacgttctcgtacncgtacccaccgacgacgtcctcggttacgtccccttccgcgtccctacccgtcgacgaccgtccgacgttcggaccggcacgcggtccccggtacncgggtaccttcgtactaccgggtgacgtttaccc

SEQ ID NO: 284321 - DNA, 803 bp, Homo sapiens
  misc_feature: GYAE6OF01ACL59.14.57.F02.1.454.CMB.1.raw
  modified_base (303)..(303): a, c, t, g, unknown or other
  misc_feature (303)..(303): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcagggccagtcagagtgtacaacaccaacgttagcctggtttcagcagaacgcctggccaggcctcccgaggcctcctctatgtatnatcgcactcccgacgacgggcccaccggctactcccgacgccgacggttcgacggtcggaccgtacgggtccggggtacgtacggggaaccgtacggtaccctttaccgaccttcccgtacccaacccgtacgtaccgtacgcctaccggacccgttaaggaccgtttacgtaaggttaaacggtttacttttaccgggtacgtttaaacgttttttaacgttaccgtttaggtaccggtacggtaccgggtaacgggttccggggtaacctaacgggtttccgggccccgttacggttacccgggtttaaccgggggtttccggggggaaacccggggggttaacgttaacgggggttacgggtaacggttaacccggtaaacgggttaccggttgggtacccgggtacgttacccgggaaccttcccgttaacgtttacccggttcgttaccgttttaccgtaacccgtttcccccgttcccgtacccgttaacccgg

SEQ ID NO: 284322 - DNA, 786 bp, Homo sapiens
  misc_feature: GYAE6OF01A0UEQ.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggggaacgtgctcagttaggacccagagggaaccatggaagccccagctcagcttctcttcctcctgctactctggctcccagataccaccggagaaattggtgttgacacagtctccactcaccctgtctttgtctccgaggggaanagccaccctctcctgcagggccagtcagagtgtcaacaccgaacttagccttggtttcagtcagaacgcctggccagggcctccaggcctccgtcatgtactaggatgctactcccgagacgggccaccggcactccccgaggtcccaagggtttcaggtcggaccacgggtcgggttcgtaggggacctaaggtacctttccgaccgttcctacccgaacctacgtccgacgaccgacggtaccctaggtacgttcgtaggtaaacggttacgttttaggacgtttaaggtttttaaccgttacgttacggttaccgacggtaccggtacggggtaccggggtaccgttaaacgggttccgggtccccgttccgttaccccggttaacccgggtttttcccggggggacccgggggggttaaccctaacgggggttaccgggtaacggtttaaacccggtaaaacccgggttacggttaacgggttccgggtaccggttaccggaaccgtacccgtaacgggttcctttaccgtttaacggttccctaacctttccccggtttacccccggtccttaacgg

SEQ ID NO: 284323 - DNA, 647 bp, Homo sapiens
  misc_feature: GYAE6OF01DVK6S.14.57.F02.1.454.CMB.1.raw
  modified_base (198)..(198): a, c, t, g, unknown or other
  misc_feature (198)..(198): n is a, c, g, or t
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctccagataccaccggagaattgtgttgacacagtcctccactcaccctgttctttgctcgagggaanacgccaccctctcctgcgaggccagtcagagtgacaacacctaacttagccttggttcagcgagacgcctggcacggctcccgaggtcctcctnacgtgtactgatcgacactacccgaacgtacgggcccaccggcncctaccgacgccgtaggtacgaggtcggacgacggtcggggtcgtacgggacgtacgtaccttccgactacctccgaacataccagaccgacgtaccgtagtacgtagtagtaacggttatttcgacttagttttaactcgtacgtcgagtcgacgggtacggtactacggtccggcgtaccgttcggttacccgggtttacgggggaacccggggtacgttacgggggtagtaaccggttaacggtaacgtacggttgacggtctacgactcgtacgtgtaccgttcttacgtctcccgtccgtcgtacg

SEQ ID NO: 284324 - DNA, 810 bp, Homo sapiens
  misc_feature: GYAE6OF01ATP1Y.14.57.F02.1.454.CMB.1.raw
  modified_base (177)..(177): a, c, t, g, unknown or other
  misc_feature (177)..(177): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttctgtgtcttaatttaaagntgtccagtgtgaggtgcgagcgtggttggcggtccgggggagtcgttcggacgacggggcccgggggtcctgacctactccgtcctgtcgcacgtcctacgagtacttacgttacttttacgacgtaatagtcgactagtcggtacgtcggtcgggtccgaccgacggtccgtaccgggaagggggaacggtcggtagggtacgggttcgggtacctacgaacgtacgtaacgtccgtaggtttggttacgtaaggtaaggactaacgtaccggttaccggacccgtcccggtttacggtacccgggttacggtaaccggggttccccgtttaccgtccctacgttaccccgaccgtaacggtaacgttaaccctaaacccgttaaccgaaaacgttaacccgtacctttacgtttaaccttttacccgaaagtaacgttaccggtaacgtacggtaacctaagggaaacgtaaccgggaacggtaccgggtacgggttaaccgttttagtttaacgttttacggaaggttaacgtaaacggtacgtaaacgttagttacctaggttaacgtacgtaacccggttagggttacggggtacgtttacgttaggcgttacggtcgggtaccgggg

SEQ ID NO: 284325 - DNA, 686 bp, Homo sapiens
  misc_feature: GYAE6OF01AHZSY.14.57.F02.1.454.CMB.1.raw
  modified_base (377)..(377): a, c, t, g, unknown or other
  misc_feature (377)..(377): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaacttagccttggtttcagcagaacgcctggccagggcctcccgaggcctcctctatgtatgatcgcactcccacgacgggcccaccggccactccccgagccgtaggttcaggtcggcgaggccggggtacgnggggactacggtaccttccgactcctacccacctactcgacgcgaacgtcccgtaagtacggttacgtaggtaacgttattttacggtacttagttttaacttacgttacgttcgaggtcgacgggtcgggtactaggttcggcccgtacgttaccggtaccgggtttacgggggacccgggggtaacgtaacggggttaggtaccggttaacgaaaccggttacggtcgggtacggtccgtacggacctaccgtacgttaccgtttcgttcccgttacttacccgttccccgttccccgcgttaccgg

SEQ ID NO: 284326 - DNA, 705 bp, Homo sapiens
  misc_feature: GYAE6OF01B8ZGH.14.57.F02.1.454.CMB.1.raw
  modified_base (196)..(196): a, c, t, g, unknown or other
  misc_feature (196)..(196): n is a, c, g, or t
  modified_base (515)..(515): a, c, t, g, unknown or other
  misc_feature (515)..(515): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctccagataccacggagaaattgtgttgacacagtctccactcacctgtctttgtctcgagggaaanacgccacctctctgcgacgggccaggtcaggtagtcgtacaaacgacctaacgttacgccttaggtttccagcaagaacggccttcggaccgtaggcctccgaggcctctactaagtgtatcgtatcgacctacctcccgaacggaccggcccgtaaccggcaccgtacccgaacggccttacggtacgtacggcggacgacgggtccggttaggtacgggactaacgtccttacgaaccttcgcctacgactcagccgacgtactagtactcgtagtagttagtttcgactttagtttacttacgtactcgacgacgnggtacggtataacggttccgcgtttacgtaccgggttacggttccggggaaccgggtaagttacgggttacggtaacgttaaaccggaaacgttcgttagggtccgttcggtacgaacccgttcgttaccttacggtttacccgttaccgtttacttacccggtttcccgttacccgtagtttaacccgg

SEQ ID NO: 284327 - DNA, 698 bp, Homo sapiens
  misc_feature: GYAE6OF01CAWCT.14.57.F02.1.454.CMB.1.raw
  modified_base (176)..(176): a, c, t, g, unknown or other
  misc_feature (176)..(176): n is a, c, g, or t
  modified_base (604)..(604): a, c, t, g, unknown or other
  misc_feature (604)..(604): n is a, c, g, or t
  modified_base (610)..(610): a, c, t, g, unknown or other
  misc_feature (610)..(610): n is a, c, g, or t
  modified_base (650)..(650): a, c, t, g, unknown or other
  misc_feature (650)..(650): n is a, c, g, or t
  modified_base (663)..(663): a, c, t, g, unknown or other
  misc_feature (663)..(663): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttctgtggctatttaaaagntgtccagtgtgaggtgcagtctggttgggaggtccgggggagtcgttggtacgacggggtcccgggggggtccctaggaccctacgttcctcccgtggtcgaccgaacgtcccgtagtaacgggtatttaccgtaagttttttaacggaccgttaaatttacgcgacccgtaagtcggaacgtcggttccgggtcccgaccgtacggcctaccgggaggggtaaacgggcgtagggtacggttcgggtcgtacgtagacgtaagtcgtaaggttcgttaccgtaaggtacgggtaaacttacgtacgtttaacccgccggtacgttccgtaccgggtaggtaccgggttcccgtaactcccgtacgttcctacgtacgaacgtacgtaaccgtaaccaacgtaaactcttacttacttactacgtaancgtaancgactagaacgtagacgagtcggtattgttattgtagtanaagtcagatgtantactacgtagtggtacgttcatacgtgtggtacgg

SEQ ID NO: 284328 - DNA, 624 bp, Homo sapiens
  misc_feature: GYAE6OF01DUCJ2.14.57.F02.1.454.CMB.1.raw
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactccaccctgtctttgtctccaggggaaagagccaccctctcctgcagggccagtcagagtgtcaacaccaacttagccctggtttcagcagaagcctggccaggctcccaggcctccncatgtatcgatgcatcccagacggccaccggnactcccagccaggttcagtggcaggtcgggtctaggggactaggtcttacgactccgtacaccctatcacgacacgacctaagcgtacgtagtaagtattttgacgttaagtttacttactgttacagcgagggcgggtactaacgttcggccgtctcgtaaccgggtttcggggaccgggggtacgaggggttcggtaagttaaccgaaacggtaccgttaggtcggtacggttacggacctacccggtacttccgttacgttcccttacgttaccttaccccttcccggaccttaccgg

SEQ ID NO: 284329 - DNA, 734 bp, Homo sapiens
  misc_feature: GYAE6OF01DT6LI.14.57.F02.1.454.CMB.1.raw
  modified_base (255)..(255): a, c, t, g, unknown or other
  misc_feature (255)..(255): n is a, c, g, or t
  modified_base (570)..(570): a, c, t, g, unknown or other
  misc_feature (570)..(570): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggtcttaatttttaaaagatgtcagtgtgaggtgcagctggttggaggtccgggggagtcgttggtacgcgggccggggggtccctgacncctctccgtgtcgcacgcctagaaggtactttacttaagttttttaacggaccgttaaaattacttcggacctaagttcggacgtccgggttcgggtccccggaccggacgggtcccgtaccggggaggggggaacgggtccggtaggggtcgggttacgggtcctcgaacgtaccgtaagttcgaggttcggtttacgtaggtaggtaagtactacgttccggacgtcccgtcgtccgggtaggacgggttcccgttctccagttccaccgagtacgactaacttaccaaagtactacctttctatttcttaanaatcgacagtacaggaaacgacgaacgacggtacggtctttagtttagtttggtagaagtaaagtgtaacgtaacgttcgttaagttacgtaaaccgttaaccgttaggggtttacggggacgggttttacccttagtacggtttcggtccggggttaacgggg

SEQ ID NO: 284330 - DNA, 633 bp, Homo sapiens
  misc_feature: GYAE6OF01AKVMJ.14.57.F02.1.454.CMB.1.raw
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (586)..(586): a, c, t, g, unknown or other
  misc_feature (586)..(586): n is a, c, g, or t
  modified_base (624)..(624): a, c, t, g, unknown or other
  misc_feature (624)..(624): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctggttgggaggtccgggggaggcttggtacgagggtcccgggggggtcctgacactctcctgtgcagcctcgaggtattctattttagacgaatagtcgccagtgagccgtcggggtcccgccgagggtccgtaccggagggggaacggggcgtaggggtaggttcgggtctcgagacaatcgtaggttcggttactagggtaggtagtactagttccgacgtccgtactccggtaggaacgggtcccggttcacctatcctaccaaggaacacctaattaccaaacgtaacctacttacttagtttctaacaagttcgacacgtcctaagaaacgacgaacgacgtacgggtgttgttatttgagtanaagtanaacggtatctanacgtactactaggtttcgggacggttcttagcgttggnggtacgggg

SEQ ID NO: 284331 - DNA, 754 bp, Homo sapiens
  misc_feature: GYAE6OF01CY8I3.14.57.F02.1.454.CMB.1.raw
  modified_base (148)..(148): a, c, t, g, unknown or other
  misc_feature (148)..(148): n is a, c, g, or t
  modified_base (182)..(182): a, c, t, g, unknown or other
  misc_feature (182)..(182): n is a, c, g, or t
  modified_base (206)..(206): a, c, t, g, unknown or other
  misc_feature (206)..(206): n is a, c, g, or t
  modified_base (275)..(275): a, c, t, g, unknown or other
  misc_feature (275)..(275): n is a, c, g, or t
  modified_base (722)..(722): a, c, t, g, unknown or other
  misc_feature (722)..(722): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctccagataccaccgganaaattgtgttgacacagtcctccactcacccttnttctttatcctcggaaggggaaancgccctaccctctcctaggcgacgggcacgtcgagagtcacaacacctaattcggccttggttacacgngtaagaacgtccgtcggacctacggtcctacccgacggtccttaacctgtaacgttggttatacgtacgttcgacctaaccgtacccgaacggaccggggaccccgtaaccgggcctaaaccccgttccccgaacggtcccgggttaacggttaccgggtaacgggtccgggaacggttaccggggccggggtttacggaacggggacccttaaacggtccctttaccgtacccgtaccctacgtaactaccgtagaccggttacacccgggtacgtaacgttacgtacgtttacgtagtttctttaagccgtttaagtttactcgtagtacccgagtcggacgggtaccgtataccgttggcctacgttaccggttggtaccggggacggttagtacgggtctaaacgggtacaaacggtgtacgtagccgtacgatacccggttntccttcgttcctacgtcccttccgtctacgtc

SEQ ID NO: 284332 - DNA, 721 bp, Homo sapiens
  misc_feature: GYAE6OF01BE6TZ.14.57.F02.1.454.CMB.1.raw
  modified_base (314)..(314): a, c, t, g, unknown or other
  misc_feature (314)..(314): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgttctttgtctccaggggaaagcgccaccctctcctgcgaggccagtcagagtcgtcaacaccaacttacgccttggtttcagcagacgccgtggccgacggcctaccacggcctcctctacgtggtaatgtanacgcctactacccgacggaccgggcccaccggcaccgtccccaacgccgtaaggttcacggttcggcgtaggccggggtcgtcggggactacggaccttccgaacgtccttaccaacctacgtaccgacgtacacgtaccgtaaggacgtttacgacggtttaaacgttagtttttacgacgtttaacgtttttacgtttacgttacgttaccgtacgacggtacgggcgggtacctaacgggttccggtccgtaccgttcgtaaccggggtttccggggaccgggggttaacgtacgggttacggtacggttaaccgaaaccgtacgttaggtcggtcgtcggtaccgtacccgttagtacgtttcgttcccttcttacccgtttcccgttaccccgtgtaacccg

SEQ ID NO: 284333 - DNA, 838 bp, Homo sapiens
  misc_feature: GYAE6OF01AME74.14.57.F02.1.454.CMB.1.raw
  modified_base (207)..(207): a, c, t, g, unknown or other
  misc_feature (207)..(207): n is a, c, g, or t
  modified_base (421)..(421): a, c, t, g, unknown or other
  misc_feature (421)..(421): n is a, c, g, or t
tcagcgtctagtaccacgaccggtgctcgatttagctcgatatagttgggtttggggagggaactgctcagttaggacccagagggaaccatggaagccccagctcagcttctcttcctcctgctactctggctcccagataccaccggagaaattgtgttgacacagtcctccactccaccctgtctttgtcctccgaggggaaanacgcccaccctctcctgcgacgggccagtcagagtgtacaaccacctaacttagccttggttcacgtacaagacgcccgtcggaccacggccctcccggaggtcccttacccgtctaagttgtaacgtcgagtaccgctacctaccccgacggacgggaccccgaaccggtccacctaccccgacgtcccggtaggttccgacggtcgggaccnggggtaccgggtcgtagggaacctacggtccttacgacctcctaacccgaacctacgtaccgtaacgcccgaacgttccgtaacggttcgttaccggtaagggttaaatttaccggttttacgtaaccggttttaagtttttaaccgttccggtacggttacccggtaaggacccgggtacgggggtaccgggtaacgtttaacgtccgggggtacccttaccgggttacccgggtttaccgggggtttacccgggggggaaccgggggtaacccttagggggttaacccggtaacgttaaccccggtaaacggggtagggttcgggttaaaccggggtctacccggtaaccctaccggttaacgtttccgtttaccgttaccgttacttaccccggttccccctcggttaacccgg

SEQ ID NO: 284334 - DNA, 828 bp, Homo sapiens
  misc_feature: GYAE6OF01ADGVU.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctctgctactctggctcccagactaccgaccggagaattgtgttgacacagtctccactcaccctgtctttgctccgaggggaactcgccctaccctctccgtgcgagggccagtcaggagttcgtacaacctaccaactttacgccgtttggtttaccagacgaacggtaacgcccgttagggacccaagggtcccttaccccgaagggtccttacccgtcaagtttcggtaacttcggaacttcggaccctacgttacccccgaaggacggggtaccccaacccgggtctaaccgttccccgaagggtccccgtaagggtttcacgggttcgggacctacggggtccgggggttctacggggaaccttacgggtacctttcgaaccgttccttacgaaacccgtggttaccgaacgggcctacggtaccgtaaggtaccgttaccgttaaggtaaacgtttcgtttacggaacgttttaacggtttaaccgtttacgtacggtaacgtacgggtacgtaggggtaccggtaccgttaacggttcgggacccgttcgtaccggttacgggttccggggaacgggggttaccctaagggtacgggttaccgttaaccggtaaaccgtacggttggttaaccgggtccggtacgtaccgtaccggttacttcggttaccttaccggtacccttacgttccccgtccggtaccc

SEQ ID NO: 284335 - DNA, 706 bp, Homo sapiens
  misc_feature: GYAE6OF01CXFFQ.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttgggggggaactgctcagttaggacccagagggaaccatggaagcccagctcagcttctcttcctcctgctactctggctcccagataccacggataattgtgttgacacagtctccactcaccctgtctttgtctccgaggggaaacngcccaccctctcccgcgacgggccagtccagagtcgtacaacaccaacgttagccgtggtttcagacagtaacgtcctcggaccgaggcctcccaggcctccctacagttcgtatgtacgtcgaccgtacctacccgacggaccggtcccgacccgcctacgtcccgaacgtccgtaacggttcgaacgtcgggacacggtcggttacgagggtaccagtaccgttacacctcgtacccactactacgacgtcgaacgtctaaacgggtactccgtaaggttaacttagtttacgtactttaacggtttttactacgtcggtaacgtacgaccggttaaggggacccgttagaccgtttcgggcccgttacgtcgttacccggggttggggaccgggtaccgttagggtccgggtaattaaccggaagtacggtcgtacggtcctacgaccgtactagtttccgacgttccctttacaccgtttccccgcgtacttaccggtacg

SEQ ID NO: 284336 - DNA, 952 bp, Homo sapiens
  misc_feature: GYAE6OF01D7FFO.14.57.F02.1.454.CMB.1.raw
  modified_base (183)..(183): a, c, t, g, unknown or other
  misc_feature (183)..(183): n is a, c, g, or t
tcagcgtctagtaccacgaccggtgctcgatttagctcgatatagttgggtttgggctgagagaggagcccagtcctgggatcttcaggtgttttacatttggtgatcaggactgaacagagagaactcaccatggtagtttgggctgagttggcttctttcttgtggcttaattttaaaagntgtacagtgtgagtgcagctagtggaggtccggggagtcgttaggtacgacgggcccggggggtcctagactctccgtcctgtacgacacgccgtacgaaggtatttacttagttttttacggaccgtaaattagtcgacctagtaggtacggtccggttaccggggtcccgaccggacgggtcccgtaaccgggaaggggggaacggggtcgtaggggtacggttggggtactacggacgaacgtaacgtccgtagggtttcggtttaccggttaggtacgggtaaacgttacgtacgtttaccgggaacccgtcccggtaccggttaccggtacggggtaaaccggggtttccccgtttaccgtaccctaacgtcccgttaacccggaagggtaacctaaaccgttaaacccgttaaccgtaaaaaccggtaaacccttaccccttttacgttttaaaccttttttacccgtaaaacgtaacgttaacccgggaaaccgtttaccggtaaccccgttaaaagggaaacccggaaaccgggtaaaccggtaaccggggtacccggggtttaaccggtttttaaggttttaacgttttttaggggtaacgttaaaacggttaaaaggtaacgttaaaccgggtttaaacgttacccgttaaggttaccggttaaacccgttaaacccggtttaaggggtttacgggggttacccggggtttacccctttaggtaaccggtttggggtcccgggttaaaccccggggggg

SEQ ID NO: 284337 - DNA, 696 bp, Homo sapiens
  misc_feature: GYAE6OF01ABYU9.14.57.F02.1.454.CMB.1.raw
  modified_base (111)..(111): a, c, t, g, unknown or other
  misc_feature (111)..(111): n is a, c, g, or t
  modified_base (200)..(200): a, c, t, g, unknown or other
  misc_feature (200)..(200): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (476)..(476): a, c, t, g, unknown or other
  misc_feature (476)..(476): n is a, c, g, or t
tcagcgtctagtaccacgaccggtgctcgatttagctcgatatagttgggtttggggggaacgtgctcagttaggacccagagggaaccatggaagcccagctcagcttcncttcctcctgctactctggctccagactaccaccggagaaattgtgtgacacagtctccactcacccgtgtctttgtctcgaggggaangccacctctcctggcacgggccagtcagagtgtacaacacctaacgttcgccgttggtttcagcagacgctaggccagggtcctacccaggtcctcctactatggttacngatcgctaactcccgacgaggggccctaccggctaacgtccccaggccctagggttcaggtccgcgacggtcggggttcngggggaccaggtacccttcaacgtccttacgacctagtcgagccaagcctagacgtcgtagacgttatttcggacttaaggttttntaacgttgttacgacggtactaacgggtcggggtaacctaaggtttcgggccctaccgtaccggttaacccgggtttcggggggaacccggggtaaccgtaagggttacccgggtaacgtttaacgaaccccgggtaaagttcgggtacggtaaccgtggacctaaccgccgtttaagtccgttcccgttaacgtacttcccgttaacccgcgttaaccg

SEQ ID NO: 284338 - DNA, 794 bp, Homo sapiens
  misc_feature: GYAE6OF01C42HI.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgttctttgtctccgaggggaaagacgcccaccctctcctgcgacgggccagtcagagtgaccaaccacctaacttacgccgttggtttcagcaagaagccgtggccacggcctacccgacggcctaccgtcactagtagtcagtcgacctactcccgaacggacgggacccgacccgggacacctacccgacgaccgtagggttacacggtaggaccgagggtccgggttacggtacggggaacctacgttaccgtttacacctttccacccgaactactacgacgaccgtacggtacctaaggtaccgttaacgtaacggtaagtttacgttttagaaccgttttaagtttttaccgtacttacggtaccgtacgtaccggtacgggtaccgggaaccttacgggtttccggacccggttaccggttaaccggtacccggggtttacggggggacccggggttaaacttaaggggggtacgtaaaggttaaaacccgtaacgggaacggttcggtaacgggtcctaaccggaaccgtacccgttactttcccgggtacgtttacccgtttacccgttacccgttttccccggaactttaccggttaaaccgg

SEQ ID NO: 284339 - DNA, 708 bp, Homo sapiens
  misc_feature: GYAE6OF01D2E5Y.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttaattttaaaagatgtccagtgtgaggtgcagctgttggaggtccgggggaggtcttggtacgacgggcccgggggggtccctgacacctctcctgtgcacgcctcgaggtattactatttttagacgtaatatgacctagtgagtcgtcgggtcccgccgacggtccgtaccggaagggggaacggggcgtagggaggttgggtcctcgagacaagtcgtaggttggttacgtaggtaggtaagtacgacgtttaccggaccgtcccgtccgtccggtaggtaaccggggtcccgtttactccctacgtccgtaccgaagaacgtaacctaaacttaccgaaacgtaacctacttactttactttctaactaaagtcggacagtaccgtaagaaacgaacgaacgaccgtacgggtcgttagtttagttttggtagtaagaaagtacgtaaggtaacgttacttagtacgtaaccgttaacccgttaagggtttacggggtacgggttaccctttagacgttcgggtcggtaccggggg

SEQ ID NO: 284340 - DNA, 795 bp, Homo sapiens
  misc_feature: GYAE6OF01ED4AO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacgaggcccgggggggtccctagaccactctcctgtgcagcctcaggattctatttttagacgtaatatgccatggacgcgttcgggtcccgccgaggtccgtaccggaagggggacgggggccgttaggggacggttggggttcctcgaagcgtaaacgtccgtaaggttcggtttacgtaaggttagggtaaacgttaccgtaacgttttcccggaaccggtccccggtttaccgtaccgggttacgggtaaaccggggttccccggtttaccgtaccctacgttcccgtacccgaaggtaacgtaaacctaaacgttaacccgaaaacgtacctaacctttcttaacttttacttaacctaaagtcggaactacggtacctaaggaaacggtaaccggaagaccggtacgggtacgtttagtttacgtttttaggagttaagaaaacgttagtaaacggaacgttacttaagttacgtaaaccttaaccccggttaaaagggttttcgggggaaaccggggttttaccctttacgtaacggtttaggtcccgggttaacccgggggg

SEQ ID NO: 284341 - DNA, 649 bp, Homo sapiens
  misc_feature: GYAE6OF01DTTQQ.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaanacgccaccctctcctgcacgggccagtcagagtcgtacaacaccaacttacgccttgggtttcagcaagaagccctggcccaggcctccccgaggcctcctcatgtatggatgcactcccagacgggccaccggcactcccagcccaaggttcaggtcggcacgggcgggtactcggggacaggtaccttcgactctcaccatcagcacgcctagacgtctagtagttatttgtctagttttattatcgtcagtcgagggcgggtatacgttcggcccgtacgttaccgtacgggtttccggggacgggggtaaccgtaggggttacggtaacggttaaccgaaaaccggtacgttacgggtacggaccgttacgggtaccctaacccgttacgttaccgtttccggtttacctttaccgttaccctttcccgttcccccggtaaccg

SEQ ID NO: 284342 - DNA, 766 bp, Homo sapiens
  misc_feature: GYAE6OF01A3K2O.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgttctttgtctccgaggggaaagagcccaccctctcctgcgagggccagtcaggagtgtacaacaccaacttacgccgttggttcacgcaaggacgcctcggccaggcctcccgaggcctccgtcaagtgtatgatgctactcccaggacggcccaccggccacctcccgacgccgtaggttccgaggtcggcgtacgggccgggtacgtacggggaactacggtacttccaccgtcctaccaccctaatccgacggtacgtacgtaccgttaacggtacgttaccgtaaggtaacgtttattttacggaccttttaaaggttttactttaacgtcgtaccgtaggtacggtacgggtcgggtaacgtaacgggttcggccccgttaccgttaccggttacccggggtttaaccggggggaccgggggggttaaccgttaacgggggttaacgggttaaccggttaaccggaaaccgggttacggtacgggttacggtccggttaccggacccgtaaccggtactttccgtttaccggttacccgttaccttacccggtttccccgttcccggtccgtttaacccg

SEQ ID NO: 284343 - DNA, 814 bp, Homo sapiens
  misc_feature: GYAE6OF01ECX0H.14.57.F02.1.454.CMB.1.raw
  modified_base (194)..(194): a, c, t, g, unknown or other
  misc_feature (194)..(194): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggctattttaaaagatgtccagtgtgaggtncagctggttggacggtccgggggagtcgttaggtacgacgggcccggggggttccctgacctactcctccgtgtcgcgacgcctcgaggtactttacgttactttttacgacgtaattagttcgacctagtcggaggtccggttaccggggtcccgccggacggtccgtacccgggaagggggtaacggggtacgtggggtacggttcggggtacctacgacgactacgttcgtaggttggtttacgtaagggtaggtaaactacgtacgttaccggaccgtcccgtaccgttaccggtacgggtaaccgggttccccggttcctacccgtacgtacccgttaccgaaggtaacaaccgtaaacgttaacccgaaacgtaaccgtaccttacctttacgttttacctaacgtaaacgtcggtaacctacggtacccgtaaggaaaccgaaccgaacggaacccggtacgggttaccgtttaggttttaacgttttacggagttaaaggaaacgttaaggtaaacccgttaaggttcctaaggtacgtaaaccgttacccgttaagggtttaccggggtaccgggttacctttaagacggttcgggtcggtaacccggggg

SEQ ID NO: 284344 - DNA, 891 bp, Homo sapiens
  misc_feature: GYAE6OF01B1WQM.14.57.F02.1.454.CMB.1.raw
  modified_base (270)..(270): a, c, t, g, unknown or other
  misc_feature (270)..(270): n is a, c, g, or t
tcagcgtctagtaccccacgaccggtgctcgatttagctcgatatagttgggtttggggctgagagaggagcccagtccctgggatcttcaggtgttttcatttggtgatcaggactgaacagagagaactcaccatggagtttgggctgagttggcttctttcttgtggctatttaaaagatgtccagtgtgagtgcagctgtggaggtccgggggaggcttggtacgacggcccggggggtccctgaccactcctcctgtgcagcctnaggtattctattttacgcgtaatatcgccagtgagtcgtcgggttccgccgtacggtccgtaccggaagggggtaacgggggtccgtaggggtagggttcgggggttacctacggacggtaccgtaaacgttaccggtaagggtttcggtttaccgttaagggttacgggtaaacgttaacgtaacggtttcccggtaaccggtccccggttacccgtacccggggttacgggtaaccggggttccccggttttaccgtcccgtaaccgttcccgttacccgaacgggtaaccggtaccttaaactttacccgaaaacggtaaacctaaccctttaccgtttacgttttacccgtttacgtaaaaggttcccggaaacgtacggaacccgttaagggaaaacccgaaacgggtaaaccggaaccggtaaccgggggttaccgtttacggttttaacggttttttagtaacgggtttaacggaaaaagttacccgttaaacggtaacggttaccgttaagtttaaccggtaaacccgtttaaacccgtaacggggtttttacggggaacccggggttttaccctttacggtaacggttttcggtacccgggtttaacggggg

SEQ ID NO: 284345 - DNA, 785 bp, Homo sapiens
  misc_feature: GYAE6OF01CK3X3.14.57.F02.1.454.CMB.1.raw
  modified_base (185)..(185): a, c, t, g, unknown or other
  misc_feature (185)..(185): n is a, c, g, or t
  modified_base (201)..(201): a, c, t, g, unknown or other
  misc_feature (201)..(201): n is a, c, g, or t
  modified_base (660)..(660): a, c, t, g, unknown or other
  misc_feature (660)..(660): n is a, c, g, or t
  modified_base (670)..(670): a, c, t, g, unknown or other
  misc_feature (670)..(670): n is a, c, g, or t
tcagcgtctagtaccacgaccggtgctcgatttagctcgatatagttgggtttgggctgagagaggagcccagtcctgggatcttcaggttgttttcatttggtgatcaggactgaacagagagaactcacagtggaggtttggctgtgttggtcttctttcttggtgacttaaagtttaaaagntgtcagtgtgaggtgngagtcgttggttgggacggtccggggagtcgttcggtacgacggggtcccgggggtcctagtaccaccgttctccgtagtcgcgacgccgtacgtagtattacgtttaagttttacggaactaagttactacgtccgtaggtcggtacggtcggttcccgggtcccggaccggtaccgggtcccggtaaaccggggaaggggtaaccgggggtcgtaagggggttacggttccggtaccgtaacggagtaaccgtaagtcgttaggtttcggttacgtaaggtacgtaacgtagtcgtccggtacgtaccgtcggttacggacggtaccgggttccgttaccctacgtactacgtacgaacgacgtaactaaacgtaccgtaaactaactccgttactttagttactaacgtaagacgtaccagtaaccgaagaaacgtaaccgaagtacggtcggttntttaaggttntttaggaagttaagaagtaccgttagaacgtttacgtaaagtacgtaacggtaaccggttagggttaacgggttccgttaactttaccggtaggtcccggttggggtaacccggg

SEQ ID NO: 284346 - DNA, 922 bp, Homo sapiens
  misc_feature: GYAE6OF01ETDVP.14.57.F02.1.454.CMB.1.raw
  modified_base (172)..(172): a, c, t, g, unknown or other
  misc_feature (172)..(172): n is a, c, g, or t
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
tcagcgtctagtaccacgaccggtgctcgatttagctcgatatagttgggtttggggggaactcgctcagttaggacccagagggaaccatggaagccccagctcagcttctcttcctcctgctactctggctcccagactaccaccggagaaatttgtgttgacacagtcnccactcaccctgttctttgtctccgaggggaaagngcccaccctctcctgacagggccagtcagagtcgtacaaccaccaattacgtccttggttcagtccagaacgcctggcctaggcctcccgaggcctcctnacgttgtactgaacgtggactactacccgacgacgggtcccaacccggtcaccgtcccaacgtcctaaggttccgacggtcgggaccacgggtcggggttacgtcggggaacctacggtaccctttacgcctttcgaacccaaccgtagttacccacgtcctaacgcccgttaagtccgttacgtaagggtaaacgtttcgtttacgtacgttaacgggtttttaacttaccgttacggttaccgaagggtacccggtaacggggttaacccgggggtaccttaaacggtttacccgggggtccccttaacccggtttaccggttaaccccgggggtttttacccgggggggaaccccgggggggtttaaaaccttaacgggggggttacccggtttaaaaccgggggtttaaacccctaaaaaacccggggtttaccggggtttaaacgggtttacccggggtaaaccccgttttagggaaaccccccgttaaaaccccggtttaaggttaacccccggttttaaaccgttccccggttttttaaaccgggtaacccccccttttttaccccgggttaaacccccccggttaaccccggtttttaaaccccggg

SEQ ID NO: 284347 - DNA, 832 bp, Homo sapiens
  misc_feature: GYAE6OF01AG0C7.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcacctgtctttgtctccgaaggggaancgcctaccctctcctgcgagggaccagtcagagtcgtaccaacaacctaacttagccttggttcagcaagaacgccgtggcccgaggtccctacccgacggccttcctcagttgtatcgagtccgacctaccgtacccgacggaccggggcccaacccggtactaaccgtccccgaggtacccgtaagggtttaccagggttcggaccgtacgggtccggggttacggtacggggaacctaacggttacccttacgaccttacctaccaacctcgtaccacgtaccgtacgtaccgttaagggtacgtttacgtaagggtaacgttttacgttttaccgggtacttttaacggtttttaacgtaccgtttacggtaccgtaaggtaccggacgggggttaaccggtacgtaaccgggtttcccggtacccggttacgttaccggggtttacccggggttaccgggggggtaccgggggtaaacggttaacggggttacggtaaaccgggtttaaccgaacgggttaaacggttcgggttaaccgtacggttacgaacccgttaccggttacgttcccgttacggtttacccttcccgttaccgtttacccggtttaccccgctttaaccgg

SEQ ID NO: 284348 - DNA, 841 bp, Homo sapiens
  misc_feature: GYAE6OF01AQEW3.14.57.F02.1.454.CMB.1.raw
  modified_base (202)..(202): a, c, t, g, unknown or other
  misc_feature (202)..(202): n is a, c, g, or t
  modified_base (277)..(277): a, c, t, g, unknown or other
  misc_feature (277)..(277): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtcttgtctccgaggggaangccaccctctcctgcagggccagtcagagtgtacaacaccaacttagcctggtttcagcagagcctggccaggcnccgaggtcctcctacatgtatgatgcactaccccgacgacgggcccaccgggccacgtccccgaggtcccgtaggtttccgaaggttcggaccgtagggtccggggtcgtacggggacacggtacctttcgaccttccgtacccgaaccacgttaccgacgtaccgacggtacccgtaacggacggttacgttaacggtaagtttaacggtttttacgtaccgtttaaacgtttttaacttttaacggttacggttacgaacgggtaaccggtaccgggggttacgggggtaaccgttaacgggtttccggggacccggttaccggttacccgggtttaacccggggttttcccgggggggtaaccccgggggggggttaacccggttaaacggggggttacggggttaaacccgggtttaaacccggtaaaaaccggttaaccggttacgggttacgggtacccgttaacgggtacccgtaaccccgttaacggttacccggttttacggtttaccccgttttaccgttaacccgtttcccccgtttccccgggtaacccccg

SEQ ID NO: 284349 - DNA, 864 bp, Homo sapiens
  misc_feature: GYAE6OF01AXRXQ.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactccaccctgttctttgtctcgaggggaaagngcccaccctctcctgcgacgggccagtcagagtcgtacaaaccaccaacgttacgccttggttacagacaaggaacgccgtcgggaccacgggcctacccgacggtccttaccctacgtaagttggtaattacggaagttccgacctaaccgtacccccggaaccggaccggggaccccgacccgggacctacccgtaccccgaacggtccccggttaggtttccgagggtcggaccggtacggggtccggggttacggtacggggtaactaccggttaccttaccgtacccttaccttacccaacccgtaacgttacccggaacgaccccgtaacggtacccgtaaggttacggttacgttaaggttaacgtttacgtttacgtacgtttaaaggttttaccttaggtcggtacgaacggtacggtacgggacgggttactaacggttccggtacccgttccgttaaccgggttaccggggtttaccgggggggaacccggggttaacggacgggggtttaccgggtaaaccgttaaacccggggtaaaacggttaaccgggttcggggtccgtaaccggtacccggtaccttaaccgttaccggtttacggttacctttcgtaaacccctttaccggttcccccgttccgtaacccg

SEQ ID NO: 284350 - DNA, 670 bp, Homo sapiens
  misc_feature: GYAE6OF01ALXH2.14.57.F02.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (318)..(318): a, c, t, g, unknown or other
  misc_feature (318)..(318): n is a, c, g, or t
  modified_base (363)..(363): a, c, t, g, unknown or other
  misc_feature (363)..(363): n is a, c, g, or t
  modified_base (437)..(437): a, c, t, g, unknown or other
  misc_feature (437)..(437): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtcnccgagggtaancgccaccctctcctgaccgacgggccagtcagtacgtcgtacaaccacctaacttacgccgttaggtttcagcagaacgccgtcggaccaggccctccgaggcctacctcgtatacgnttcgactcgacgacctacccgacgaccggggtaccaccggtaccncgtacccgcggtaccgtaacggtcgaggtcgacgtacggtcggtacggttacggcgtacgtacctccgtactcncgactacgtcgacgtcaccgtcagtacgtcgtaagtacgtacgttttcgacgtttaactttaacgttcgtacgggtacctacgggacgtaccgggtcgtacgttaccgtttccggaccgttacgttcggtaacccgggttcggggaacgggttacgtagggttcaccgtaacggagtacgtcgtacggctgactcgtcgtcgttacgtccttagcctttccgtacccggtaac

SEQ ID NO: 284351 - DNA, 727 bp, Homo sapiens
  misc_feature: GYAE6OF01CBA5U.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggaggtccgggggagcgttggtacgaggccgggggggtccctggacacctctcctgtcgcacgcctacgaggtacttacttatttttacgacgtaaatatgacctaatgacgtcgtcggggtcccgcgacggcctaccggaagggggacgggcgtgggaggtggtctgagctaagtcgaaggttggttcgtaggtaggaagtactacgttccgaccgtccgttctacccggtagggaaccggggttcccggttacctaccgtacttcctaccgaaggaccgtaacctaacgttacccgaaaacgtaacctacctttaccttaacttttaccttaacaaagttacggaactaacgaccgtaagaaaacgaacggtaaaccggaacggtacggggtacgtttagtttagttttcggaggttaagaaagtacgtaaacggtaagttacgtattaggaacctttaaccggtaaaggttttgggggaaccggtttcctttaggacgttcgggttcgggtaaccggggg

SEQ ID NO: 284352 - DNA, 948 bp, Homo sapiens
  misc_feature: GYAE6OF01BO4PB.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactagaacagagacgaactcaccagtggtaggtttgggctgagttggcttctttcttgtggtacttaatttaaaagatgtccagtgtggaggtgcagcgttggttgggacgggtccgggggaggtcgttaggtaaccggccggggtccccgggggggtccctaggacctacctccgtccgtggtcgacgtaccgtccgtacgtaacggttactttacctttaaagttttacggaaccgttaaagttacgtacggaccctaagtacggtaccggtccgggttaccggggtccccgaaccggacggtccggtaaccgggaaggggaacggggtcgtaagggtacggtacgggtcctaccgagacgtaacgtacgtacgggttgtttacggtaagggtacggtaaccgtacgtacggtcccggtaccgtcccgttacgtaccgggtaaccggggtaaccgggtcccgttacctcccgttagtcccgtacggaacggtactaacccgtaaaacttaacccggaaagttaccctaacgtttacgtttaaccgtttaactaaaccggtaaagttccgggaactaaaccggttaaccgtaaaggaaaacccgggtaaaccgtaaccggggtaaccgtaaccgggggtttatttaagggttttaaccgtttacgggttttaaggtaacgggtaaaaacgggtaaacgttaaaccgtttaaacgggactttaaccggttaaacgttaaccggtaaaaccccggtttaacccgggtttaggggtttacccggggggaaccgttttttcccgtaaacggttccggggtttaccggaaaccccgggggg

SEQ ID NO: 284353 - DNA, 814 bp, Homo sapiens
  misc_feature: GYAE6OF01BZZK7.14.57.F02.1.454.CMB.1.raw
  modified_base (341)..(341): a, c, t, g, unknown or other
  misc_feature (341)..(341): n is a, c, g, or t
tcagcgtctagtaccacgaccggtgctcgatttagctcgatatagttggggtttggggggaactgctcagttaggacccagagggaaccatggaagccccagctcagcttctcttcctcctgctactctggctcccagataccaccggagaaattgtgttgacacagtctccactccacctgttctttgtccgtccgaagggggaaagacgcccaccctctcctgcgacgggccagtacaggagtcgtacaacaacctaacttacgtccgttggtttacacgacaacgaacggccgtcggaccgacggccctccgacggtcctcctctagttgtatgtacncgccacctacccgacggacccggggacccgacccggactaccgtccccgacggtaccgtacggttacgacggtacgggcgtacgggtcggggtcgtacggggactacggtaccgttcaccgttacctaccaacctactacgaccgactaccgtcgtaacgtacggtacgtaggtaacgtttacgtttcgtacgtttaacgtttttaactttacgttacgtaccgtagggtaccgggtacgggtaccggggttagttaacgggtttccgggacccgtttccggtaccggtttaaccggggggtttcccggggggaacgggggttaacccggtacggggttacgggttaaccgggttaacgggtaaaccggttaccgggttggggtaccgaccggtttacggaccgttacccgttagttacccgtttacggttcccttaccgttaccgttacccccgtttacccgccgtttaacg

SEQ ID NO: 284354 - DNA, 559 bp, Homo sapiens
  misc_feature: GYAE6OF01DMIV8.14.57.F02.1.454.CMB.1.raw
  modified_base (197)..(197): a, c, t, g, unknown or other
  misc_feature (197)..(197): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcacctgtctttgctcagggaangccacctctctgcagggccagtcagagtgacaacaccaacttagccttggttcagcagaacgcctggccaggcctacccgaggcctcctcgatgtatgatcgactactccccagacgggcccaccggtcacgtcccagccaggttcaggtcgcaggcgggtcncgggactagacttcactctacaccatcagcagcctagagtctagagttntttagacgtagtttatacgtgtacagtcgaacgggtcgggatacgttccggcctacgttcgtacggttcggggacggggtacctagggtcggacgttacgaaacgtacgtggtgctgccactgtcttcgtctactactccgttccgtaac

SEQ ID NO: 284355 - DNA, 631 bp, Homo sapiens
  misc_feature: GYAE6OF01DX0SA.14.57.F02.1.454.CMB.1.raw
  modified_base (585)..(585): a, c, t, g, unknown or other
  misc_feature (585)..(585): n is a, c, g, or t
  modified_base (627)..(627): a, c, t, g, unknown or other
  misc_feature (627)..(627): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactccaccctgttctttgtctccgaggggaaagacgcccaccctctcctgcagggccagtcagagtgtaccaacacctaacttacgccgttggtttcagcagaacgccgtggccacggcctcccgaggtcctacctctatcgtatgatcgccactacccgacggaccgggacccaccggctaccgtccccgaacgccgtaggttccaggtcggacgacggtcgggtcgtagggactacggtaccttcgacctctaccgacctacgtacacgtacacggtacctagacgttcgtaagtaattcgttttagacgtttagttttactacgtgtacgagtcgtaggtcggtactaggtcgcctcgtaccgtacgggttcgggaccgggtactagggtcgtaacgtaccaaggcgtggngtcgtagctactactcgttactcttactacgttccctccgtntacg

SEQ ID NO: 284356 - DNA, 696 bp, Homo sapiens
  misc_feature: GYAE6OF01EQA3D.14.57.F02.1.454.CMB.1.raw
  modified_base (199)..(199): a, c, t, g, unknown or other
  misc_feature (199)..(199): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctcaggggaangccacctctcctgcagggccagtcagagtgtacaaccaccaacgttagccttggttcagcagacgcctggccaggcctcccgaggtcctcctcatgtatgatgacactcccgacgacggggcccaccggcctacgtccccgaacgccgtaacggtttcgaggtcggcgtagggtccgggtcgtacggggacacggtaccttcgacctcctacacctacgtacaacgcaacgtacgtaggtacgtactagtaacgttgtttacgactttaaggttttacttacgttgtactaggtacgtacggggtcggtacgttaaggtcggcccgtacgttaccggttcggggttaccgggggacccgggggttaacgtaacggggtacgggtaaccgttaaacggaaacggttacggttcggttacggccgttacggacccgtaccgttacgttccgttacggttccctttaaccgtacctttccccggttcccgaaccttacgg

SEQ ID NO: 284357 - DNA, 559 bp, Homo sapiens
  misc_feature: GYAE6OF01B75RT.14.57.F02.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
  modified_base (313)..(313): a, c, t, g, unknown or other
  misc_feature (313)..(313): n is a, c, g, or t
  modified_base (354)..(354): a, c, t, g, unknown or other
  misc_feature (354)..(354): n is a, c, g, or t
  modified_base (377)..(377): a, c, t, g, unknown or other
  misc_feature (377)..(377): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccagggaaangccaccctctcctgcagggccagtcagagtgtcaacaccaacttagcctggtttcagcagaacgcctggccaggcctcccgaggcctcctcatgtatgatgacntcccacgnggccacggcactcccagccaggttcagtcgcaggcggtcgngggacagtcctcacgtctcaccntcagaccagcctagtatcgagtagtatttcgactagtttactacgtgcngtcgnggtcgggacttagtcgcctcgtcgttcgttacgggccggggtaacaggggttcgagttaccgaacgtactcgggtcgtcgttacnccaccgtnttaccgtggtccttacgctttccccgtcccgtacc

SEQ ID NO: 284358 - DNA, 883 bp, Homo sapiens
  misc_feature: GYAE6OF01A0Q6V.14.57.F02.1.454.CMB.1.raw
  modified_base (188)..(188): a, c, t, g, unknown or other
  misc_feature (188)..(188): n is a, c, g, or t
  modified_base (204)..(204): a, c, t, g, unknown or other
  misc_feature (204)..(204): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccagtggtagtttgggctgtagttggcttcttttcttgtggtcttaattttaaaagntgtcagtgtgaggtgnagtcgttggtagggacgggtccggggggagtcgtttacggtacggaccgggggtccccggggggggttccctacgaaccttacccttcccgttcccggttggtacgccgtaccgtccccgttacgaacgggttattttaccgttttaaggtttttttaaccggaacgttaaaagttacgttaccggaaccctaggttacggggtaccggttccgggttacccggggggtcccccgaacccgggtaccggggttaccccgggtaacccgggggtaaaggggggggaccggggggtccggttaggggggtacgggtttccggggtaccttacggaacgtacgtaacgtacggttagggtttacggttaacgttagggtaacggtaacgttacgtcggttaccggtacccgtccggttaccgtacgggtacgggtaccgggttccgttacctccgtactcctacgaacgtactactaaccgtaccaagttacctacgtttactacctttaacacctaagtcgacagtaacgtaaggaacgtaacgtacggaccggtaggttcgtttagttttagttacggtaaggtacgtaaagtaccgtaagtaacgttcgtataaccgttacgttaaccggttagggttacccgggtacgtttcgtaccgtggtcggtcgggtaaccggg

SEQ ID NO: 284359 - DNA, 925 bp, Homo sapiens
  misc_feature: GYAE6OF01B7DGW.14.57.F02.1.454.CMB.1.raw
  modified_base (179)..(179): a, c, t, g, unknown or other
  misc_feature (179)..(179): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttcttgtgcttaattttaaaagntgtcagtgtgaggtgcagctggttggacggtccgggggagtcgttggtacgacgggcccgggggggtcctggacctactcctcctgtcgcacgcctcgaggtattcttagtttttagacgtaaattacttgacctagttggagtccggttcggggtcccgccgaacggtccgtaccggaaggggggaacggggtcctagggggacggttcggggttacctaccggtaggtaacctaaacgttaccgtaagggtttacggtttacgtaaagggttacggggtaaaacgttaaccgtacggtttacccgggaacccggtccccgggttacccgttacccgggttacggggtaaaccgggggttccccgttttacccgttaccccgtacgttaccccgtaacccgtaaacgggtaacgtaaacccttaaacgttaaccccgaaaacggtaaaccccgtaacctttaccgttttaaacgttttacccgttaaaccgtaaaaccggttacgggaaaccccttaggtaacccccgttaaggaaaaccggaaaccgtaaaccgggaaccgggtaccgggggttaccgttttaggtttaagttttttacgggtagttaaacggtaaaacgttaacgtaaacggttaaacgttacgttaaagtaccgttaaacccggttaaacccgtaagggttttacgggggtaccgggtttacccttttaaggacggtttcgggttacgggtaacccgggggg

SEQ ID NO: 284360 - DNA, 831 bp, Homo sapiens
  misc_feature: GYAE6OF01BJ623.14.57.F02.1.454.CMB.1.raw
  modified_base (255)..(255): a, c, t, g, unknown or other
  misc_feature (255)..(255): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaccatggtagtttgggctgagttggcttctttcttgtggcttaattttaaaagatgtccagtgtgaggtgcagctggttggaggtccgggggagtcgttggtacgcgggcccggggggtcctgaccncctctccgtgtcgcacgcctacgaggtattacgtatttttacggacgtaatatgccctatggacgtccgttcggggtccccgccggaggtcccgtaccggaagggggtaacggggccgtaggggtacgggttacggggtcctacgaacgtaccgaaacgttaccgtaggggttcggttttacgttaaggggtaacgggtaaacgttaaccgtacggtttacccggacccggtcccccggtttaccggttacccgggttacgggaaacccggggttcccgggttttaaccccttacccgtaaccgttcccgttaaccccgaaggggtaaaccgtaaacttaaaccctttaaacccgaaacgttaaacccgtaaccgtttaacctttacgttttaaccttaacgaaaagttcggaaccgtacgtaaccgtaagggaaaacggaaccgaaaccggacggtaaccgggtcgtttaagtttagttttacggtagtaacggtaagtacgtaacgtaagttctaagttacgaccgttaaccgtaggtttcgggtacgttacttacgtatgggttccgacgggg

SEQ ID NO: 284361 - DNA, 769 bp, Homo sapiens
  misc_feature: GYAE6OF01BNEGR.14.57.F02.1.454.CMB.1.raw
  modified_base (181)..(181): a, c, t, g, unknown or other
  misc_feature (181)..(181): n is a, c, g, or t
  modified_base (742)..(742): a, c, t, g, unknown or other
  misc_feature (742)..(742): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggcttctttcttgtggcttaattttaaaagntgtccagtgtgagtgcagctggttggaggtccgggggagtcgttggtaccgcggggtcccgggggtcctgactctcctcgtgtcgcgacgcctagaggttactttacttaagtttttacgacgtaattctcgacctagtcgacggtcgtcgggccccgccggacggtccgtacggaagggggtaacgggcgtagggtaggtcgggtacctacgagtactaacgttcgtagggtttcggttacgtagggtaaggtaacgtacgtagttaccggaccgtccgttaccgtcggtacggtacccgggtccgttcctacctacgtcccgacgaagtaacgtaacctaacgttaaccaaagtaaccctacgtttacttaccttttacgtaaactaaggtacgaactacgtaccgtaaggaaaccgtaacggaacggtaccggtacggttagtttagtttcgtttacggtagtaaacggtaaatacgtaaaggttaacgttacgttaaggtaacttaaacccggttaacccgtttaagggtttacggggtacccgtttacgtttaacncgggtttcggtacggggtaacccgggg

SEQ ID NO: 284362 - DNA, 738 bp, Homo sapiens
  misc_feature: GYAE6OF01B2HG4.14.57.F02.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
  modified_base (279)..(279): a, c, t, g, unknown or other
  misc_feature (279)..(279): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagngccaccctctcctgcagggccagtcagngtgtacaacacctaacttagcctggtttcagtcagaacgccgtggaccnggcctcccgaggcctcctctactgtatgatgcactcccgacgacggcccaccggaccactacccaggtcctaacggttccaggtaggccgtaggccggggtcgtacgggacctaggtacctttacgaccttcgaccaaccctacgtcaacggtccacgtaccctagaacgtttaccgtaaggtaaacgtttagttttcgaccgtttaaagttttacgttaacgttcggttacgacgtacggtacgggacggggtaccttaaggttcccgggacccgttaccgttcccgggttaccggttttaaccgggggggacccgggggttaaaccgtaagggggtaccggtaacgggttaaacccgtaaaaccggtgtttaaccgggtcgggcgttacggacccgtaacgtcgttccgtttaccgtaccgtttccttaacgttcccccggttcccgtccgttaacg

SEQ ID NO: 284363 - DNA, 755 bp, Homo sapiens
  misc_feature: GYAE6OF01BZMAL.14.57.F02.1.454.CMB.1.raw
  modified_base (730)..(730): a, c, t, g, unknown or other
  misc_feature (730)..(730): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttcttttcttgtggctaattttaaaagatgtccagtgtgaggtgcagctgttggagtccgggggagtcttggtacgacgggcccggggggtccctgaccacctcctccgtgtgcagcctcaggtattctatttttagcgtaaatatgccaatgacgtcgttggggtcccgccgtacgggccttaccggaagggggaacggggcgtagggacggttcgggtctcgtaggactaaagtcaggttcggttacgtaggtaggaacgttacacgttccggaccgccgttccgtccggtggaaaccggggtcccgtttactccctacgttcccaccgaagtacgtaaccaaactttacccgaaagaaacccgtaactttacctttaattttacccttactaaaacgttcgggaacctacggtaacccttaagaaaacggaaccggaaacgaaccgtaccgggggtacgttacggttttaagtttttcgaggtttaacgaaaagttagtaaaccggtaagttcgtaaagtcggtaaaccttaacccgttaaagggttttcgggaaccggggtttcccgtttanacgggtttgttaccgggtacggggg

SEQ ID NO: 284364 - DNA, 816 bp, Homo sapiens
  misc_feature: GYAE6OF01B7PQ8.14.57.F02.1.454.CMB.1.raw
  modified_base (182)..(182): a, c, t, g, unknown or other
  misc_feature (182)..(182): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagntgtccagtgtgagtgcagctggtggacggtccgggggagtcttggtacacgggccggggggtcctgactactcctcctgtgcacgcctcgaggtattcttagtttttagacgtaaagttacgtcgacctagttacggacggtccggtcggggtcccgcccggaacggcccgtaccggaagggggtacgggtcgtaggggtaggttcgggtctacgagacctaacgtcgtagggtttcgttacgtaaggttagggtaacgtacgttacttaccgggaccgtcccgttccgtaccggtacggaaccggggttcccgttctacccgacttccgtaccgaaggaacgtaaacttaaccgttaccgaaaacgtaacccttacgttactttaacgttttacttaaacgtaagttccgaactaccggtacctaagggaaaacgaaccggtaaacggaaccgggttaccgggtaggtttacggttttaagtttttacggtaggttaaaggtaaacgttaacgtaaacggttaagtttcccgttaagttaacggttaaccgtttaaacccggtttaagggtttacccgggggtaacgggtttacccctttaaggtcgttacggggttccgggtaacccggggg

SEQ ID NO: 284365 - DNA, 893 bp, Homo sapiens
  misc_feature: GYAE6OF01CY4RY.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagttggctgagttggcttctttcttgtgctatttaaaagatgtccagtgtgaggtgcagctgtgggaggtccgggggagtcgttggtacgacgggcccgggggggtccctaggaccactcctccgtgtcgcagcctcgaggtattctagtttttagacgtaatatcgaccagtagacgcgtcgggtacccgacgtacggcctaccggaaggggaacggggcgtgggtaggtcgggtacctagacgaacgtaactacggtaggttacggttacgtaagggttacggtaaacgttactacgtttaccggaccggttccgtaccgttccggtaaggtaacggggtcccggttacctacccgacgttaccgtaccgaacgggtaacgtaaaccgttaaacccgtttaaacccgaaaacggtaaacccttaaccctttaccgttttaaactttttacccgttaaaacgtaaacggttacgggtaacctaaccgggttaacccttaaaagggaaaaaccggtaaacccgggtaaaaccgggaaacccggggtaacccggggtttacccggtttaagggtttttaacggttttttagggtaaaggttaaacgggtaaaaacggtaacgtttaaaccgggtaaacgtttacgtaaacggttaaacggtaaccccgttaaaaccgggttaaagggttttaccgggggtaaccggggtttacctttaccgtaaacgggttccggtacccgggggttaaacccggggg

SEQ ID NO: 284366 - DNA, 736 bp, Homo sapiens
  misc_feature: GYAE6OF01CBALY.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtgaggtgcagtctggttgggaggtccgggggagtcgttggtacgacggggcccggggggtccctggacctacctccgtccgtgtcgcacgtcctgaaggtactttcgtaagtttttaagacgtaatagtcgacctagtgacgtcggtcgggtcccgccgacggccgtaccggaaggggacggggcgtggggtacggtcgggtcgacgaacgtctaacgtcgtacggttcggttacgtaaggtaaggtaaacgttacgtacgttaccggaccgtccgttccgtaccggtaggaaccgggttcccgttcctaccgtactccgtacgagaacgtaacctactaaccgaaagtacctaacgttacttaactttcgtaaacgtaacgtgaacgtacgaccgtaagaacgaacgaagacgtaggtcgttagtttacgtttagacggttaagaaacgtacgtaacgtaagtaccgttaataacggttaccgtaacccggttaaggttccggggtacggtttaccttaggtcggttacggtcggtaaccgggg

SEQ ID NO: 284367 - DNA, 738 bp, Homo sapiens
  misc_feature: GYAE6OF01BAP6E.14.57.F02.1.454.CMB.1.raw
  modified_base (236)..(236): a, c, t, g, unknown or other
  misc_feature (236)..(236): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaattgtgttgacacgtagtctccactcacccttgttctttgtcctaccgagggaaagagccaccctctcctgcgagggccagtcagngtcgtacaacgactaacttacgcttggtttcacgtacaggaacgccgtggaccacgggtcctcccgacggtccttaccgtcagttcgtaagtgactgactacgtccgacgacggcccacggcacgtccgagccgtagttcacggtacgtcgacggtcggtcgtacggggaactccgtacgttacgacttaccgtacaccctagtacccagaccgtaggtaccgttagacgttcgtaacgtacgttacgtttacgtacgtttaagtttacttaaccgtacgttacgtaagtccgtaacgggagggttaccgtaacgtttccgggaccgtacctttccggtacgggttttaccccgggggaacggggtaacgtaacggggtttaggaaccgtttaacgtaaccggttaaccggttgggtaacgggttccgtacggtaacccgtcccgtaagtttccgtacgttaccggttacctaaccgtttcccgtaacccgtcgttaacccg

SEQ ID NO: 284368 - DNA, 725 bp, Homo sapiens
  misc_feature: GYAE6OF01BMCMM.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggacgtccgggggagcttggtacaggccggggggtcctgacactctcctgtgcagcctcaggtacttctagtttttagctaatatcgccatgagctgggtccgccgaggcgtccgaggggaagggcgtgggaggtgggtctcgacgactaagtcgtaggtcggttcgtaaggtaggtaacgtactacgttacggaaccgtcccgttcgtacccgggtaggtaacgggtccgtttcgggttcctccgtacgttcctaccgagacggtaactaaacgtttaccaaaacgtaacctaccgttactttaacttttacctttaaccgtaaagttacgggtaacctaaccggtaccgtaaacggtaaaacggaaccggaaacggaacccggttacggggtaccgttaggttttacgtttttggtaaggtagtaaaacgtaagtaacggtaacgttacgttaagtacgtaaacttaacccggtaagtttacgggggacggttaccttttcgtacgttcggtaaccgggg

SEQ ID NO: 284369 - DNA, 699 bp, Homo sapiens
  misc_feature: GYAE6OF01A7IVP.14.57.F02.1.454.CMB.1.raw
  modified_base (303)..(303): a, c, t, g, unknown or other
  misc_feature (303)..(303): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcgagggccagtcagagtgtacaacaccaacttacgccgttggttcagcagaacgccgtggccaggcctccgaggcctcctcatgtngatcgcatcccagacgggcccaccggcacgtccccacgccgtaggttcgaggtcggccgtaggccgggtcgtcggggacacggtaccttcgactcctaccaaccatacgacgacgtacgtaccgtaggtacgttacgtagtaaagtttacgttttcgacgtttaagttttacgttaccttcggtacgaggtaccgtagggccgggtaacgtacggtccggtccgtaccgttaccggttaccggggtttcccggggggaaccggggttacggtaacgggtcgggttaacggtaaaccgtaaacgggtacgtcgggtcgggttccgtacggaccgtacccgtcgttaccggttccgtttaccttactacccggtttccccttaccccgtaccgttacg

SEQ ID NO: 284370 - DNA, 761 bp, Homo sapiens
  misc_feature: GYAE6OF01AUFTK.14.57.F02.1.454.CMB.1.raw
  modified_base (253)..(253): a, c, t, g, unknown or other
  misc_feature (253)..(253): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggtacttattttaaaagatgtccaggtgtgaggtgcagctggtgggacgggtccgggggaggtcgttggtacgcgggccgggggtccncgacacctctcctgtcgcacgcctacgaggtacttacttattttagacgtaatagtcacagtgaggtcggtcgggtccgaccgacggtccgacggaagggggacgggtacgtgggtaggtcggtctacgacgacaacgtcgttggtacggttagtaagggtaggtaactacgtacgttccggtaccgtcccggtaccgtacggtacgggtaccgggtcccgttcgtacctacgtccgtaccgagtaacgaacctaacgttaaccaaacgtaccttacttactttactttaccgtaacgtaaggtccgaactacggtaaccgtaaggaaacaacggaacggtaccgggtacggttacgggtttattttaggttttgtaacggtaaaggtaaacgttcgtaaacggttaacggtacttaacgtacggtaacccgttaaaccgggttttacgggtaacggggggttccctttaaccggtttacggtacgtttgggacggggtaacccgggg

SEQ ID NO: 284371 - DNA, 764 bp, Homo sapiens
  misc_feature: GYAE6OF01CT6F5.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgctccgaagggaaancgcccacctctcctgcagggccagtcagagtgtacaacaccaacttacgcctggttacagacaagacgccgtaggccgacggcctacccgaggcctcctactaagtgtactaggactcgacctaacgtccccgacgaccgggcccaaccggacctacgtacccctacggaccgtacgggttaccgaggttcgggacgtacgggtcgggtcgtagggactaaggtacccttagaaccgtcctactaacccgtatccgaacgacccgtaacgtaccgtaacggtacgttacgtaaaggtaaacgtttcgttttaacggtactttaaagggttttaacttaagttacgtaaccgtaaccgggtacggtaacggggtccggggttaaacctaaacgggtttccgggaacccgtaccggtttaacgggtacccgggttttacgggggggaaccgggtaacgtaacgggtacggtaacggttaaccgaaacggttacgttggacggtacgttcggaaccctacgttaactcgttcgttaactttcgtacttccccgttcccgtaacg

SEQ ID NO: 284372 - DNA, 914 bp, Homo sapiens
  misc_feature: GYAE6OF01AE19N.14.57.F02.1.454.CMB.1.raw
  modified_base (169)..(169): a, c, t, g, unknown or other
  misc_feature (169)..(169): n is a, c, g, or t
tcagcgtctagtaccacgaccggtgctcgatttagctcgatatagttgggtttgggggaactgctcagttacggaccagagggaaccatggaacgcccagctcagtcttctccttaaaaacctctgcctactcgtggcctccgagtactaccgacggataacttgtgtnaacacgtacgtctccactcaccgttgttcttacgtcgtacggaggaacgcgtcccaccttcgtacgtcgacgacggctacgcacggtacgtcgtaaccaacctaccgtaattaccgtccgtttacggttacaacggtaacgaacggtaccgccggttacgggacccgttaccggtaccccttacggacgggttacccttccgtaccgtaaggttacttaccggtacgtaacgtccggtaccctaacccggtacccgtaaccggggtaacccggggtaccccgttaacccgggtaaccggtttaaccccaccccgggtaacgggtaaccccgggttttaccgggtaaaccggttacgggggcggttaaacccggggtaccggggggttaaccccggggtttcggtttaaaccgggaacccgttaaaacgggtttcccctttacccggtacccttaacccgtaaaccgtacccgggtaaactccgggaaaccgttaccggtacccgttaacgtcggttaacgtacgtacgttagttacggttactaacgttagtttaaccgtggtataccggtccgtacggtcgggttacgtacggtaccgttccggaccgtttaccggtcggttacccgggtacgggtacggttacggtaagggacgtttacgtaccggtaccgtagtcgtacggactacggtaccctgttaccgtgttaccgttacctacgttacccgtactcccgtgtaacccg

SEQ ID NO: 284373 - DNA, 665 bp, Homo sapiens
  misc_feature: GYAE6OF01B788F.14.57.F02.1.454.CMB.1.raw
  modified_base (157)..(157): a, c, t, g, unknown or other
  misc_feature (157)..(157): n is a, c, g, or t
  modified_base (202)..(202): a, c, t, g, unknown or other
  misc_feature (202)..(202): n is a, c, g, or t
  modified_base (309)..(309): a, c, t, g, unknown or other
  misc_feature (309)..(309): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgngttgacacagtctccactcaccctgtctttgtctccaggggaaangccaccctctcctgcagggccagtcagagtgtcaaacaccaacttagcctggtttcagcagagcctggccaggctcccaggcctcctcatgtatgatgcatcccagnggcccacggcatcccagccgagttcaggtggcaggcgggtactgggacagtacttcgactctacaccatcagtcagcctagacgtctacgtaagtatttagtactaagtttacttacgttgtcgtacgacgaggtcggggacgtaacgttccgggacccggtacgtccgttaaccggttttaccggggaccggggggggtaacccggtaacggggtacgggtacgggtttaaccggaaaacccgggttaaacggtacgggttacgggtacccgtggtacccgtaacccgttaaacgttcccgtttacgttaacccgttttccgtaaacctttccccgtttcccccggttaaccccg

SEQ ID NO: 284374 - DNA, 773 bp, Homo sapiens
  misc_feature: GYAE6OF01DURY5.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggataaattgtgttgacacagtctccactcaccctgtctttgtctccgaaggggaaagcgccaccctctcctgcgagggccagtcagatgtacaacaccaacgttagcctggttacagcagaacgctcggccaggcctcccacggtcctccgtcagttgtagtgtatcgtacaccgtacccgacgaccggggacccgacccggtactaaccgtccccgtacggtccgtaacggttccgaaggttcggaccgagggtccggggttacgtgggaccgtagtaccgttcaccgtttacctccgaaccctagtcccgtaacggtactacggtaccgttaaccggtacgttacggtaacggttaagttaacgttttacgtaacgtttaacgttttaaccgtttacgttacggtaccgtaggtacgtaccgggacgggttaccgtaaaggttcccggtaaccggttccgtacccggtttaccggggttacccgggggtaccgggggtaacgggtaaccgggtaggggtaaccgttaaccggtaaccggtacgttagggtacggtaccgtaggtacctaccgttacgttcgttaccgttcccgttacttcgttacccccgttccggtccttaacgg

SEQ ID NO: 284375 - DNA, 754 bp, Homo sapiens
  misc_feature: GYAE6OF01B4L6F.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactccaccctgttctttgtcctccgaagggggaaagacgccctacccttcctcctgcgacgggccagtcgagagtcgtacaacaaccaacttacgcttggttcagcaacgacgccgtcggccacggcctacccgaggtcctcctactagtgtatagtatcgcacctacccgacgacgggcccgaccgcacctcccgacgccgtacggttacgacgggtcggaccgtcggtccgggttacgcggggtaacacgttaccttccgtaaccgttccctaaccgtacctacgtaccgaccgaccgacgtaccgttaacggtacgttaacgtacgtttaattagtttacgtactttaagttttacgttacgtacgtacggaacgtacgggaggtacgggtaacgtacgttcgggtcccgtcgttacccggtacgggggtttaccgggggaaccgggggttaacgtaggggttacggttaacgtaaccgggtaacggtacggttacgggtacggtacgtaccgtaccgtacccgtcgttaccggttcgttaccgttaccgtacccgtttcccttaccgtccccttacgg

SEQ ID NO: 284376 - DNA, 951 bp, Homo sapiens
  misc_feature: GYAE6OF01B9012.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggataaattgtgttagacacagtctccactcacctgtctttgtctcgagggaagcgccaccctctcctgcgacgggccagtcagagtcgtacaacacctaacttacgccgttggtttacagactaaggagcccgtggccgacggcctaccgacggtcctaccgtacattacggttacgtgacttcggaccaccgtacccgaccgacgggtcccaccggctaaccggtcccgacggtaccgtacgggttacgtacgggtcggccgttaagggcccgggttacggtaacgggaccgttaaccgttaccgtaccgtaccccttaacgtacccgtaaccgtaacgttacccgaaacgggtacccgtaccggtaacccggtttaagggaacccggtttacgtttaaacgggtaacggttttaacccggttttaagggtttaaccggtttaaacgttttttaaacggttaaccccggttagggttttaaccccggtaagggtttacccgggtaaccgggggtaccggggttaaaccgttaaccggggttttacggtccccgttaaccggggttttaccccggttaaccccgggggggttttttaaccggggggggaaccccggggggttaaaccggtttaacggggggttaaccgggttaaccgggtttaaaccggtaaaccggggttacccggtttagggtacccggggtaccgttaccggtaacccggtaccgtttaccgttaccggttacccgttttaccttacccgggtttacccctttacccggttcccccgtaccgtttaacccggg

SEQ ID NO: 284377 - DNA, 984 bp, Homo sapiens
  misc_feature: GYAE6OF01AWLH3.14.57.F02.1.454.CMB.1.raw
  modified_base (767)..(767): a, c, t, g, unknown or other
  misc_feature (767)..(767): n is a, c, g, or t
tcagcgtctagtaccacgaccggtgctcgatttagctcgatatagttgggtttggggctgagagaggagcccagtcctgggatcttcaggtgttttcattttggtgatcaggactgaacagagagaactcaccagtggtaggtttgggctgtaggttggtccttctttcgttggtggtacttaatttttaaaaagtatcggttaccgaggttgtaggtaggtgacgagtcgttgggttcgggacgggttaccggggggtggtacgtttcgggtaacggaccgggggtccccggggggggttacccgttcggtaacctaccggttccttccgttcggttacggcctaacggtcccgttacggtaaggttacttttaccggttttaagtttttaaccggaccggttaaaagttccgttacggaccctagttacggtaccgggtacccggtttacccgggggtaccccgaccggtaccggggtacccgtaacccgggggtaaaggggggtcggggttcggttaacgggggttacgggtttacgggttccgtaccgaaacgttaaccgtaacgggtttaccggttagggtttacgggtttaccgttaaaggggtaaaccgggttaaacgttaccgttaacgggtttccggaaccccggttccggtttaccgggttacccgggttaaacgggtaccgggttcccggtttacctttacccgaccgtttacgaccgtaagtaccgtaacctaacggtaacccaaacgtaacctnttaaccgtttacgttaacgtaacgttaacgtacgaccgtaacgtaacccggaaaggtaaccgtaacgaaaccgggtcgttaaaccgggttagtttaggttttacgttacgggtaaggtaacgtaaagtacgtaaagtacgttataacggtacgttaacgtaaccggtttaaggtcggttaaacggttccgttacttggtccgggttagggacccggg

SEQ ID NO: 284378 - DNA, 717 bp, Homo sapiens
  misc_feature: GYAE6OF01EFKF3.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttggggagaactgctcagttaggacccagagggaaccatggaagccccagctcagcttctcttcctcctgctactctggctcccagataccaccggagaaattgtgttgacacagtctccactcaccctgtcttgtctccaggggaaancgcccaccctctcctgcgacgggccagtcagagtgtacaacacctaacttacgccttggtttcagcagacgcctggccaggcctcccgaggtcctccgtcattgtatgactgcctactccccgaacggaccgggcccaccggccaacgtccccaggtcccgtaggttcacggtcggacgagggtccgggttcgtacggggaactacggtaccttacgtacctcctaccaccctatacgacggtactacgtccgtaaggtacgtacgtaaggttaacgttagttttcggagtttacgttttacttaccgttaggtaccgtaggtcggtaacgggtccgggtaactaacggttcccgggacccgttcgttacccgggttaccgggtttaccggggggaccgggggtaacttaaggggtcggtaacgttaacccggaaacggtaggttcggtacggtaccgtcgtaaccctaccgtgttaccgttcgttacctaccttacgtttccccgtcccggtaccg

SEQ ID NO: 284379 - DNA, 659 bp, Homo sapiens
  misc_feature: GYAE6OF01D5LN7.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgatttagctcgatatagttgggtttgggggaggaactgctcagttaggacccagagggaaccatggaagcccccagctcagcttctcttcctcctgctactctggctcccagataccaccggagaaattgtgttgacacagtctccactcaccctgtctttgtctccgaggggaaanagcccaccctctcctgccgagggccagtcagagtgtacaacaccaacttacgcctggtttcagcagaagcctggccaggcctcccgaggctcctcactgtatgatcgcactcccacgacgggcccaccggcactcccgagcctaggtcaggtgcaggcggtacgtggactagaccttcactctaccacactcgaagcaacgccgtagacgtacgtagtaagttatttcgacgttaagtttactttaacgttcgtacgtaggccgaacgggtccggggtactaacggttcgggacccgttaccgttaccgttaccgggtttaccgggggacccgggggtaaccgtacggggttacggtaacggttaaaccgtaaacccggtaagttcggtcggtacctcggtacccaacccgtcttaccgttcgttaccttactaccgttcccgtcccgtacccg

SEQ ID NO: 284380 - DNA, 747 bp, Homo sapiens
  misc_feature: GYAE6OF01DV9AW.14.57.F02.1.454.CMB.1.raw
  modified_base (217)..(217): a, c, t, g, unknown or other
  misc_feature (217)..(217): n is a, c, g, or t
  modified_base (672)..(672): a, c, t, g, unknown or other
  misc_feature (672)..(672): n is a, c, g, or t
  modified_base (731)..(731): a, c, t, g, unknown or other
  misc_feature (731)..(731): n is a, c, g, or t
  modified_base (739)..(739): a, c, t, g, unknown or other
  misc_feature (739)..(739): n is a, c, g, or t
tcagcgtctagtaccacgaccggtgctcgatttagctcgatatagttggggtttggggctgagagaggagcccagtcctgggatcttacaggttgttttcatttggtgatccaggactagaacagagacgaactcaccagtggtggtttgggctgagttgtcttcttttcttgtggtacttaattttaaaacgattgtccagttgtggaggtgacgngtcgtgggttgggacgggtccgggggagtcggttaggtaacggcggggtccccgggggtcctgaacctcctcctccgtgtcgcgacgccgtagttacgtactttaccgtttagttttaacgacgtaaattcgaccgtcgagtcgaccggtcggttcccgggccgcggacggtccgtaccggggaaggggaccgggtgtagggtacgggtcggttacctacggaaccgtagtaacgttggtaggttcggtaacgtagggtaacgtacttacgtacgtcgaccggtccggtaccgtaccggaggtacccggttccgttactccgtactacctaccgaacgaacttaacgtaactaaaccgaaacgtttacctaacttatttaacctttacgaagtaacgtcgtaacacgttaataagaaccggaaggaccgaaccggtggttaactttgttaggttntaggagtaatacgtataacgtgtacgagttacgtaaccggtgggtcggtacttcggttnaggttcgnggaccggg

SEQ ID NO: 284381 - DNA, 842 bp, Homo sapiens
  misc_feature: GYAE6OF01B08B0.14.57.F02.1.454.CMB.1.raw
  modified_base (242)..(242): a, c, t, g, unknown or other
  misc_feature (242)..(242): n is a, c, g, or t
  modified_base (300)..(300): a, c, t, g, unknown or other
  misc_feature (300)..(300): n is a, c, g, or t
  modified_base (819)..(819): a, c, t, g, unknown or other
  misc_feature (819)..(819): n is a, c, g, or t
tcagcgtctagtaccacgaccggtgctcgatttagctcgatatagttgggtttggggctgagagagagcccagtcctgggatcttcaggtgttttcatttggtgatcaggactgaacagagagaactcaccatggagtttggctgagttggcttctttcttgtggacttattttaaaagactgtccagtgtgaggtgcagctgtggagtcggggagcgttggtacgaggccggggggttccncgcgtactcgtcctgtcgcgagtcctgagtacgttactagttttacgcgtaaacgttncggacctagttacgagtccggtacgggtcccgacggacgtaccgtaccggtaagggggtaagggtccgtaggggtaacgggtcgggtacctacgtacggtactaacctacgggtggttacgggtttcctaaagggttacgggtaaaacgtttaccgtaaacgttcggtaaccccggtccgggtttaaccccttcgggttaaccggggtaaaccgggttccccgggttttaccgaccccgtttacgttacccgtaccgaacgggtaaccgaaccgttaaacgtttaacccgaaaaccggttaacttaacccgttactttaaactttttacccgtaaacgtaacgttaacgggactaaccgttcgtaaaacggaacgtaaacccgggaaagttacccgggacggggtttaaaccgttgtttaacgttttagtacggttaagaaagttacgtaacgtaacgttcggtaataccggtacccgttaaaccttagggttaccggggtaaccggttcttaaccgtnttaacccgggtggtaacccgggg

SEQ ID NO: 284382 - DNA, 779 bp, Homo sapiens
  misc_feature: GYAE6OF01CDSVW.14.57.F02.1.454.CMB.1.raw
  modified_base (185)..(185): a, c, t, g, unknown or other
  misc_feature (185)..(185): n is a, c, g, or t
tcagcgtctagtaccacgaccggtgctcgatttagctcgatatagttgggtttggggctgagagaggagcccagtcctggtatcttcaggtgttttcatttggtgatcaggactgaacagagagaactcaccagtggagtttggctgtagttggcttctttcgtgtggtacttaattttaaaagntcgtacctagtgtaggaggtgacagtcgttggttggagtcgggtagggggagtcgttaggacgaggtcccgggtgggggtccctagacgtcctcgtccgtggtacgcgacgtcccgtgtaggttactttccgttacgttagccgtaacgtccttagccggactaggttcggaccggtcggtccggtccgtccggaccggtacggtccgtaccggggaggggaacgggtcggttgggtacggtcggtctcgtcgtacttacgtcgtaggcgttaggttgactaattaacgactaaacttaccgcgaacgtacggtaccgtccgggaaggtcgggtacccgtttgtacctttagtacccgaaggtaactaaacgtaccgtaacaacacctaacgtatacggtactcgagaacgtaagacgtaccgaccgtacacgtaacggacgtaccggaacgggtaccggtaacccggttaccgtaacggtttaactttaacgggttcggtaacccgggtaaacggaaaccggttaaacccgttacgggttttaaaagtttacggggtttttaacgggtaaaggttttacgtttttaaaccggg

SEQ ID NO: 284383 - DNA, 726 bp, Homo sapiens
  misc_feature: GYAE6OF01ELR9X.14.57.F02.1.454.CMB.1.raw
  modified_base (170)..(170): a, c, t, g, unknown or other
  misc_feature (170)..(170): n is a, c, g, or t
  modified_base (203)..(203): a, c, t, g, unknown or other
  misc_feature (203)..(203): n is a, c, g, or t
  modified_base (694)..(694): a, c, t, g, unknown or other
  misc_feature (694)..(694): n is a, c, g, or t
  modified_base (722)..(722): a, c, t, g, unknown or other
  misc_feature (722)..(722): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtcnccactcaccctgtctttgtctccagggggaaanagccaccctctcctgcgagggccagtcaagagtgtacaaccgtaacccaacttacgccttggttcagcagaagcctggcccaggcctacccgaggctcctcatgtaatgatcgacgtactcccgaacgacgggacccgaccggaccaacttcccgaacgtacccgtaacggtttccgaagggtcggaacgtacgggccggggttacgttaccggggaactacggtaacctttccgaacccttcgtaacccgaaccgtaaccgttcaaccggaccgtaaccggtaccgttaacggtaccggttacgttacggtaaaacgtttaggtttttacgaccggtttaaatttttacgttaagttcgtacgaggtaccacggggtaccggggtaactaaggtcccggtccgtactaccggtacggtttaccggggcgggggtaaaccgagggttacgtacgtaacgaaaccgtagtacggtaggcctagacccacgtntccgttgttactacgacttcctccccgntacg

SEQ ID NO: 284384 - DNA, 731 bp, Homo sapiens
  misc_feature: GYAE6OF01DO159.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagcgccaccctctccgtgcgacgggccagtcgacgtagtcgtacaacacctaactacgcctggttcagcaggaagcctggaccaggtcctcccgacggtcctaccgtcacgtgtactggatcggacactaccccgacgaccgggcccgaccggtactaccgaccccacggcccgtaaggtccgaggtacggccgtacgggtccgggttacgtacggggaaccgtacggtaccttaccgtacccgttaccgtacccgtaccctacgtaccgtaacgaccgacggtaccgttaaggacgtttaccgtaaggtaagttagttttccggaactttacggttttaacttacgtcggttacaggccggtacgggacgggacttaaggttccgggacccgttcgtaccggttccggggttaccggggacgggggtaaccgtaagggtacggtacgttaacgaacgttaccggtaggcggtaccgacggtacctacgttaccgttgttaccgtcgttccagtttccccgaccgtctacg

SEQ ID NO: 284385 - DNA, 818 bp, Homo sapiens
  misc_feature: GYAE6OF01DRYHF.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctaccgaggggaaagacgcccaccctcctcctgcacgggccagtcagagtcgtaccaaacacctaacgttacgtcctggtttcagacaggaacgccgtcggccacggcctacccgaggtcctcctacagttcgtatgtatacggcctaccgtccccgaacgaccgggacccgaccggacacctccccgaacggcccgtaaggttccgacggtacggaccgacgggtccggggtacgtacgggaactacggttaccttccgtacctcgtacccaccgactacgacgtaccgtaacggtacccgtaacggtaacgtttccgtaaaggttaaacggttttacgttttacgaacgttttaaggtttttacgttacggttggtaacccgtaggaccggttacggggtacggggtaacgtaaccggtttcgggacccgtaccgttaccgggtttaccgggggttaccgggggacccggggggttaaccgttaaggggggtacgttaaaccggttaaccgggtaaaccggttaccggttcgggtacccggtacgtacccggtaacctacccgttacggttcccgttaccgttaccgtttacccgtacccgttttcccgttcccgaccgtttaccgg

SEQ ID NO: 284386 - DNA, 801 bp, Homo sapiens
  misc_feature: GYAE6OF01B0GB8.14.57.F02.1.454.CMB.1.raw
  modified_base (244)..(244): a, c, t, g, unknown or other
  misc_feature (244)..(244): n is a, c, g, or t
  modified_base (469)..(469): a, c, t, g, unknown or other
  misc_feature (469)..(469): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggcctcccagactaccacggagtaaattggtgttgacacagtcctccactcacccgttgttcttttcgtccgtaccggaaggggaaaacgcgacccctaccccttcgttcccgnggaccgaacggggcccagtacgaggtacgtcgtaccaaacctaaccgtaacttacggacctttcgggtttacacggaacgaacgaacggtcccgtacgggccaacggtccctacccgtacggtcccttccctacggattaggtaaccgttgaacgttcgacctacgtaccccggacgtaccgggacccgaccgtaccgacctcccgagtacccgtacggttacgnggtacggtacggtcgtccgggggtataccgggactaccgtactacgtacccttaccgacaaccggtactcggacacgtaccaccgttaggtacgttacgtaacgttaagttacgtttacgtaacgtttaacgttttacttaacgttgtaccgtacggacggtacgggtcggtacgttaccggtcggtaccgttcgttacgttccgggttacgggacggggtaacggtacgggtaaggttaaccggtaacgtaacggtaaccggtggtcgtaccggttagaccgtacgttacgttacgtacgtttccctagtccccttccggtccttacccgg

SEQ ID NO: 284387 - DNA, 798 bp, Homo sapiens
  misc_feature: GYAE6OF01ET15V.14.57.F02.1.454.CMB.1.raw
  modified_base (152)..(152): a, c, t, g, unknown or other
  misc_feature (152)..(152): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggcctcccagactaccgaccgganaattgtgttgacacagtcctccactccacctgttctttgtcctcgagggaagcgccaccctctcctgccgacgggcagtcgagtagtcgtaccaaccaccgtaacttcgccttggttcagacgagacgccgcggaccgacggtcccgtcccgacggtccctccgtactagttacgtagtacgcgtacgtcctaccgtacccgaccggacccggggccccgacccggcctaaccgtcccacggacgtacggtccagggtcgtacggcggtcggtcgtacgggactacggtaccttacgtacctcacccgtacctactccgacgtaccacgtaccgtagtaccgttagtagttaacgtttacgtttaccgtagttaacggttttacttacgttacgtaccggtagaccggacgggtaccgggttaactacgggtcccgggtaccccgttccggtacccgggtttaccggggtacggggggtaacccggggttaaaccgggtggggttacccgggttaacgtaaacccggttaaacccgggttacggtccgggtaccggttacccggttacggaccctaaccggtttacctacccggttttcttacccgtttacccggttcctttcccccgttacccgttcccgtaacg

SEQ ID NO: 284388 - DNA, 825 bp, Homo sapiens
  misc_feature: GYAE6OF01AXCG8.14.57.F02.1.454.CMB.1.raw
  modified_base (818)..(818): a, c, t, g, unknown or other
  misc_feature (818)..(818): n is a, c, g, or t
tcagcgtctagtaccacgaccggtgctcgatttagctcgatatagttgggtttgggggggaactgctcagttaggacccagagggaaccatggaagcccagctcagcttctcttcctcctgctactctggcctcccagactacccgaaccggaagtaaatttgttgttagaacactacgtcctcccacctcctacccttgttccttttcgtcctaccggaaagggggaaacgaccgcccctaccccttccttccgtcgccgacgggccagtcaaggtagtcgtaccaaccaacctaacgttacgtccgttggttcacgtacgaacgacgccgtcggaccgacggtccctacccgacggtacccttccgtactagtacggtagtacgtagtcgacctaccgtacccggaacggtaccggacccgaccgacctaccgtcccgtacgtaccgtacggtcgtacggtcggacgtacgggtcggtacgtgggaacctacgtccgttactaccgtccctaaccgacctacgtaccgacgacgtaaccgtaccgtaggtaccgttaacgtaagttaacggttttcttttaacggtaaccgttttaagttttaacgttcgttacgacgtaccggtacggacggggtacccgtagttaccgggttccgcccgtttaccgttacccgggttaccgggggttaccggggggacgggttaaacggtacgggttaggtaacccgtaaccgtaacggttcgttgggtaccgcggttacccaactacggttcctttagttcccgttactttaccgtccctttcccgacccgtnttaacgg

SEQ ID NO: 284389 - DNA, 710 bp, Homo sapiens
  misc_feature: GYAE6OF01BJW37.14.57.F02.1.454.CMB.1.raw
  modified_base (202)..(202): a, c, t, g, unknown or other
  misc_feature (202)..(202): n is a, c, g, or t
  modified_base (308)..(308): a, c, t, g, unknown or other
  misc_feature (308)..(308): n is a, c, g, or t
  modified_base (687)..(687): a, c, t, g, unknown or other
  misc_feature (687)..(687): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcacctgtctttgtctccgaggggaangccaccctctcctgcgacgggccagtcagagttcgtacaaccacctaacttacgccttggtttacagcaagaacgccgtggccaggcctacccgaggcctcctacntagtatgatgctactacccgacgacggacccgacggtcaccgtcccgacgtccgtacggttcaggtcggtacgaggtcggtcgtacggactacgtcttaccgaccttcacctaacctagtaccgtacgaccgtactccgtaagtccgttataacgggttaaacgttcgttttacgaccgtttaattttacgtaccggttgtaccgtacggtaccgggacggtaccgggtactacggttcggccggtacttccgggttaccgggttcgggggaccggggtaaacctaggggtaccggaagttaaaccggtaaacggttcggtacgggtcggaccttacgggaacccctaacgttcgtacccgtttcgttccgttaacccnccgttttcccccgtccgtacccg

SEQ ID NO: 284390 - DNA, 761 bp, Homo sapiens
  misc_feature: GYAE6OF01BTM77.14.57.F02.1.454.CMB.1.raw
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtacaacaccaacttagccttggttcagcagagcctggccaggcctcccgagctccnatgtatgatcgcactccacgacgggaccaccggcactcccagccgtaggttcaggtcgngacggtcgggtacgtcgggaactaggtaccttactaccttacctaccaacctagtaccgacggtaccgaacggtacccgtaggtacgttaccgtaggttaaacgttacgttttacgtaacgtttaagtttttaactttaccgttggtaccgtacgggaccgtaacgggtacggggtaccgttaaaggttcccgggtacccgtaccggttaccggttaacccgggtttccgggggggtaaccccgggggggttaaccggttaaacgggggtttccgggtaacgggtttaaacccggtaaaaccggtaaacggttcgggttacgggtaccgttaccggacccgtaccgttaacgttcccgtttacggttacccttttacccgtaacccgttttccccgttcccgttaaacccg

SEQ ID NO: 284391 - DNA, 757 bp, Homo sapiens
  misc_feature: GYAE6OF01CSFPU.14.57.F02.1.454.CMB.1.raw
  modified_base (234)..(234): a, c, t, g, unknown or other
  misc_feature (234)..(234): n is a, c, g, or t
  modified_base (319)..(319): a, c, t, g, unknown or other
  misc_feature (319)..(319): n is a, c, g, or t
  modified_base (432)..(432): a, c, t, g, unknown or other
  misc_feature (432)..(432): n is a, c, g, or t
tcagcgtctagtaccacgaccggtgctcgatttagctcgatatagttggggtttgggggggaactgctcagttaggacccagagggaaccatggaagccccagctcagcttctcttcctctgctactctggctccagataccacggataatgtgtgacacagtctccactccaccttgttctttgtcctaccggaaggggaaagcgccctacccgtctctgcgacgggccagtnaggagtcgtacaacctaaccaattcgtcgttcggttcacgcaaggacgccgtcggccacggctaccgcgtcctcctatatgtacngtacgtcgaccaccgtcccgaacgaccggcccgtacggacctaccaccgacgtccggtaaggtcgtacgggtcgcggtaggtccggggtcgtacgggactacgtacgtacccncgttccacgtacacgcgacgacctacgtaccggtagtacggttacgtaagttaagtttacgttttacggttactttaaaggtttcctttacgttacggtcgtaacgtcgggtaacggggtccggtaacggtttaacgggtccggtaccccgtttcgttacccggggtttccggggttacccgggggacgggggttaacggaaggggttacggttaaaccgggttaaacccgaacggtaggtccggttcgggtcgtaaccggtccttaacgttcgttaccgttcgttaaccgttcccgttaccgtccccgttacccgttctacggg

SEQ ID NO: 284392 - DNA, 779 bp, Homo sapiens
  misc_feature: GYAE6OF01BUO1F.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagatgtccagtgtggaggtgcagcttggttgggagggtcccggggggaggtcgttggtacgacgggcccgggggggtcctggaccacctcctccgtgtcgcacgcctcgaggtatttctaattttttagacgtaatatgcctatgaggcgttcggggtcccgccgacggtccgtaccggagggggaacggggcgtgggaggtcgggtacctcgacgactaagtcgtaggttcggtttcgtaaggtacgggtaaagttacgtacgttaccggaccggtcccgttccgtcccgggtaggtaaccggggtcccggtttacctcccgtaacgttccctaccgaaggaacgtaacctaaacttaacccgaaacgtaaacctacctttacctttaagttttaccttaacgtaaaagttcgggaaccacgtaacccgtaaggaaacgaaaccggaaggaaccggtaccggggtacgtttagtttacgttttaggtaggtaagtaaaagtacgttaaacgtaggttacttaagtacggtaaccttaacccggttaaggtttacggggtacgggtttacctttaggacgttcggttccgggtacggggg

SEQ ID NO: 284393 - DNA, 755 bp, Homo sapiens
  misc_feature: GYAE6OF01C872S.14.57.F02.1.454.CMB.1.raw
  modified_base (200)..(200): a, c, t, g, unknown or other
  misc_feature (200)..(200): n is a, c, g, or t
  modified_base (715)..(715): a, c, t, g, unknown or other
  misc_feature (715)..(715): n is a, c, g, or t
tcagcgtctagtaccacgaccggtgctcgatttagctcgatatagttggggtttgggggggaactgctcagttaggacccagagggaaccatggaagccccagctcagcttctccttcctcctgctactctggctcccagataccacggaataaattgtgttgacacagtctccactcaccctgtcttgctcgagggaancgccaccctctcctgcgagggccagtcaggagttgaccaacacctaacgttgccgttaggttcacgactaagaacgccgtacggccgacggtcctacccggaggtccctccgtacagttcgtagtacggtactcgacctaccgtaccccgacggaccggacccgacggcctaaccgtcccgaacggtccgtaggttcgacggtcggtaccggtacggtccggggtacgtaacggggaacctacggtaccttccaccgtaccgttacccaacgtctacgaccgacgtaacgtaccgtaggacgttagttagtaaagtttcgtttaagcttttaaagttacttacgtacggtactacgggacgtacggggtaccggtataaccgggttccgggtaccgtcggttaacccgggttacgggggttaccgggggaacccggggtagttaacggggtacggttaaccgtaaaggaaccgttagggtcgacggtaccgcgtaactacccgttgttacccgtnttacccttacgtacccgtaccccgttcgaccgtttaacgg

SEQ ID NO: 284394 - DNA, 845 bp, Homo sapiens
  misc_feature: GYAE6OF01A02RV.14.57.F02.1.454.CMB.1.raw
tcagcgtctagtaccacgaccggtgctcgatttagctcgatatagttgggtttggggctgagagaggagcccagtcctgggatcttcaggtgttttcattttggtgatcaggactagaacagagagaactcaccagtggtagtttgggctgtagttggcttctttcttgtggtcttaattttaaaagatgtccaggtgtgaggtgtagtcgttggttgggacgggtccgggggaggtcgttacgggtacggacgggggtcccgggggggtcctagtaccgtacgtcctccgtcggtcgcgacgtccgtacgtacggttattaccgtttaagtttttaacggaacgttaaacttacttccgaccgtaggttaggacggttccggttccggggtacccgtaccgggtacgggtacccgtaccgggggaagggggaacggggtcggtagggtaccgggttggtacctacggaccgtacgtaagttacggtcgttacggtttacgtagggtacgtaaacgtaccgtacgttacggaccgtccggtcggtacggttaacgggtaccgggttccgttccctacgtacttccgacgtaaagtaccggaacttaacgtaacccgaaactaacttccttactttacgttactaacgtaacgtcggaactacgaccgtaacggaagaacgtaccggaacgggtagtttacggttacgttttaggttacgtaagggaacctaaattacggtaaacgttaacgttaacgtaacggttactaaaccggttacgttaacggggttacgggtaccgttaccgttacggttaggtcgggtaaccgggttaacgggaacggg

SEQ ID NO: 284395 - DNA, 786 bp, Homo sapiens
  misc_feature: GYAE6OF01DMXUK.14.57.F02.1.454.CMB.1.raw
  modified_base (744)..(744): a, c, t, g, unknown or other
  misc_feature (744)..(744): n is a, c, g, or t
  modified_base (751)..(751): a, c, t, g, unknown or other
  misc_feature (751)..(751): n is a, c, g, or t
tcagcgtctagtaccacgaccggtgctcgatttagctcgatatagttgggtttggggggaactgctcagttaggacccagagggaaccatggaagccccagctcagttctctccttcctcgtctactctcgcgtccacgatacaccgagaagtatgtgtacgacagtctaccacctcctacctcgttgtttcgttacgtcccgtaagggaaagggtaacgcccgtaccctaccttcccttcgcggacgggtaccgactacgagtaggtacgtacctaaccaaccgtaaccttaaccggtccgttacggtttacgtacgacgacgtaaggaccgtcgggaccgacgtaccgcccgtaccgtacgtccctgtaagattagtcgatcacctacacccgtacgaccggacccggaccgtacccacgtaccccacggacctacggttacggtacggacgtcggtaccgggtacggttacggggccaaacgggtactccctttaaacgtccaacccttctaacccgtactacgacggtaccgacgtaacgttaccgtagtaaccgttagttaacgtacgttttacgtttactaaaccggtttttatacgtttaccggttaggacggtcgttaacgggacggtaccggttattaccgggggcccctgtttacccgtacggggtaaccggggttacggggacgtaacgggtagtacgttaagaaccgtaagcggtactggactacccagttntccggtnttaccgttactacgtaccccttcgcttacgtacgg

SEQ ID NO: 284396 - DNA, 691 bp, Homo sapiens
  misc_feature: GYAE6OF01DUD5X.14.57.F02.1.454.CMB.1.raw
  modified_base (280)..(280): a, c, t, g, unknown or other
  misc_feature (280)..(280): n is a, c, g, or t
  modified_base (617)..(617): a, c, t, g, unknown or other
  misc_feature (617)..(617): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(633): a, c, t, g, unknown or other
  misc_feature (631)..(633): n is a, c, g, or t
  modified_base (637)..(637): a, c, t, g, unknown or other
  misc_feature (637)..(637): n is a, c, g, or t
  modified_base (644)..(644): a, c, t, g, unknown or other
  misc_feature (644)..(644): n is a, c, g, or t
  modified_base (648)..(649): a, c, t, g, unknown or other
  misc_feature (648)..(649): n is a, c, g, or t
  modified_base (655)..(656): a, c, t, g, unknown or other
  misc_feature (655)..(656): n is a, c, g, or t
  modified_base (659)..(659): a, c, t, g, unknown or other
  misc_feature (659)..(659): n is a, c, g, or t
  modified_base (661)..(662): a, c, t, g, unknown or other
  misc_feature (661)..(662): n is a, c, g, or t
  modified_base (668)..(669): a, c, t, g, unknown or other
  misc_feature (668)..(669): n is a, c, g, or t
  modified_base (671)..(672): a, c, t, g, unknown or other
  misc_feature (671)..(672): n is a, c, g, or t
  modified_base (674)..(674): a, c, t, g, unknown or other
  misc_feature (674)..(674): n is a, c, g, or t
  modified_base (677)..(678): a, c, t, g, unknown or other
  misc_feature (677)..(678): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (685)..(688): a, c, t, g, unknown or other
  misc_feature (685)..(688): n is a, c, g, or t
  modified_base (690)..(690): a, c, t, g, unknown or other
  misc_feature (690)..(690): n is a, c, g, or t
tcagcgtctagtaccacgaccggtgctcgattttagctcgatatagttgggtctcagcaatcagtggttctagtggaagtacattcgacgccgtctccgtgaagggccggttctccatctccagagacaattccaagaacactcttatttctcaaagtggacagcctagaaaagacgaagacgacgggtcgttgtttattttttggtaggtaacgaaaagtacgttaacggaagttctatacgaacttaacccgtaaggtttggggacgggttcctttanagttcgtcggtggggaccgaaagggtccgcgttcggtaccgtaccgttctttcgttccgaccgtccctacccgaaaccgtaccgggccctacgtcccggtttccccctacccccggtcggacccccacccccttcccgtaaccgaacgtacgacccccgtaccggttccgggcgggggtaccaaccggtaccggcccccgggtccccgtgggtcctccggtccggttacgggaacgtaaccgggttacccttacccgttaccgtacggaaccgtacggcgtaccgggacgggtcccgggtcggtaacgggacgtaaccgggccgtacgtaaggtacncgcagcgagngngnnngcgngacgcgngcgnngtgagnncgngnngcgagnngnncnacnngcntnannnngng

SEQ ID NO: 284397 - DNA, 647 bp, Homo sapiens
  misc_feature: GYAE6OF01EYS2Y.14.57.F02.1.454.CMB.1.raw
  modified_base (224)..(224): a, c, t, g, unknown or other
  misc_feature (224)..(224): n is a, c, g, or t
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (624)..(624): a, c, t, g, unknown or other
  misc_feature (624)..(624): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttcttgtggctattttaaaagatgtcagtgtgaggtgcagctgttggagtccgggggagcttggtacnggccggggggtcctgacaccgtntcctgtgcagcctcaggattctattttagcgaatatgccatgagctggcgcaggcnccgaggacgggctggagtcggctcgagcaatcgtatggttctaggtaggtaatcacgtttcgaccgtccgtacctccggtaggaacggtcccggttctacctacgtcctacccgagaacgtaacctaattacccgaacgtaaactaccttctttaacttttacgtacctaaagtcgggaactaacgtacccgttaggaaacgaccgaacggtacgtaccgggtcgtagttttaacgttttgaacgttggaaaacgtataacggtaggtactacgtaacggtacgtaacccgtaaagtttccgggggaaacggttcccttanaccggttgtccggttaacggggg

SEQ ID NO: 284398 - DNA, 983 bp, Homo sapiens
  misc_feature: GYAE6OF01CGET2.14.57.F02.1.454.CMB.1.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccatggagtttgggctgagttggcttctttcttgtggtcttaattttaaaagatgtccagtgtgaggtgcgagtcgtggttacgggacgggtccggggggagtcgttggtacggacgggtcccgggggggtccctgacncctctcctgtgcncgcctnaggtactttcttaagtttttacggacgtaattagcgacctagtggacggtccggttggggccccggccgtacgggcccgtaccgggaagggggaacgggggtcggttaggggtaacgggtttcgggtaccttacgaacgtacgtaaacgttcggtaagggtttacggttttaccggtaaagggttacggtaaaacgtttaaccgtaacgttacccgggtaccggttcccccggttacccgtacccggggttaacgggtaaacccgggggtttccccggtttacccgtaccccgttacgtttacccgtaacccgtaacgggaaccgtaaaccctaaacgtttaacccgaaacgtaaacccgttactttacccttttaactttttaccgtaaccgtaaaaggttccgggtaaaccctacggaacccgttaaagggaaaaccgggtaaaccgggaaaccgtaacccggggttaacgggggttaccgttttaggtttttaacgggtttttcgggtaaacgggtttaagtaaaaccggtaacgggttaaaaccggttaacggttaacgttttaaggtaaacccggtttaacccgttaaaaccccgggttttaaaggggttttaaccggggggggtccgggtttttaacccggtttccgttaaacgggttccggggtttccggggttaaaccccgggggg

SEQ ID NO: 284399 - DNA, 719 bp, Homo sapiens
  misc_feature: GYAE6OF01CGPB1.14.57.F02.1.454.CMB.1.raw
  modified_base (201)..(201): a, c, t, g, unknown or other
  misc_feature (201)..(201): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
  modified_base (366)..(366): a, c, t, g, unknown or other
  misc_feature (366)..(366): n is a, c, g, or t
  modified_base (405)..(405): a, c, t, g, unknown or other
  misc_feature (405)..(405): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtcctccgagggaaancgcccaccctctcctgcgngggtccagtcagngtgtacaacaccaattcgccttggttcagcaagaacgcctggaccaggcctaccgaggcctacctcattcggtatgaatcgactactcccacgacggcctaccggcacgtcccagccgtaggtcgagtgacgnggtcggtcgtacgggactagtcttcgactctaccaactntacgacgctacgtacctaagacgttaccgtagttaaggttacttttaggactttaagttttacttacgttacgtacgtacggtaccgttaacgggcgggtaaccgtaacggttccgggtacctaccggttaccggttaaccggggttacccgggggtacgggggtaaaccgttaacgggggttaacgggtaaccgttaaaccggtaaaccggtaacggttaggggtaccggtccgttagacccgttaaccgttaacgttccgtttaccgttacccgttaccttacccggtttccccttacccgtcgttaacccg

SEQ ID NO: 284400 - DNA, 734 bp, Homo sapiens
  misc_feature: GYAE6OF01BLK9E.14.57.F02.1.454.CMB.1.raw
  modified_base (294)..(294): a, c, t, g, unknown or other
  misc_feature (294)..(294): n is a, c, g, or t
  modified_base (710)..(710): a, c, t, g, unknown or other
  misc_feature (710)..(710): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttctgtggcttaattttaaagatgtccagtgtgaggtgcagctgttggacgtccgggggagtcgttggtacgacggccgggggtcctgaccactcctcctgtcgcagcctcgaggtacttctatttttacgactaatntcgccagtcgagcgttcgggtcccgacgcggtctaccggagggtacgggcgtagggtcggtggtcttacgagacagtaccgtaggttcggttactaggtacgggtaaataccgtagttaccgacggtcccttcgtacccggtaggtaaccggggtcccgttacgttcctacgtacctaccaggtaaccgaacgttaaacttaccgaaacgtaacctaaccttactttaaccttttaccttaaccgtaaagttaccggggaaacctacggttaccgtaaacggtaaaacggaacggaaacggtaacgggtacgggttaacgttggtttaacgttttagtaggtagtaaaactacgtaaccgtaagtaccttagttaacgtaccttaccgtaacggttacggggtaccgtccgtttanacggtttcggtccggtaaacgggg

SEQ ID NO: 284401 - DNA, 808 bp, Homo sapiens
  misc_feature: GYAE6OF01ESE61.14.57.F02.1.454.CMB.1.raw
tcagcgtctagtaccacgaccggtgctcgatttagctcgatatagttgggtttgggggaggaactgctcagttaggacccaggagggaaccatggaagccccagctcagcttctcttcctcctgctactctggctcccagataccaccggagaaattgtgttgacacagtctccactcaccctgtctttgtctaccgaaggggaaagacgccaccctctcctggcgacgggccagtcagtagtgtaccaaccaacctaacgttacgccgttcgggtttacacggacaacggaacgtcccgtcggacccgaacggccctaccccgagggtcccttcctcgtatcgtatggtatcggactaccgtcccgaacggacgggcccgaccggcactcccgacggccgtaggttcgaggtcggacgtcgggcgggttcgtacggggactacggttaccctttccgaaccttaccctaccgtaaccctagtcccgaacggtccgtaaccggttcccgttaaacggttaacccgttagtttaaaccgggtaaagtttaccgtttttacggtacttttaaacggttttactttacggttacgttaacgtacgggtaccggtacgggtaccggggttacttaacgggtttcccgaaccggttcccgttaacggggtttaccggggttaccgggggggaaccgggggtaacgttaacggggggtcgtaaccggttaacggaaaccgttacggttacgggtacgtcgacggtcctaactaccgttctacggttacctacttaccgttccctcccggtaacg

SEQ ID NO: 284402 - DNA, 737 bp, Homo sapiens
  misc_feature: GYAE6OF01AZJX7.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaangccaccctctcctgcacgggccagtcagagtcgtacaacaccaacttagccttggtttcagcagacgccgtggccacggcctcccgaggcctccctcagttgtatgatcgcactcccgacgacgggcccaccggccacgtccccacggtcccgtaggtttccgaggtcggacgacggggtcggggtacgtcggggaacctacggtaccttaccgaccttccgtaccaccctacgttccaacgaccgtacgtaccgttaacggtacggtacgtaacggttaacgtttacgttttacgtaaccgtttaagttttacttaacgttcggtacgtacggtaccggacggggtcgggtacgtaacggttccggcccggtccgttacgggttaccgggtttccggggaccgggggtaacggtaacgggtcgggtaacggttaaccgaaacggtaccggttcgggtacggtacgtaccggtaccgtaaccgtacgttccgttacgttaccgtttaccgtaccctttccccgttcccggtaccc

SEQ ID NO: 284403 - DNA, 689 bp, Homo sapiens
  misc_feature: GYAE6OF01CCUF9.14.57.F02.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (653)..(653): a, c, t, g, unknown or other
  misc_feature (653)..(653): n is a, c, g, or t
tcagcgtctagtaccacgaccggtgctcgatttagctcgatatagttggggtttggggggaactgctcagttaggaccagagggaaccatggaagcccagctcagcttctcttcctcctgctactctggctccagataccacggagtaaattgtgttgacacagtctcactcacctgttctttgtctcgagggaancgccacctctcngcgacgggcagtcagagtcgtacaaacgtacctaacgttacgtccttaggtttacaggacgtaacggaacgccgtggaccacgggtcctcccggaggtcctacctatagtgtatgacgtcgaccacgtacccgacgaccgggacccgaccggtcaccgtacccgacgtcgtacggttacgaggttcggacggacggtcggggtctacgggactacgtctacgtcgtacacgacataccagactacgctaacggtattacgtaagtacgtttactttacggaattttaggtttaacttaggaccgtagaacgcggtacgggtacgggtaactacgttcggcccgttaagtccccgggttaagggttcccgggggacgggtaactaggggtacggttaacgtaaccggaaaggtccgtagggtcggaccttagactcgttacggttntaccggttctacggttcttacccgtcccagttaccg

SEQ ID NO: 284404 - DNA, 761 bp, Homo sapiens
  misc_feature: GYAE6OF01BHE5A.14.57.F02.1.454.CMB.1.raw
tcagcgtctagtaccacgaccggtgctcgatttagctcgatatagttgggtttggggaggaactgctcagttaggacccaggagggaaccatggaacgccccagctcagcttctcttcctctgctactctggctccagactaccaccggagtaaattgtgttgacacagtctccactcaccttgttctttgtcctacggaaggggaaacacgccctacccttctccgtgcgacgggcctagtcgaggtagtcgtaccaaaccgtaacctaacgttacgccgttaggtttacagacaacggacgtccgtcggccacggtcctaccgacggtcctctacgtagttcgtagtcgtagtccgaccttaccggacccgaaccgggaccggacccgaccggacctaccgtacccgacggtaccggttaacggttcgacggtcggacggacggtcgggtacggtacgggactacggtaccttcgactcctactacctacgaccgtacgactcgtacgtaacggtcgttacgtaagttacgtttacgtttactacgtttaagtttacttacggtacggtacgaacggtacggtacgggtaccgggattaaccgggtcccggaccgttaccgttccggggttaccggggttacggggaacccgggttagtaacgggtacggaacttaacggacgttacggttcggacgttccgaacggtcttaccgtcgttcgtttccgtacgtaaccgttccttacccgggttcctacg

SEQ ID NO: 284405 - DNA, 796 bp, Homo sapiens
  misc_feature: GYAE6OF01CYD4V.14.57.F02.1.454.CMB.1.raw
  modified_base (116)..(116): a, c, t, g, unknown or other
  misc_feature (116)..(116): n is a, c, g, or t
  modified_base (147)..(147): a, c, t, g, unknown or other
  misc_feature (147)..(147): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (712)..(712): a, c, t, g, unknown or other
  misc_feature (712)..(712): n is a, c, g, or t
tcagcgtctagtaccacgaccggtgctcgatttagctcgatatagttgggtttgggggaactgctcagttaggacccagagggaaccatggaagccccagctcagcttctcttccncctgctactctggctcccagataccacgganaattgtgttgacacagtctccactcaccctgtctttgctcgagggaancgccacctctcncgcacgggccagtcagtactgtaccaaaccacctaacgttacgtccgttacgtttcgacgcgaaggaacgtccgtacggaccgaacggtcccttaccccgacggtaccctccctacgtacgttacgtagtcggtactacggaccttacctacccgacggacccggggaccccaccgggtacctaaccgtccccggaaggtacccgtacgggttaccacgggtacggacctacggggtcggtcgtaagggacctacgtaccgttccactaccctacaccgtatccgacgtacgcgtaaccgtgtcgttacgtacgtaagttttccgttcgtaacgtttagttttacgtacttcggtaacctacgggcggtaaccggggtccggtattaaccgggttcccggtacccgtaccggttttaaccggtacccgggggtttaccggggggtacgggttaaaccgggtaacgggttacgggtaaacggttaaacccgaaaggtttcccgggnggttacccgggaaccgttccgaaaccgtaaaccgttcgttacgttcgttacccgtaacttccgttaccccgttccgtactaccg

SEQ ID NO: 284406 - DNA, 983 bp, Homo sapiens
  misc_feature: GYAE6OF01BM7SE.14.57.F02.1.454.CMB.1.raw
tcagcgtctagtaccacgaccggtgctcgatttagctcgatatagttgggtttggggctgagagaggagcccagtcctgggatcttcaggttgttttcatttggtgatcaggactgaacagagagaactcacctagtggtagtttgggctgtaggttggtctttctttcgttggtggtacttaaattttaaaaagattcgtaccgtaggttggtggtagggttcgacgtaggtccgttgggttggggtacggggtcccggggggtagttccggtttacgggtaccggtacgggggtccccggggggtccctggaaccctaccgtccgttccgtggtccgccgtacgtcctacgtagttactttacttaagtttttacgaacgtaagttacgtacgtaccgtagtcggtacgtccgggttcccgggtacccggtaccggaaccggtccgggtaaccgggaagggggggtacgggtacggtaggggtacgggttacgggttaccgacgtaacgtaacgtaagtttcggtaggtttccggtttaggtaagggttaacggtaacgttacgttaccggttaccggtccgtaccccggtttcgggtaccgggtaacgggttcccggttacccgttcctaccgtacgttcccgaaccgtaaagtaaccgtaacttaaaccctaaccgaaaccgttaaccctttaaccttttaacgtttaaccttttaccgtaaacgaaacggttaccgtaacgtaacgtaacccggtaaaggtaaacggtaaaccggtaaccggaacgggttacgggtttaacggttttagtttccggttttaaggtaggtaaaaacggttaacggtaaacgtttaaaccggtagttaaaccgttaacgtaccggttttaaaacccgtaacgggttttaaacgggggttaccggttacgggtttaaccctttagggttacggttccggggttaaccggggtaacccgggg

SEQ ID NO: 284407 - DNA, 548 bp, Homo sapiens
  misc_feature: GYAE6OF01AIH24.14.57.F02.1.454.CMB.1.raw
  modified_base (480)..(480): a, c, t, g, unknown or other
  misc_feature (480)..(480): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattcatttttagcgaatatgccatgagctgggtccgccaggctccgagggaaggggctgggagtgggtctcgagcaatcagtggttctagtggaagtacattcgagcccgtctccgtgaagggccgttctccatctccagacgacaattccaagaacactctatttctacaatggacagccgtagaaacgacgaagacacgggctgtattttgngtgaaagtatacgaagtctagtgactacccaagtttcgggacgggttcctttacgatgtcgtacgggg

SEQ ID NO: 284408 - DNA, 691 bp, Homo sapiens
  misc_feature: GYAE6OF01ERFNV.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagatacccaccggagaaattgtgttgacacagtctccactcaccctgtctttgtctccgagggaagngcccaccctctcctgcaggccagtcagagtgtacaaccaccaacttagccttggtttcagcagaagcctggccaggcctcccaggctcctcatgtatgatgcactccacgacggcccaccggccactccccgagtcccgtaggttcgaggtcggacgtacgggccggggttcgtacggggactacggtaccctttacgacctccgtaccacccgtataccgtacgacctacggtaccctaaggtagtaccgtaggtaacgttagttttcgtacgttaagttttacgttcgttacgttccgagtccgtacgggtccgggtaacgtagtttccggccgttaccgttaccgttaccgggtttccgggggaccgggggtaacctaaggggtacggttaacggtaaccggtaaaccggttacgcggtacggtcgtacgtacctaccgtagttccgttacgtttccttacgtacctttcccgtcccggtcctacg

SEQ ID NO: 284409 - DNA, 910 bp, Homo sapiens
  misc_feature: GYAE6OF01DC6JR.14.57.F02.1.454.CMB.1.raw
tcagcgtctagtaccacgaccggtgctcgatttagctcgatatagttgggtttggggaggaactgctcagttaggacccagagggaaccagtggaacgcccccagctcagtcttcctccttcctcctcgtctactctcggcctcccagactaccgaccggaagtaattggtgttacgacacctacgtcctccactcctacccttgttccgtttcgccgttaccgaagggggaaacgaccgccctaccctcgtcgtacgcgacgggccagtgagagtcgtacaacgtaacctacgttagtccgttggttacacgacgaacgacgtccggtacggcccgtaacggtccgtaccgtacgtcccgtacctaccgtagtaggttaacgtcgtaacgtaccgaacctaccgaaccccggtacggaacccggggccccgtaaccccggtaccgtaaccccgttacccccgaacggttaccccggttaagggttaccgacggtacgggacccgggtacggggtaccgggttcgggaccggtaacctaaccggtaccctttccgtacctaccctaaccgtacgtacctaccgaggtaccctacggttaaccgtacgggtaagtttacggtaacgttagtttaacgtttctttaaccggtttacgttttaactacgaccgtttaacgggagtacccgggtaacggggtacgttaaaccggttcggtacccgtccgggtttaacccgtttccgggtaccgggggttaaacccggggtgggtaaaccgggtaacggttaaccgttaaaccggtacgggttaaacgtaacggtccgggttaacgaacccggttaacctccgttaccgggtaacctttcggttaacccgtttcgacccctttagtttccccccggtctacccgg

SEQ ID NO: 284410 - DNA, 832 bp, Homo sapiens
  misc_feature: GYAE6OF01BYZVT.14.57.F02.1.454.CMB.1.raw
  modified_base (200)..(200): a, c, t, g, unknown or other
  misc_feature (200)..(200): n is a, c, g, or t
  modified_base (824)..(824): a, c, t, g, unknown or other
  misc_feature (824)..(824): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaggggaanacgccaccctctcctgcagggccagtcagagtgtacaaacacctaacttacgccttggttcagcagaacgcctggccaggcctcccgaggcctcctctatgtatgacgtcgaccactaccccgaacgacggggcccgacccggaccaacgtccccgaagcccggtaaacggttccaagggttcggacgacgggtccggggttacgtacgggggaacctacggttacccgtttaccaacccgttaccgtaccctaaacccgtaagttaccccgaaacggtacccgtaaccgggtaccccgttaagggttaacccggtttaccggttaaccggggttaaaagtttaacgtttttttacgggaaccgttttaaacgggtttttaacgttttaaccgttacgttaccggttaacggtacggtaaccggggtaccggggttaaccgtaacgggtttccggggtacccggttaccgttaccggttacccggggtttaccgggggtaacccggggggtaacggtaacggggttacgggtaacggttaaccgaaacggtacgttacgggtcggtccgtacggacctaccgtagttccttcggttactttactaaccgtttcccttaccccgngttaaccg

SEQ ID NO: 284411 - DNA, 760 bp, Homo sapiens
  misc_feature: GYAE6OF01BO62S.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaattgtgttgacacagtctccactcaccctgttctttgtcctccgaaggggaagcgcccacccttctccgtgcgacgggccagtcaggagttcgtaccaaaccaaccgtaacttacgtccgttggttacaggaccaaggaacgtcccgtgggtacccgacgggtccctaccccgacggtcctacctcgtaagttcgtaagtcgatgccacgtaccccgaaggccgggtaccccgaccggcctaccgtaccccgaggtacccgttaggttccgaagggtccggtacggacgggtcggggtacgtaggggaaccctacgtaccctttccgaccgttcctaccgaacctgacccgtacgacctacgtacgttaggtaacgtacgtaagttaacgttagttttacgtactttaagtttacttaccgttgtaccgtagtccgtactaccggtaactaccgggtccttccgtaccgtcggtccgttacgttccggtaccgggttacgggaccgggtacgggacggtaacgggttagaacggttaacgtaaccggtaaacggttcgtgggtaccggtacgtaccgtacgtctaaccggttctttacgtttcccgtaac

SEQ ID NO: 284412 - DNA, 764 bp, Homo sapiens
  misc_feature: GYAE6OF01CXAED.14.57.F02.1.454.CMB.1.raw
  modified_base (146)..(146): a, c, t, g, unknown or other
  misc_feature (146)..(146): n is a, c, g, or t
  modified_base (184)..(184): a, c, t, g, unknown or other
  misc_feature (184)..(184): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccagtggtagttggntgagttgtcttctttcttgtgacttaaagttttaaagntgtaccagtggtaggtggtgactgtcgttggttagggacggtccgggggagttcgtcggtaacggcggggtccgggggtcctgacctcgtctcgtgcgactcgccgtacgtaggttactttcgttaagttttacgacgttaatagcggtactagtggtacggtcggtcccggccgacggtaacggtccgaaccggtaggggacggtgtacgggngttcggtaacngacgtaacgtagtcgttaagttcggttagtaagggtaagtacttaacgtcgtaccggacgttcccgttacgaccgggttaggtacccgggttccgttccaacctcgtaccgaccgtaagaactaacgtaactaaccaaacgtacctacttacttacttactaagtaagtacgaacacgtaacgttaacggaaaccgtaaacgacggtaaaccgggtcgtttacgttaaggttttacgttaggtaaacgtaagttaaacgaagtttaacgtaaggttccaaggtaacttaccgttaaacggttagggtttacggttacccggttatttaccgaggttccgggaagggtacccgggg

SEQ ID NO: 284413 - DNA, 761 bp, Homo sapiens
  misc_feature: GYAE6OF01EC5EX.14.57.F02.1.454.CMB.1.raw
  modified_base (184)..(184): a, c, t, g, unknown or other
  misc_feature (184)..(184): n is a, c, g, or t
  modified_base (419)..(419): a, c, t, g, unknown or other
  misc_feature (419)..(419): n is a, c, g, or t
  modified_base (638)..(638): a, c, t, g, unknown or other
  misc_feature (638)..(638): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggtagtttgggctgagttggcttctttcttgtggtctaagttttaaaagntcgtaccagtgtaggaggtgacgagtcgttgggttgggaacggggttcccggggggaaggtccgttttacggaaccgacgggggtcccgggggggttacccctcggaaccaccttcctccgtggtcgacctacggtcctacggaggtactttatttagtttttacgagtaatatcgacagtacgagtcggtaccgggtccgcgacggtacgtaccggggaggggaaccgggtcgnggggttacggtcgggtacctacgagtacgtaatccgtaaggttcggttagtaggtacggtaagtacgttacgtccggaacgtcccgtacgtacgggtaggacccgggttactccgtacacttcgtacgaggataacgtactaaccaagtaactcctattttactttacaacgagtacggaactacgtacgtaagaaacgtacgaacgtaggaacggttnttacgtttagtttacgtaggaacgtaacgtagtaccggtaagttcgtaagtacgtaaaccgttaaccgttagggttaacgggtccgtttaacccttgaaccggttggtcccggggtaaacggg

SEQ ID NO: 284414 - DNA, 804 bp, Homo sapiens
  misc_feature: GYAE6OF01A9SUP.14.57.F02.1.454.CMB.1.raw
  modified_base (182)..(182): a, c, t, g, unknown or other
  misc_feature (182)..(182): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaaagntgtccagtgtgaggtgcagctggttgggaggtccgggggagcgtttggtacgacgggccggggggtcctgactacctctccgtgtgcacgcctcgaggtattcttatttttagacgtaatatcgccagtgacgtcgtcgggtcccgaccgacggccgtaccggaaggggggaaggggtcgtaggggtacgggtcgggtacctacgagacgtaacgtccgtaaggttcggtttacgtaggtaagggaacgttacctacggttaccgaccggtcccgttccgtaccgggtacgggtaaccggggttccccggttaccgtcccgtacttcccgtaccggaacggtaccgtaaaccctaaacttaacccgtaaaccgtaaacgttaccctttacgtttaaccttttaccgttaaacgtaaacgtccggaacctacggtaacccgttaaggaaaacggaacggtaaacgggaacccgtacggggttaccgtttagtttaacggttttagtaggtaaacggtaaaggtaactaacgggtaattacgttaatacgtaacccgtaaacggttacgggtttacgggggtaacggttcccgtttagacggttcggttcgggtaacccggggg

SEQ ID NO: 284415 - DNA, 852 bp, Homo sapiens
  misc_feature: GYAE6OF01DZIY5.14.57.F02.1.454.CMB.1.raw
  modified_base (147)..(147): a, c, t, g, unknown or other
  misc_feature (147)..(147): n is a, c, g, or t
  modified_base (196)..(196): a, c, t, g, unknown or other
  misc_feature (196)..(196): n is a, c, g, or t
tcagcgtctagtaccacgaccggtgctcgatttagctcgatatagttgggtttggggggaactgctcagttaggacccagagggaaccatggaagcccagctcagcttctcttctcctgctactctggctccagataccaccggaanaattgtgttgacacagtctccactctacctgtctttgctcgaagggaangcccacctctccgtgcgacggcagtcgagtacgtgtaccaaacgtacctaaacgttacgtccgttaggtttaccagtacgaacgtaacggtccgtgggacccgaaggtccctacccggaacggtccttaccgtactagttacggttatacggtactcggtacctaccgtaccccggaacgggtaccgggtacccgtaccgggtacccaaccgttaccccgaacggtaacccgttacgggttaccgtaagggtcgggtaaccgtccgggtacgggttacggtacgggaaccgtacggtaccttacctacgttccacctaacctaacgtcgtaaccgacgtaccgtacgtaggtaccggtacgtaacgttagtttaacgttgtaactttaaggttttaccgttaagtcgttaaccggcggtaccggtacggggtcgttaacgttacggtttaccgggcccttcggtttaaccggtacggggggtttaaccgggacgggggttaaacccggtaagggttccgggtaaaaccgtttaaccggtaaaacggggttccggtgggttaaccggtccggttaccgaacccggttacggttaccgttcgtttacccgttacggttaccccttacccggttttcccctaacggtccgtttaaaccg

SEQ ID NO: 284416 - DNA, 884 bp, Homo sapiens
  misc_feature: GYAE6OF01DW4ML.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctcggcctccagactacccgacggaagtaattggttgttgacactacgtcctccacctcctacccgttgttctttcgtccgtaccggaaggggaaacgccgcccctacccttcctccgtcggaccggacgggcccaggtacaaggtacgttacgtaccaaaccgtaacccgttaacgttaccggtacccgtttcggttaccgacggaccgaacggtaaccggtcccggtaccgggacccgtaaccggtaccccgtaccccggaaccggtcccttacccgtacgtaagttcgttagtacggtacgtaccggtacctacccggtacccgaccgggacccggtaccccgaaccggtaccctaccgtaccccggaaccggtacccggttacgggtaccggtacgggtacggaccgggtacgggtccggggtacgtacgggtaccgtacgttacccgttaccctaccgttaccctacccgtacacgtaccgacgtaccgacgtacgtacgtactacggttaagtacgttttacttagtacgtttagtttaacgttcgacgtacggacgtaccgggtagggtacccggtacgtacgttccgggaccgttaccggttaccgggttaccggggggttacccgggggaacggggttactaaggggttacgttaaccggaaccggtaagtcgggttaggaccgtcgacgtaccgtcgtttacccgtgtttccgtaccttaccgttaccctccccgttcgccgttacg

SEQ ID NO: 284417 - DNA, 905 bp, Homo sapiens
  misc_feature: GYAE6OF01C332I.14.57.F02.1.454.CMB.1.raw
tcagcgtctagtaccacgaccggtgctcgatttagctcgatatagttgggtttgggctgagagaggagcccagtcctgggatcttcaggttgttttcatttggtgatcaggactagaacagagagaactcaccagtggtaggtttggctgtagttggtcttcttttcgttgtggtacttaaatttttaaaagatcgtccagttgtgtaggtgcagtcgttggtgggtacgggtccgggggtaggtcggttaggtacggacggggtcccggggggttccctagacctaccgtccgttccgtcgtacgccgcgtaccgtagtagttaactttgtttagttttacggactaaaagttcgtaccgacctagttacggacggtccggttacccggggtcccgtacccggtacgggtacccggtacggggaacgggggtaagggtccggttaaggggtacgggttccgggttccgtaacgtacggtaagtaacggttacgttagggtttaccggtttacgttacgggtaaacggttaaacgttccgtaacgtttacccggcggttaccccggttcggtttaacccgggtacgggttaacccgggttttcccccgtttccgtaacccgtaccgtttaccccggtaaccgaaaccggttaaacgtaaaccttaaaccccgttaacccgtaaaacgttaaacccttaccttttacgtttaaacttttaaccgtaaacgtaacgttacggaacgttcgaaacgtaacgaaacgtaaccgaacggtacggtacggttagtttacgtttagtttggaagtaagtaaagtaccgtaagtactacgtagtaacgttaacgtaacggttaggttaccggggtacgtttcgttaggtacgtttgggtccggtaacccgggg

SEQ ID NO: 284418 - DNA, 672 bp, Homo sapiens
  misc_feature: GYAE6OF01CW96W.14.57.F02.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (306)..(306): a, c, t, g, unknown or other
  misc_feature (306)..(306): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (358)..(358): a, c, t, g, unknown or other
  misc_feature (358)..(358): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcacagtggtagttggctgagtcggctgtcgtaggtgactaattaagntgtcgngngtgaggtcatgtcgtggtggaggcgggggatgtaggcgacgggccggggtcagcnctcgtctnagcgcacggtctagtatcgttnttaacgnaatggcagtncgnggtcgtcggcgctcggncggtaagggtggcttgggtaagcggtaaccngaactagtagnggtacggttntaagttacggtagtaacgtctccgtaccgggactcccggttacggtaccggtaacggttaccgttcctaccgtcctaccgtaacgacgtaacggaacgtaaactaacctaacgaactaccgtaccgttaacttattaacgtaacgtacgtacgaagtaacgtacgtaaaggaaacgaacgtacggacgttacggttagtttgttaagttacggtaaggtaacgtaagtaaagtaccgttaagtacgtaaccgttaagttaacgttaacggttagggttacggttacgtagttacttcggtaccggaacggtggg

SEQ ID NO: 284419 - DNA, 943 bp, Homo sapiens
  misc_feature: GYAE6OF01A1LHR.14.57.F02.1.454.CMB.1.raw
  modified_base (156)..(156): a, c, t, g, unknown or other
  misc_feature (156)..(156): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
tcagcgtctagtaccacgaccggtgctcgatttagctcgatatagttgggtttgggctgagagaggagcccagtcctgggatcttcaggtgttttctatttggtgtatcaggactgaacagagagaactcaccatggagtttggctgagtggcttntttcttgtgctattttaaagatntcagtgtgacggtnacgagtctggttgggacggtccggggggaggtcgtttagggtacgacgggggtcccgggggggttcccgttacgaaccgttccgtccgtttcctgggtacgccgtaagtcccctggaaggtacttttactagttttttacggaccgttaaatagttacgtacctaagtggtaaggttcccggtacggggtccccggtaccgtaaccgggccgttaccgggaaacgggggaacgggggttacgttacggggaggttcggggttacttccggaaggtactaacgtacgttaacggttcggttacgttaaggttacggtaaacgttaacgttaaccgttccggaaccgtcccggtttaacgttaccgggtacggggtaaaccgggttccccgggttttacgttacccctaggttacctacccggttaacggaacggttaacttaaaccccggttaacggtaaaaccaaccgtttaacttacccggtttaacctttttaacgtaacctaaacggtacgtaaactaccggtaaaccgttaacggaaaacgtaaaccgggttaaccgaacccgggtaacggggtttacgtttaacggtttaacgtttttaacggtcgggtaaaaagtaaacgtaaccggtttaaaggttaaacggtacctttaaggttaaccgtaaacgttaaaccccgtttagggggttaccggttcggggtttaacctttaggttaaaccggtggttaacccgggtaccggggg

SEQ ID NO: 284420 - DNA, 919 bp, Homo sapiens
  misc_feature: GYAE6OF01BGPW4.14.57.F02.1.454.CMB.1.raw
tcagcgtctagtaccacgaccggtgctcgatttagctcgatatagttgggtttgggtgcccaagctgctggagggcacggtcaccacgctgctgagggagcttggtacaggccgggggggtccctgacactctcctgtgcagcctcaggattctatttttagacgtaatatagccatgagtcgtcgggtacccgccggaggccgtccggagggggaaacggggcgtgggaacggtcgggtctacgaggtaccaaattcggtaaggttggttacgttaaggtaggggaacttaactagttaccggaccggtccgttcgtaccggtaggaacggggtcccggttcctaccgcttaccgtaccgaggtaaacgtaactaacgttaacccaaacgtaaactacctttacgtttaattttacccgttaacgaaaggtaccggtaacgtaacggtccgtaaaggaaaaccggaaaccggaaagggtaaccgaacgggttcgtttaacggttttaagttttaggtaaggtaacgaaaagtacgtaaaacggttaacgtacttaagtaacgtaaaccgtaaacccgttaagggttttacggggaaccggggttacccgtttacgttaacggtcgtacgggttacggggaccggtaacgggtacggccgtacggttaccctaccggttccgttacgttacccgaacgtccccgtaacccgaaacccggtaccgggaacccttaccggttacccggtttacccttcccccccggtacggtcccctaccccgttacccgtaacccgtaacgtaccggtacccgtaacccgtccgggttacccggggacctaaccgggaacccggtccgggacccccggttcggtacgtcccggttaaccggttacgtaaaccgggtaacggttaaccccg

SEQ ID NO: 284421 - DNA, 771 bp, Homo sapiens
  misc_feature: GYAE6OF01BWIA3.14.57.F02.1.454.CMB.1.raw
  modified_base (194)..(194): a, c, t, g, unknown or other
  misc_feature (194)..(194): n is a, c, g, or t
tcagcgtctagtaccacgaccggtgctcgatttagctcgatatagttgggtttgggggggaactgctcagttaggacccagagggaaccatggaagccccagctcagcttctcttcctctgctactctggctccagataccacggagtaattgtgttgacacagtctcactcacctgtcttgctcgaagggaancgccacctctcctgcgaggtccagtcaggagtgtacaaacgacctaacttacgccgttaggttacagcaagaacgccgtcggacctaggcctacccgaggcctacctctaagtcgtaacttggaactcggaccaccgtcccgaacggtacggaccctaccggctaaccgtcccgaacgccgggttaaaggttccgaagggttccggcgaacggggtccggtacggtaccgggaattacggaccttacgaccttactacgtaaccaggtacccaacggtccaaggtcccgtaagggcttagtaagtaacgtttacttaggacgtttaatttaacgttacgtcgtaacgtaaccggttcgaacgggttcggaacgtttaaacggttccggggaacccttcgttacccggggttaacgggtttcccgggggaaccggggtttaaacgacggggtttaaccgggtaacttaaaccggtaaaaccggttaccgttagggtccgtaacccgggtacgtaccaaacggtttaccgttgttaacccgttattaccggtaaccttcccgttccccgggcttaacgg

SEQ ID NO: 284422 - DNA, 729 bp, Homo sapiens
  misc_feature: GYAE6OF01BV71P.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctggttgggaggtccgggggaggtcgttgggtacgacgggcccgggggggtcctagaccactcctccgtgtgcacgcctcaggtattctatttttagcgtaatatgaccagtcggagtcgtcgggtcccgaccgacggtcctccgaggggaaggggcgtagggacggtgggtctacgacgactaaagtcgaggttacggtttacctaggttaacgggaacgttactacgtttaccggaccgtccgtccgtaccgggtaggtaaccggggtcccggtttcctacctaacgttccgtaccgtaacgacggtaaaccttaaaccttaaccgaaacgtaaacctaaccgttctttaacgttttcttacgtaaagtcggaactacgaccgtaagaaacgacggaaacgtacggacggttcgttagtttaggtttcgtaggtagtaaagtacgtaaggtaacgtatagtacgtaaccttaaccgtaagggtttacggggacggttacctttacgtacggttggtcgggtaacgggg

SEQ ID NO: 284423 - DNA, 826 bp, Homo sapiens
  misc_feature: GYAE6OF01DTGBW.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagactaccaccgggagaaattgtgttgacacagtctccactccacctgtctttgtctcgaggggaacncgccaccctctcctgcgacgggcctaggtacagtagtcgtaccaacgtacctaaccttgccctttggttcacgtacagaacgccgtaggccgacggtcccttacccgacgggttccttccgtacgtactagttacgtacgtacgttacggtcctaaccgttacccggaacggacccggggtccccgaaccggtacctaacccgttccccggaaccggtacccgttaacggggttcccgtaagggtccgggtaccggtaacggggtccggggttacggtacgggggaaaccttacgggtttaaaccgttcctaaaccccgtttccgaacccgtaaacccctacggtaaccgggtacctaaccgggttaccgttaaccccgggtaggttaccggttaacgtacggtttaaagtttacggttttaactaaccggttttagttttaacgttcgttaccggtcgtaaccggtacggtacgggtaccgggttaactacgggtcggtacccgtacgtcggttacgggtccggggtaccggggtacgtaagggtcgtaacgttaccgaaagtcgtaggacgtcgtcgtactcctagtcgttcgttacttcgtacctcccgttccgtctcg

SEQ ID NO: 284424 - DNA, 915 bp, Homo sapiens
  misc_feature: GYAE6OF01AUCYX.14.57.F02.1.454.CMB.1.raw
  modified_base (245)..(245): a, c, t, g, unknown or other
  misc_feature (245)..(245): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactccacccttgttctttgcgtccgaaggggaaagacgcccacccgtctccgtggcgagggcccagtcgaaggngttacgtacaaccgtaacctaacgttacgtccgtttagggttttcaaggtccgaaaggtaaaccggtcccgttacgggaccccgtaacgggtccccttaccccggaacgggtcccttacccttacgtagttacggtaatacggaacgtcggtacctaaccgtacccgacggaccgggacccgtaccggactccgtacccgacggtaccgtacggtacgtacggtcggacggtaggtccgggtacgtacggaaccgtacgtaccttacgaccttaccgtacctaaccaccgttacgacgtacccgtacggttaccctaaggtaccgttacggtaacggttaaagtttaaccgttttacgggtaaccgttttaagttttaacgtttacgttaccgggtacgtaacggtaccggtaacgggtacggggtaaccgttaacgggtttcccggaaccggttacccgttacgggtttaacccgggggtttccgggggaaaccccggggggttaaggttaaccggggttacggttaaaccggtaaccggggtaaaccgttaccggtttaagggacccgggttcgtaacccgggttacgggaaccctttacggttccgtttaccggttttacctaccccggttttacgttccccggttacccgtccggtttaacccggg

SEQ ID NO: 284425 - DNA, 650 bp, Homo sapiens
  misc_feature: GYAE6OF01B1QJC.14.57.F02.1.454.CMB.1.raw
  modified_base (256)..(256): a, c, t, g, unknown or other
  misc_feature (256)..(256): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
tcagcgtctagtaccacgaccggtgctcgatttagctcgatatagttgggtttgggggtccagtgtgaggtgcagctgttggagtccgggggaggcttggtacagccggggggtccctgacactctcctgtgcagcctcaggattcatttttagcgaatatgccatgagctgggtccgccaggctccgagggaaggggctggagtgggtctcagcaatcagtggttctagtggaatacattcgacgccgtctccgngagggccgttnccatctcaganacaatcaagacactctatttctacaagtgacagcctagaaagacgaagacgacggcgttagttagtttttggtagtaggaaagtagtaacgtaagttctaatacggaacttaacccgtaaggtttcggggaacggggttcctttacgtattcggttacgtacggggtaccgaaaggggccgtcgttcggtacctaccgttctcttccgacgtccctaccgacccgacggccctagtcccggtccgttccccgtggacctacccctccgtaccgacgtacgacctaccgtcggtcggggcaccggacggccggcccgtgggcctcggaccgtggtaacgacggtaccttaccgttcccgtacgtcggtaccgg

SEQ ID NO: 284426 - DNA, 960 bp, Homo sapiens
  misc_feature: GYAE6OF01DC70K.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttcttttcttgtggtcttaattttaaaagatgtccagtgtgaggtgcagctggttggagggtccgggggaggtcgttggtacgacgggcccgggggggttccctcgaccacctcctccgtggtcgcgacgcctacgtaggttactttactttaagttttttacgaacggtaaattactacgtaccctagtcggtacggtccggttcgggggtacccccggacccggacgggtacccgtaaccgggggaaggggggtaacgggggtccggtaggggtacggggttcgggttaccgttaccgaacgtaccgtaagttacggtaacggtttcgggttttaacggttaacgggtaaacgggttaaaacggttaaccgtaacggttttacccggaacccggttcccccggtttcccggttaccgggtacccgggggttaacgggggtttcccccgtttaccgttaccctaacgttcccctaccgaaacggtaacgtaaacctaaacggttaacccaaaacggtaaaccttaaccttacttttaaccttttaaccgttaaacgtaaacggttacggtaacccgacggttaaccgtaaacgggaaaaaccggaacggtaaacgggaccggttaacggggttaccgttttaggtttttagtttttagggtaacgttaaaggtaaacggtaaacgttaaacggtaacgtttaaacgttaaagtaacgtttaaaccgttaaacccggtttagggtttaaccggggtacgggtttaccctttaggtaccggttccgggttaccgggtaaccgggggg

SEQ ID NO: 284427 - DNA, 730 bp, Homo sapiens
  misc_feature: GYAE6OF01BAEX2.14.57.F02.1.454.CMB.1.raw
  modified_base (201)..(201): a, c, t, g, unknown or other
  misc_feature (201)..(201): n is a, c, g, or t
  modified_base (362)..(362): a, c, t, g, unknown or other
  misc_feature (362)..(362): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgagggaagngccaccctctcctgcagggccagtcagagtgtacaacaccaacttagcctggttcagcagaagccgtgccaggcctcccgaggtcctcctcatgtatgtatgaccacgtcccgacgaccgggcccaccggctacgtaccccgaacgtcccgtaaggttcgngggtacggcggacggtccggggttacgtcgggaacgtacgtaccctttcgaccgttcctaccaacctagtccgacgaccgaacgtacccgtaaggttacgtacgtaaggttaagtttacgttttacggtacgtttaagttttaaaccttcgttacggtacgtaacgtcgggtaacggcggggttaacgttacgggttcggccccgttaccgttacccggttaccgggtttaccggggggaccggggttaacgtaagggggttacgtaacggttaaaccgaaacggttaccgttgggtaacggtccgtagtaccgtaccgttattccgttacggttccttacgtaccgttcccttaccccgtcgtaacg

SEQ ID NO: 284428 - DNA, 1098 bp, Homo sapiens
  misc_feature: GYAE6OF01B3F9N.14.57.F02.1.454.CMB.1.raw
  modified_base (188)..(188): a, c, t, g, unknown or other
  misc_feature (188)..(188): n is a, c, g, or t
  modified_base (351)..(351): a, c, t, g, unknown or other
  misc_feature (351)..(351): n is a, c, g, or t
tcagcgtctagtaccacgaccggtgctcgatttagctcgatataggttgggtttgggggaggaactgctcagttaggacccagagggaaccatggaagccccagctcagcttctcttcctcctgcttactcgtcggccttacccgagtactacccgaaccgggtagaaatttggtggttagacctacncggttcctcccaccttcctaaccccgttgtttccgttttcgtcccgtaccgggaagggggtaaaacgtccgacccctcccttcgtcccgtggccgacggcccgtacggtcaagggagttccaaccaacctaaacccgttacgttacgccgtttacgggttacncgaacgtaagaaccggcggttaccggcgtaccggcctaccgcggtacctccgtaccgtatttcggtacgtggtactccggtcaaccttccccggaaccggtccggcccccgaaccggaccgttaccccgaccccggacgtaacccggtcgggtttacgaccgggttacggccgggttcgggtaccggggtacgggtacgggtcgtaaccgttacccgttaccggtcccttacccgttacccgaaccttccggaactaacggtcccccgtaacggtaccgttaaaacggggtccctttaacggtttaaccgggttaaaccggttttaggtttaccggttttaaacgttttacccgtttttaaacggggttaacccttcggtttacccggtaaccccggggaggggtttaaaccccgggggtaacggggtttacccgttaaacgggggttttcccggggttaaacccccgggtttcccgggttttaacccccgggggttaccgggggtttccccggggggggggttaaaccccggggtaaagggggttttaaccggggaaccggggggtttaaaccccgggtttaaacggtaaacccggggtttaacccggggtttaccgggtttaacgggtaacccgggtttacccggaacccgggtttaacccgtttaacggttttcccgggtttccccgggtttaccgttttaaaccccggttccccttttcccccggggtaaaccctttccccgg

SEQ ID NO: 284429 - DNA, 800 bp, Homo sapiens
  misc_feature: GYAE6OF01EL3FT.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtcctccactcaccctgttctttgtctacgaaggggaanacgccaccctctcctgcgacggcacgtcgagtagtcgtacaacctaacctaacgttacgtccgttcggtttacgacgacgtaaggaaccgtccgtaccgggaccgacggtcccgtacccgacggtccttcctactagtagttagtacggtagtcgtaccctaaccgtaccccgaacggacccggggaccccgaccggaccgtaccgtccccgaacggtcccgtaagggtacgtaacggtcggacggtacgggtcgggtacggtaacgggacgtacggttacttaccgtacctactacccacgtactaccgtacgaccgtaccgtacgttagacgttacgtaaggtaaagtttcgtttacgtacgttttaagtttacttacggttacgtacggtacggttacggacgggtacgggtacttaacgggtccggaccgtccggttaccgggttacccggggtttcgggggacccggggtaacgggttacggggtacgttaaccggtaacgtaaaccggtacggtccgggtacgtacgtacgtcccgtacgttaccgttcgtttactacccgtttactacccggttccttcccggtaacg

SEQ ID NO: 284430 - DNA, 773 bp, Homo sapiens
  misc_feature: GYAE6OF01D066Q.14.57.F02.1.454.CMB.1.raw
  modified_base (134)..(134): a, c, t, g, unknown or other
  misc_feature (134)..(134): n is a, c, g, or t
  modified_base (202)..(202): a, c, t, g, unknown or other
  misc_feature (202)..(202): n is a, c, g, or t
  modified_base (411)..(411): a, c, t, g, unknown or other
  misc_feature (411)..(411): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccngtggagtttgggctgagttggcttctttcttggtggtactaattttaaaagatgtacagtgtgaggtntcagtcgtggtggacgggtccgggggaggtcgttagggtaccggtcgggggtcccggggggttcccctaggacctaccttccgttaccgtcgtacgcgactccgttacgaaggttactttactttaagttttacgaccgttaatacgtcgactaggtgacgtaccggtcggtcgaccgtggaccgtcggaacgggggaggcggttaggnggggtcgtactacggactacgtacgtacgtcgggttgttaccgtaaggtaggtactaacgtcgtaccggcccgtccgtccgtaccgggtacggtaccgggtcccgtactcgtactccgtacgaaagactaacctaacttaaccaactacctacgttactttcttaaccgtaatacggtagtacgacgtacgtaaagaaccggaacaacggtaccggtaccggttagttttacggtttagttttgtaacccggtaaagtaacgtaacttaacgggtattaccgttaaataaccggtaaacgttaacgttaacggggtaccgggtagggtttaccctaggacgtttgggttcccgggaacgggg

SEQ ID NO: 284431 - DNA, 567 bp, Homo sapiens
  misc_feature: GYAE6OF01B5IWM.14.57.F02.1.454.CMB.1.raw
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (526)..(530): a, c, t, g, unknown or other
  misc_feature (526)..(530): n is a, c, g, or t
  modified_base (532)..(532): a, c, t, g, unknown or other
  misc_feature (532)..(532): n is a, c, g, or t
  modified_base (534)..(536): a, c, t, g, unknown or other
  misc_feature (534)..(536): n is a, c, g, or t
  modified_base (538)..(567): a, c, t, g, unknown or other
  misc_feature (538)..(567): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctagaaagacgaagacgacgggcgtgttattttttgtgtagaaagatacgaagtctatgactacccaagtttggggagggtccttttcatgtcgtggggacccgaagggaccgcgtggtccaccgttcttccttcgacgccctcccaccgaacgggcccacgttccggtccctttccccccgtcggcccaccccctccctacccgaacgacgacccaccgttcggtcgggggaccaccggacggcccgggcccgtggggtcctcggccgtggtaccgaacggtaccttaccgttaccggtacgtacgacgtcgtggacgggccggtcggtcgggacgaacgggccgtacgagcgncnacgncnnnnngncnnncnnnnnnnnnnnnnnnnnnnnnnnnnnnnnn

SEQ ID NO: 284432 - DNA, 1068 bp, Homo sapiens
  misc_feature: GYAE6OF01CTXMV.14.57.F02.1.454.CMB.1.raw
  modified_base (311)..(311): a, c, t, g, unknown or other
  misc_feature (311)..(311): n is a, c, g, or t
tcagcgtctagtaccacgaccggtgctcgatttagctcgatatagttgggtttggggctgagagaggagcccagtcctgggatcttcaggtgttttcattttggtgatcaggactagaacagagagaactcaccatggtagtttgggctgtagttggtcttcttttcttggtcgtactttaaattttaaaacgattcgtccaaggtgtaggtaggtgacgagtcgttggttcgggtacgggtccgggggagtcgttacggtacggacggggtcccggggggtcctacgactacctccttccgtgtcgaccncgtccgtagtaaggttacttaccgtttagttttacgaacgttaagttactcgtaccgtaggtacgacggttccggtaccgggttaccccggaccgtaccgggttacccggtaacccggggggtaacgggggggtaagggtccgggtttaggggaggggtttacccggtaccgtacggtaacgtaccgttaacgtacgggttaacggtttttcggttaaacggttaagggtaacggttaacgttttacccgtaacggttttccgggtaaccccggttccgggttaccccgttttacggggtaacccgggggtttaaccggttcccccccggttttacgtaaccccgtcgtttaaccccgaaccggtaaccggttaactaaacccgttaaaccccgtttaaacccggtaaaccgtaaaacccttttactttaacccgtttttaaccgtttttaaaccgaaccgttttaaaacgggtaccggtaaacccgttacggtaaacccggtaaaaggtaaacccgggaaaccggttaaacccggtaacggggtttaccggggttttaccgttttaaagttttttccgggttttaggaaacgggtttaaaccgtaaagttacggttaaaacgttaacggtttaaactccgggtttaaaaccttaaacccgggttttaaacccggttttaaagggggtcccggggtttaacggttaaccgttttacggttaaccggggttccgggtaaccggggttaaccccggggg

SEQ ID NO: 284433 - DNA, 823 bp, Homo sapiens
  misc_feature: GYAE6OF01D7719.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgttctttgtctccgaaggggaaancgtcccaccctctcctggcagggccagtcagagtcgtacaacgaccaacttacgtccttggtttcacgacgaagaacggtccgtcgggcccgaacggtcccgtccccgacggacccttcccttacgaattggttatacggtatcgacctaactccccgaacggaccggggtacccggaccgaccgtactaccccgacggtaccggtacgggtttacgcgggttaccggaccggtaggggtccgggggttaccgtaacgggggaacccgtaacggttacccttaccggtaacctttaccctacccgaacccgtaacttaccggacgacccgtacgttaaccccgtaagggttacggttaacgttagttaaagtttacgtttttggtaacctttaagttttaccgttacgtttacgacgtacggaccgtaacggggcgggaactttacgggttccgcccggttacgtaccggtttaccgggggttccgggggacgggggtaaaccggtggggttacggtaccggtaaacgtaaacggtcggtggttaacgccggttcgacctacccggtaagtttccgagttttccctacgttaacccgtttccccgtccggcctttacgg

SEQ ID NO: 284434 - DNA, 621 bp, Homo sapiens
  misc_feature: GYAE6OF01BH2BY.14.57.F02.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (400)..(400): a, c, t, g, unknown or other
  misc_feature (400)..(400): n is a, c, g, or t
tcagcgtctagtaccacgaccggtgctcgatttagctcgatatagttggggtttggggaggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcgacgggccagtcagngtgtcaacaccaacttacgcctggtttaccagcgagaacgccgtggaccacggcctcccgaggcctacctcagtgtatgactgacactcccagacgggccacggcacncccacgcgtagtcaggtcgngacggcggtacgcggacacgtacttcgactccacaaccnctcacgtcacgacctagacgtcgtagtaagttacgtttgacttaagtttacttacgttcgttacgagcgtacgggacgggtcgtaagtccggtacctcggttaccgtaccgggtttccggggaccgggggtacgtacgggtaggtacgtaacgtaaacgtacgttggtcggcgacgtcgacctagtcttcgttactttccgtacttcccgttcccggtacc

SEQ ID NO: 284435 - DNA, 768 bp, Homo sapiens
  misc_feature: GYAE6OF01A14VV.14.57.F02.1.454.CMB.1.raw
  modified_base (207)..(207): a, c, t, g, unknown or other
  misc_feature (207)..(207): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagactaccaccggagaaattgtgttgaacacagtcctccactcaccctgttctttgctccgaaggggaanacgcccaccctctcctgccgacgggccagtcagagtcgtacaaaccacctaacttacgccgttggtttacacgactaagacgccgtcggaccacggcctccgacggtccttacctcgtagttacgtacgtgtaacgttcgacctaaccgtccccggaaccggaaccgggtccctaccggacctaccgaccggaccgtaccgtacggtttcgacgtacgggcgacgggtccgggtagtacgggacgtacgtacgttacctacgtaccgtccctaaccgtagtacccgaacttaccggaccgtacgttaaggtaccgttacgtaaggttaacgtttacgtttagacctttttaagtttactttacccgtgttaccgaagtcggtacgggcggtaacgtcggtaccgtccgtcgtaaccggttcgggttaccgggggacggtacggtaggtaccggtaagtaaccggtaaacgtacggttcggtactacccgtacggtacccttaccgttacgtaccggttttacttcccgtaaccgttaccctttcccgttaaccccggttag

SEQ ID NO: 284436 - DNA, 865 bp, Homo sapiens
  misc_feature: GYAE6OF01BUI5P.14.57.F02.1.454.CMB.1.raw
tcagcgtctagtaccacgaccggtgctcgatttagctcgatatagttggggtttgggggggaactgctcagttaggacccagagggaaccatggaagccccagctcacgcttctcttcctcctgctactctggctccagataccacggagaattgtgttgacacagtctccactccacctcgttctttcgtcctaccggaaggggaaacgacgccctacccttcctcctcgacgacgggaccagtacagagtagtaccaaccaaccctaacttacgtccgttggtttacacggacgaacgaacgtccgtcggacccgtacggcccgtacccgacggtcctacctactagttgtacgtagtacgtcgacctacccgtacccggaaccggaccggggaccccggaacccggtcccgtaacccgtaccccggtaccggtaccccggttaacgggttaccggtacgggtcgggaccggtacggggtccggggttacgggtacgggtaccgtacgtacccttccgtacccgtcctacccgtacccgtaactacggaacgtaccgtaaccgtaccggttaaggtaccgttacgttaagggttaacttttacggtttacgtacgttttacgttttaacgttacgtcgtcgggtacgtacgggtacgggtcgggttaataccgggttcccggtacccttccggtaaccggggttaccgggggttacccgggggggagggggttaaacccgtaggggttaaccgggtacccttaaaacggggtaacggtttcggtcgggtaccggtccgtacggacccgtacttacggtccgtttaccttccttacggttaccccttccccggtagtccgtaag

SEQ ID NO: 284437 - DNA, 868 bp, Homo sapiens
  misc_feature: GYAE6OF01A5WTD.14.57.F02.1.454.CMB.1.raw
  modified_base (151)..(151): a, c, t, g, unknown or other
  misc_feature (151)..(151): n is a, c, g, or t
  modified_base (317)..(317): a, c, t, g, unknown or other
  misc_feature (317)..(317): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctgctcccagactaccaccgganaattgtgttgacacagtctccactcacctgtctttgtctcgagggaagcgccaccctctcctgcgacggccagtcagagtgtacaacacctaacgttcgtaccgttggtttacagaccgaagaacgccgtcggtacccgacggtccgtacccgacggtcctccctntacgtcgtagtaggacgttcgacctaccgtaccccgacggaccgggacccgaacccgggtaccaccgtaccccgacggtaccgtaacgggttaccgacggtacggggctacggggccgggttacgtcgggaacctacggtaccttaccacccgtttacccgacctaaacccgtacgttaccgacgtaccgtaccgtaaccgtaaccggtacgttaaccggttaaaggttaacggtttaacgttttacgttaaaccgtttaccgtttttaacgtttacgttaacggtacccgtaaggtacgggtacccggggtaaccgggttaccgttaacgggttcggggtaaccccttccggttaccggttacccggggttttaccggggggaaccggggggttaaccggttaggggttaccgggttaaacgggtttaaacccggtaaaccgggtaaacggttcgggtaaccggttccggtaaccggtacccgttaaacgttcccggtttacgttaccggtttaccttacgttaccccgtttccccggttacccgtaccg

SEQ ID NO: 284438 - DNA, 786 bp, Homo sapiens
  misc_feature: GYAE6OF01C982M.14.57.F02.1.454.CMB.1.raw
  modified_base (148)..(148): a, c, t, g, unknown or other
  misc_feature (148)..(148): n is a, c, g, or t
  modified_base (212)..(212): a, c, t, g, unknown or other
  misc_feature (212)..(212): n is a, c, g, or t
  modified_base (385)..(385): a, c, t, g, unknown or other
  misc_feature (385)..(385): n is a, c, g, or t
  modified_base (770)..(770): a, c, t, g, unknown or other
  misc_feature (770)..(770): n is a, c, g, or t
tcagcgtctagtaccacgaccggtgctcgatttagctcgatatagttgggtttgggggaactgctcagttaggacccagaggaccatggaacgcccagctcagcttctcttcctcctagctactctggcctaccagataccacggganaaattgtcgttgactacagtctccatccacctgtctttggctacaggggaaaccgtccaccctntaccgtgccgaaggcccaggtccaaggacgtacgtaccaaaacctacccgtaaattacggtccttaggtttacacgacaaggaaacgtcccgtaggaccacggccttcccgaaggttcctccgtactagttcgtaagtcaatggaccagttaccccagacgggaccaccggtnactccgaacgcgtacgtacgagtcggacgaggttccggtactaaggggaacctacggtcctttaaccggaccttttaccacggaaacctcgttaaccggaacgtcgaaccggtaactacgggaacgtttaccgttaagtaaacggttacttttggaactttaacggttttactaacgtcggtacgaagtccggtaacggggtagggacccttaaagggtcccgggaccctccggtttaaaccggtaccggggtttaccgggggaccggggtaaccgttaagggggttacccgaacggtttaaaacccggttaaaacggaaccgtttgggacggtaccctagggaccctaaaccgtagttacgtcttaacctaacgtccgtttccnccccgtaattaaccgg

SEQ ID NO: 284439 - DNA, 937 bp, Homo sapiens
  misc_feature: GYAE6OF01C82WL.14.57.F02.1.454.CMB.1.raw
  modified_base (176)..(176): a, c, t, g, unknown or other
  misc_feature (176)..(176): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcacatggagttggctgagttggcttctttcttgtgcttaatttaaagntgtcagtgtgaggtgcagtcgtgttggacggtccgggggagtcgttggtacggcggggcccggggggtcctagacctaccttcgtccgtggtcgcgacgtcctacgtacggtatttactttaagttttacgacgtaaacttatcgacctaagtcggtacgtccggttccgggtaccccgccgtacgggaccgtaccgggaacgggggtaacggggtcggttagggtacgggttcgggtccgtaacgtacggaaccgttaacgtcggttacggttacgggttttacgtaacgggtttaaacgggtaaccgttaccgtaacgttacccgggacccgtaccccgggtttacccgttccggggtaaacggttaacccgggggttcccccgtttacgttaacccgttacgttccccgtaacggtaaaccggtaaccgtaaaaccgttaacccctttaaaaccgaaaaccgtaaccgtttaaccctttaccgttttaaacttttaaccgaaaccggttaaaggtacccggttaacaaaccggttacccgtaaagggaaaacccggtaggaaacccggttaccgggtaacccggggttttagtttacgggttttttaagtttttgggaaacggtaaacgggtttaaacgaccggttttaaagacgtttaacgtaacttaccggttaaacctttaaacccggggttaagggtttccgggggttaactttacccgtttaggcggttacgggttacccggggtaaccgggg

SEQ ID NO: 284440 - DNA, 681 bp, Homo sapiens
  misc_feature: GYAE6OF01CC1ZD.14.57.F02.1.454.CMB.1.raw
  modified_base (204)..(204): a, c, t, g, unknown or other
  misc_feature (204)..(204): n is a, c, g, or t
  modified_base (361)..(361): a, c, t, g, unknown or other
  misc_feature (361)..(361): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctcgaaggggaaagngcccaccctctcctgccgacgggcccgtacagtaggtcgtaccaaaccaacctaaacgttacgtccgttagggttttaccaagtccaaggaacggtccgtacgggccaacggtcctccccgaacggtccttcctctaagtgtaatcgatcgcctacncccacgacgggcccaaccggcacgtcccgacgaccgtacggttcaggtcggcgagggtccgggtcgtaggggaactacggtacctacgaccttcgtaccaccgtactcgagcctagaccgtagtacgttactaagtaagtacgtttgtacgttaagtttacgttactcgtacgacggacgtaggacgggtacaacgttcggcctacgtcgtacgggttcggggacgggtacgtaagggtgtaacgtaacgaacgtacgtggtcgtcgtacgacgtactcggtacttcggtcctttacgaccttcccgttccgtccgtacg

SEQ ID NO: 284441 - DNA, 727 bp, Homo sapiens
  misc_feature: GYAE6OF01CYWRN.14.57.F02.1.454.CMB.1.raw
  modified_base (199)..(199): a, c, t, g, unknown or other
  misc_feature (199)..(199): n is a, c, g, or t
  modified_base (294)..(294): a, c, t, g, unknown or other
  misc_feature (294)..(294): n is a, c, g, or t
  modified_base (337)..(337): a, c, t, g, unknown or other
  misc_feature (337)..(337): n is a, c, g, or t
  modified_base (460)..(460): a, c, t, g, unknown or other
  misc_feature (460)..(460): n is a, c, g, or t
tcagcgtctagtaccacgaccggtgctcgatttagctcgatatagttgggtttggggggaactgctcagttaggacccagagggaaccatggaagcccagctcagcttctcttcctcctgctactctggctcccagataccaccggagaaattgtgttgacacagtctccactcacctgtctttgtctccaggggaaancgccaccctctctgcgagggccagtcagagtgtacaacacctaacttagccttaggttcagcagagcctggccaggcctacccgaggtcctcctnactgtactgatcgctactcccaacgcgggacccaccggctacnccccgagccgtaggttccaggtcggacacggtcgggtcgtaggggactacgtacttccgaaccttccgacacctacgtcgaacgcctacggaccttaaggtacgttcgttaaggtaacgtttntttttaccggactttaagttttacgttacgtgttaccgacgtacggtacggggtaccgggtacttaacgggtttccgggacccgtccgtttaccgggttacccgggggttttccgggggggaacccggggttaaccggtaggggttacgggttaaccgttaaaccggaaaccgggtaggttcgggttacgggacccttgaacccgttacctacgtttcgtacgtttacctttacggtacccgtttccctttacccccgcgtttaacg

SEQ ID NO: 284442 - DNA, 740 bp, Homo sapiens
  misc_feature: GYAE6OF01B9RMG.14.57.F02.1.454.CMB.1.raw
  modified_base (444)..(444): a, c, t, g, unknown or other
  misc_feature (444)..(444): n is a, c, g, or t
  modified_base (688)..(688): a, c, t, g, unknown or other
  misc_feature (688)..(688): n is a, c, g, or t
  modified_base (732)..(732): a, c, t, g, unknown or other
  misc_feature (732)..(732): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctgctccagataccacggataattgtgtgacacagtctccactccacccttgttctttgtctaccgaggggaagacgccaccctctcctgcgaggccagtcaagtagtgaccaacaccaacttcgacgttgttacagacagacgtcctcggaccgacggtcctccgacggtccctcctacagttgttatgagtcacctacgtcccacggaccggcccgaaccggtcctacctcccgacggtccgtacggttaccgaggtcggacggtacgggcgggtcgtacgggacgtacgtaccttaccacctccaccctaactacncgaacctaccgacgtaccgtaggttaacgttgtaacgggttaactttagttttaaccggtgtttaacgttttaactaccgggacgtttaccgaacggtccggtaaccggggtcggggttaacttaccggggtttcggtccccgtaaccggtttcgggtaacccggggtttccggggggaaccgggtaaccgtaaggggttcgtaaacggtaaccgaacggttaggtcgtacggtctaacgtacncccttatccgttacgtaccctttcgaccgtttcccgttacccgnttaccggg

SEQ ID NO: 284443 - DNA, 907 bp, Homo sapiens
  misc_feature: GYAE6OF01E5KWN.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggcttctttcttggtggacttaattttaaaagagtgtccagtgtggaggtgcagtcgttggttgggagggtccggggggagtcgttacgggtacgacggggcccgggggggtcctagacctaccgtctccgtgtcgaccacgtcctacgaggtactttaccttagtttttacgacggtaaacttatcgacctaagtcggacggtccggtccggggttaccggaccgaacgggtccgtaaccgggaagggggtaggggtcgtaacggggtcggttcgggtacctacgagtaacctaagtcggttaggggtttacggttaggttaaggtacgggaacgttaactaccgttaccgggacgtcccggtttacgtccgggtacggtaaccgggtcccgtttactacccgtatcccgtaacgaacggtaacgaaccttaaccgttaaaccgtaacgtaaccttaacccgtttacctttaattttaacccgttaaagtaaaaccgggttccggaaccctaaccgggtacccgtaaagggaaaaccgtaaccggggaaacggtaaccggggttaacggggtttacgttttaggttttaaccggttttaggtaaggtaaacggttaaacggttaaacgtaaacgttaaccggttacttaaccggtaacggttaaaccccgttaaacggggtttaacgggttttacggggggttaccccttaccggttaagtaaccggtttcgggggtaacccgggttaaccggggg

SEQ ID NO: 284444 - DNA, 909 bp, Homo sapiens
  misc_feature: GYAE6OF01E5DOW.14.57.F02.1.454.CMB.1.raw
  modified_base (360)..(360): a, c, t, g, unknown or other
  misc_feature (360)..(360): n is a, c, g, or t
tcagcgtctagtaccacgaccggtgctcgatttagctcgatatagttggggtttgggggggaactgctcagttaggacccagagggaaccagtggaagccccagctcagcttctcttcctcctgcctactctcggcctcccagaatacccaccggtaataaattggtgttagacacagtcctaccacttccaccctgtctttgcctaccgaaggggaacacgcccaccctctcctgcgtacggaccagtcagacgtctaccaacacctactacgtccttggttcacgtacgaagacgccgtacggaccgtaccggtaccctacccggacggtccgttccctacgtaagttaccggtaagngtacgtcgaccgtaccacccgaccgggtaccggcccgaaccggtacctaacccgccccgtaacggccgtaggtaccgtacggacgccggtacggggtacccgggttggaaccgggaccgttaaaccgtccgtacccttaccgtaccttacccggtaacctaacggttccgaacggtcccgtaaccggttaccgtaaacggttacctaacgttaaggttaccggttttacgttttacggttaacgttttaactttaccgttaccgttacggttaacggacggtaccggttaaccggggaccggtttaaacccggtcgggttaccccggtcccgggttcccggttacccggggttaacccggggggtttacccgggggtaaaccggggggtaaccggttaaggggtaacccggtaaccggttaaaacggtaaaccccgggtacggttacggtcccggggtcgttaccctaacgttacccgggtaacttttccggttaccggtttcccttaacccgttacccgttacccccgtttacccgtccccgttaacg

SEQ ID NO: 284445 - DNA, 738 bp, Homo sapiens
  misc_feature: GYAE6OF01ENDUY.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccacggagaattgtgttgacacagtctccactccaccttgttctttgtctaccgaaggggaagcgccctacctctcctgcgacgggcctagtcagagttcgtaccaacaacctaacttacgtccttggttcagtcaagacgcctggccgaggtcctacccgaggtcctcctacgattacgtagtcgacgttcgacctacgtaccccgacgggaccggtccccgaccggacctacccgtcccgaacggtaccgttacggttaccgtagggtccggtacgaccgggtcggtacgtacgggaacgtacggtacccttaccgtaccttccgtaccaccgtaacttaccgacgtaccgtaactaccggtagtactacgtagtaaagtttcgttagtacctttaagtttactagtacgtacgacgtcgtacgggtccgtacgacggttcggcccttaccgggttaccttaccgggggttccggggaggggtaacccgtaaggggtacggtaaccgtaacgtaaacgggtcggtggtaccggtcgtaacctcggtaacgtcgtttgtacctttaccgttactttaccgttcccgactgttaccgg

SEQ ID NO: 284446 - DNA, 865 bp, Homo sapiens
  misc_feature: GYAE6OF01C7ZZW.14.57.F02.1.454.CMB.1.raw
  modified_base (173)..(173): a, c, t, g, unknown or other
  misc_feature (173)..(173): n is a, c, g, or t
tcagcgtctagtaccacgaccggtgctcgatttagctcgatatagttgggttggggaggaactgctcagttaggacccaggacgggaaccagtggaacgccccagctcagcttctccttcctcctgtctactctggcctccagactacgaccggtagtaattgtgtagacacngtcctccactcctaccgttgttctttcgtcgtaccggaaggggaaacgcgccctaccctctccgtcggccgacgggctacgtcgaagtacggtaccgtacgaaacctacctaacgttacggtccgttacggttacgaagaccgagaccggtccgcgggccacggccctccggacggtcctttaccctaggtacttggtactagttaccgactcctaacccgacccggaacggtcccgggacccgaaccctccgtaacccttcccggaaccggttcccggtagggttcccggaggtaccggggtccggtaccgggggttaccgggtacggtacggggaaccctttcggtaacccttcgtaaccctttcccgaaaccgtacccgtaagtaccgttaccgggaacgtacccgttacgtacggttaacgttacggttaacgttacgtttacgtttacgttacggtttaacgttttcgtaacgttcgtaacggacggtacggacgggttacggaaccggttcggtaccgggtacctcgggttacccgggttacgggggtacgggtaacggggtaaccgttacggggaacggtaacggttacggtaacggtcggttaccgttacgggacctacggtaccctacgggttacctttcggttaacccgttcttacccgttaccgtttcccgccggtttacg

SEQ ID NO: 284447 - DNA, 788 bp, Homo sapiens
  misc_feature: GYAE6OF01CLONS.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgctccgagggaagcgccacctctcctgcgacgggcccagtcaggacgtcgtacaaccgacctaacgttacgccgttggtttcagcgtaggaacgtccgtcggaccacggcctcccgaggtcctcctcgacttgtatcgagtcgccacgtcccaacggacgggtccccaaccgggtccaccgtcccacggcccgtaggttacgaggtcggcgtacggccgggtcgtacgggaacacgtaccttacgacctccgtacctaaccgtactccgagaccgacgtacgttaggacgttacgtaacgtagtttacttttacggacttttaagttttccgtaacgttacggtactacggacgggtaccggtaccggggtacgtaaaccgggtttggaccccgttaacgttcccggttaaccgggggttttaccggggggaccgggggttaaacccgttaaggggttacgttaaacggttacccggaaaacggttaccggtagggtacggttaccggtaccggttaaccccgtccgtttaacggttcccttaccggtttacccgtttaccgtaacccttttccccgggtaccccggttacccttaaccggg

SEQ ID NO: 284448 - DNA, 736 bp, Homo sapiens
  misc_feature: GYAE6OF01DSA71.14.57.F02.1.454.CMB.1.raw
  modified_base (348)..(348): a, c, t, g, unknown or other
  misc_feature (348)..(348): n is a, c, g, or t
tcagcgtctagtaccacgaccggtgctcgatttagctcgatatagttgggtttggggctgagagaggagcccagtcctgggatcttcgaggtgttttcatttggtgatcaggactgaacagagagaactcaccatggagtttgggactgagttggcttctttcttgtggtctattttaaaagatgtccagtgtgaggtgcagctggttaggacggtccgggggagtcgttggtacgacgggtcccggggggtccctagaccgtaccttcgtccgtgtcgcacgtcctacgtaggtattacctagttttacgacgtaactagtcgactagtcgacgtcgtacgggtccncgtaggtccgtaccggaggggtaacggggtcgtggtacggtcggttacctacgagacgtaacgtcgtacggtttaggttacgtagtacggtaacgtaacgtcgttacgaccggtacccgttcgtaccggtaggaaaccgggttcccgtacgtacctagttcccaccgtaacgtaccgtaaactaaacgtttaccgaaaagtacctaccgtttacttaacgtttactaaccgtaaagtcggaactaaccgacgtaagaaacgacggtaacgtacgggaccggttattacggtttacgtttaggaacgtaacgtaagtacgttaagaacttcgtagtacgtaaactacgttaggtaacgggtccgtagtttgtacgtcgtcggtaacggg

SEQ ID NO: 284449 - DNA, 788 bp, Homo sapiens
  misc_feature: GYAE6OF01DD1EK.14.57.F02.1.454.CMB.1.raw
  modified_base (743)..(743): a, c, t, g, unknown or other
  misc_feature (743)..(743): n is a, c, g, or t
  modified_base (754)..(754): a, c, t, g, unknown or other
  misc_feature (754)..(754): n is a, c, g, or t
  modified_base (783)..(783): a, c, t, g, unknown or other
  misc_feature (783)..(783): n is a, c, g, or t
tcagcgtctagtaccacgaccggtgctcgatttagctcgatatagttgggtttggggggaactgctcagttaggacccagagggaaccatggaagccccagctcagcttctcttcctcctgctctctggctcccagatacccaccggagaaattgtgttagacacagtcctcctacctccaccccgtgttcctttcgtctaccggaaggggaaacgaccgccctacccctcttcctcggccgacgggccctagtacgaagtagtacgtaaccaaaccgtaaccctaacgttacgtccgtttacggtttacacgtacgaaggtaaccgtccgtacggacccggaccggtccctaccccggacggttcccttcctacgtagttacgttactacgtagtccgtaacctaccgtacccgaccggaacccgggcccgtacccggtaccctacccgtaccccgtaaccggtacccggtacggttaccggtacgggtaccggaccggtcggggttacccgggtacgggaacggtacccgtaccgtttacccttacccggtaaccttacccggtaaccctaccgtactaccgaacgtccgaaccgttacgtagtcgtaacggttagtaacgtttattcgtaagtttacctttacgttacgtgtacgcgtcgggacgtccggtatacgcgtacacggttccgacgggtcggggacggtacgacggtagacgtaacgtacgcgtggacgctanaccgttacgtntcgtaccttactcgtaccttccgtcccgntaccg

SEQ ID NO: 284450 - DNA, 748 bp, Homo sapiens
  misc_feature: GYAE6OF01B651L.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactccaccctgttctttgtcctccgaaggggaaagcgcccaccctctcctgcgacgggccagtcagagttcgtacaaccaacctaacttacgccttggttccagcgaagaacgccgtaggaccacggccctcccgacggccttacctcacgttgtaatgactcgcctacgtacccgacgaccgggcccaccggcctaccgtacccacggccgtaggttcgaggtcgaccgaggtccggtagtacggactacgtccttaccaccgttcctaccaaccgtactaccgaccggtacaacgttaccgtacgtacggttacgtaaggttaaacgtttagttttcggtaagtttaagttttacgttacgtcgttaccgacggtacggtagggaccgggtaacgttacggttccggaccgttaccgtccggtttaccggggttaccggggacggggtaaccgtaaggggtaccgtaacggtaaacgaaacgtaggttcgggtacgtcggtacccgacgttacccgtgttacccgtttaccgttacgtttacccgtaaccgtttccccgttcccgtaccgttacg

SEQ ID NO: 284451 - DNA, 764 bp, Homo sapiens
  misc_feature: GYAE6OF01CK66P.14.57.F02.1.454.CMB.1.raw
  modified_base (163)..(163): a, c, t, g, unknown or other
  misc_feature (163)..(163): n is a, c, g, or t
  modified_base (186)..(186): a, c, t, g, unknown or other
  misc_feature (186)..(186): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccagtggagtttgggctgtagttggcttctttnttgtggtacttaattttaaaagntgtccagtgtgaggtgcagtcgtggttgggacggtccgggggagtcgttaggtaccggacggggtcccggggggttccctacggacctaccttccgttccgttaggtcgaccgacgtcccgtagtaggttactttagtttaacgttttacgaacgttaattacgtcgtaccgtagtacggcggtccggttaccggacccgtaccgaggtacccggtacgggacggggtaacgggtcggtagggtggttcgtctacgacgtaactacgtgtacgttacggttactaagggtacgtaacgtacgtacgtaccgcgtccgtcgtacggacggtacggttccactcactcacgaagactactaataccgaagtaacctcgttacttacgttacgtaaacgacggtcgaaccgacgtaacgtaacggaaagtaacccggtaaggtaccggtacgggtttacgtttagtttagttacgagggtaaattaccgtaaagtcgtaacgttgtaacggtaacttaccggttacggttaagggttccgggtacgtttacccttagtaccggtgttccgggggtaaaccg

SEQ ID NO: 284452 - DNA, 661 bp, Homo sapiens
  misc_feature: GYAE6OF01BM82D.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaaggggaaagacgcccaccctctcctgcgacgggccagtcagagtgtacaacaccaacttagcctggttcagcagacgctggccaggcctcccaggctcctcatgtatgatcgcactcccgacgacgggcccaccggcactccccgaaggcccgtaggttccaggtcggccgaggtccggggtctacgggggacacggtaccttccgaactcctaccaccatccgagccaggcctaaggcgtacgtaggaagttctttggacttaacgttttagttacgtggttaccagtacggagggtcgggactaagggttccggaccgtcctacgggttacccggtttacggggggaccggggttaacggaagggttaccggtaacggttaccgaaacggtacgtggttacgggcttcgggacctaccgtcgttcccgtacgttccttaccgagtttaccccttccgacttaccg

SEQ ID NO: 284453 - DNA, 901 bp, Homo sapiens
  misc_feature: GYAE6OF01DSQSO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactagaacagagagaactcaccagtgggtaggtttgggactgtaggttggtccttcgttttcttggtcggtacttaaagttttaaaaagatcgtccaggtggtgaggttgcgaggtcgttggttagggtacgggttccgggggaggtcgttaggtacggacggggcccgggggtccctagaaccgtctccttccgtgtcgaccgcgccgtacgtaaggtactttacgttagtttttacgaaccgtaatacgtcactaacgttcggacggttccggtccggggtacccgaccggtacgggtaccggtaccggggtaacgggggacggggtacggttgggacggtttaccgggtctacgaacgtacgtaacgtcgggtaggtttaggtttaccggtaggtaacgtacggttaacgtacgtaccggtaccccggtcgttaccggtaccgggtaacggtaccgggtttccccggttactaccgtcttacccggaagaaaccgttaacgaacccttaaggttaaaccaaaaccgttactaccctttagttttaaccttttacctaaacggtaaaggtccggaaacttaccccgtaagggttaaaagaaaccggtaacgggttaacccggacgggtttaccggttttacgttaggtttttagtttacgggaagttaaacggaaagttaaaccgtagtttaaacgtacgtttagggaaacttccggttaaaaccggttggggttttaaccgggcgttttaaacccttggtacggttcccgggttaagggacccgggg

SEQ ID NO: 284454 - DNA, 745 bp, Homo sapiens
  misc_feature: GYAE6OF01ERE74.14.57.F02.1.454.CMB.1.raw
  modified_base (590)..(590): a, c, t, g, unknown or other
  misc_feature (590)..(590): n is a, c, g, or t
  modified_base (745)..(745): a, c, t, g, unknown or other
  misc_feature (745)..(745): n is a, c, g, or t
tcagcgtctagtaccacgaccggtgctcgatttagctcgatatagttgggtttgggggaactgctcagttaggacccagagggaaccatggaagccccagctcagcttctcttcctcctgcctactctggcctccagactaccgaccggagtaaattgtgttcgacacgacgtcctccactcctaccttgttctttgcctacggaagggtaaacgacgccacccttctccgtgcgtacgggccagtacgagtacgtacgtaacaaacctaaccgtaacgttacgtccgttagggttaccagtacgacgtaacgtccgtcggccgtacggtcctcccgtacgtccttacctagtacgttacgtattgacgtacgacgtaccgttaccgaacggaccgggtacccaaccggcctaacccgtaccgaacggtcccgtaacggttaccgacggtacggaaccgtcgggtaccggtcggtaaccgggaactacgttaaccgttccaccgttacaccctacgacttacggactacgacgttaccgtacgtagtaccgtagtttaacgttcgttagtaacgtttattacgtttaacncggcgtagtccggaagggcgtaacttggccgtccttcggtacgtacggtacggggaccgtaagtaggtagaaccgtaacgaacggtcgtgtaccgtacgtaccacggtacacggttcttacggttaccttactcccgtcccgtaacgtacggttn

SEQ ID NO: 284455 - DNA, 606 bp, Homo sapiens
  misc_feature: GYAE6OF01BFE3U.14.57.F02.1.454.CMB.1.raw
  modified_base (333)..(333): a, c, t, g, unknown or other
  misc_feature (333)..(333): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (600)..(600): a, c, t, g, unknown or other
  misc_feature (600)..(600): n is a, c, g, or t
tcagcgtctagtaccacgaccggtgctcgatttagctcgatatagttggggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcgagggccagtcagagtgtacaacaccaacttagcctgttcagcagagcctcggccaggcctccgaggcctcctctatcgtatgatcgcactcccacgacgggccaccggcacncccagccgaggtcgagtcggcgaggtcgggtcgngggacagtactcnctcncacntcagcagcctaagcgtcgtagtaagttagtttgactttaagtttagttactgtacagtcggacgggtcggtactaaggttcggcctcgttacgtaccgggttcgggggaccggggtaacgtagggtacgtacgtaacgaacggtacgtgggtcgtacgtcggacctccgtagttcccgttagttcccttacgtacccgtttccttccccggnttaccg

SEQ ID NO: 284456 - DNA, 789 bp, Homo sapiens
  misc_feature: GYAE6OF01DHX2K.14.57.F02.1.454.CMB.1.raw
  modified_base (755)..(755): a, c, t, g, unknown or other
  misc_feature (755)..(755): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggaggtttgggctgtaggttggcttcttttcttggtggtcttaattttaaaagatagtcctagtgtgaggtgcagcgttggttgggacgggtcgggggaggtcgttgggtacggacgggtcccggggggtcccagaccacctctccgtgtcgcgagcctagaggtactttacttattttagacgtaatagtcgcagtggacgtcgtacgggtccgaccgaggccgtaccggaaggggtacgggtcgtgggaggttcgggtctacggagacgagtacgtaggttcggtttacgtaggttaggtaagtactacgttacggaccgtccgtccgtaccggtacggtaccgggttcccgttacgtacctagttcccgaacgaagggaactaaaccgtaaacttaccgaaacgtaacctctttactttaactttctaaacgaagttacggaactacgtacgtaaaggaaacgtaaccgaaacggtaccggtacgggttagttttaacgttttagttttggggaacgttaaacggaaacgttaccggttaaagtacggtttaactaaggttaaacgtaacccgttaaaaccggttttggggttaacccgggggtaactttaccgtttntaaagggtcccgggtttcgggtaaacccgggggg

SEQ ID NO: 284457 - DNA, 732 bp, Homo sapiens
  misc_feature: GYAE6OF01C8N2A.14.57.F02.1.454.CMB.1.raw
  modified_base (207)..(207): a, c, t, g, unknown or other
  misc_feature (207)..(207): n is a, c, g, or t
  modified_base (476)..(476): a, c, t, g, unknown or other
  misc_feature (476)..(476): n is a, c, g, or t
  modified_base (719)..(719): a, c, t, g, unknown or other
  misc_feature (719)..(719): n is a, c, g, or t
  modified_base (724)..(724): a, c, t, g, unknown or other
  misc_feature (724)..(724): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctccagataccaccggagaattgtgttgacacagtcctccactcctaccctgttctttcgtctccgaaggggaaacncgcccacccctctctgccgacggccagtcgagtagttcgtaccaaaccacctaacttacgtccgttcggttcacgacacggaacgtccgtcggcccgacggtcctacccgacggtccttcctacgtattacggtatcgtagttccgacctacctaccccggacggacccgggaccctaccggaccaccgtacccgacgtaccggttcggtacgacggtggaccgtgggtccggttacggaggaccgacgttcttaccgaccgtttaccnccgtaacacgttcgacgtaccgacgtacgtaacggtcttaacgtacggtaatttcgtttacgacgttttaagtttactcgttagaccggtacgacggttacgggcgtaagttaccggttcgacccgtcgttaccggttacggggtccgggaaccggggtacgttagggtaggtaactaacggtacggtacgtgtaccggtcctgaccgtcgtacttccggttactttctacctcctttccccnccgtntaacccgg

SEQ ID NO: 284458 - DNA, 897 bp, Homo sapiens
  misc_feature: GYAE6OF01AQ6IK.14.57.F02.1.454.CMB.1.raw
  modified_base (254)..(254): a, c, t, g, unknown or other
  misc_feature (254)..(254): n is a, c, g, or t
  modified_base (696)..(696): a, c, t, g, unknown or other
  misc_feature (696)..(696): n is a, c, g, or t
tcagcgtctagtaccacgaccggtgctcgatttagctcgatatagttgggtttgggggaactgctcagttacggacccagagggaaccagtggaacgccccagctcagtcttctccttccctcctgtccttactctcggcctcccagtaactacccgaccgggtaagtaaatttggtcgttaggaacctacctagtcctaccctactaccctacccttgttccttttcgtacccgtaccggaaagggggaaacnccgtcccctaacccttcttaccgtcggacgtaccggggtacctggttacgaaggtacggttactaaccaaaccgtaacctaacgtttaccgtcccgttttgggttaccacggcgtaaacgaaccggtccggtaccggaccggtcggtcccggtccggtacctccgtacgtagttaccgtagtacgtacgtacaccgttaccgtcccgtaaccggccgggacccacccggtaccctaaccgtcctaacgggttaccgttacgggtttaccgaagggtccgggtaccgttaccgggggacgggttaccgtaaccgggttacgaacccgttccctttaccggcccttacggtaccctaccgtaccgttagaccccgacttcggtaaccgtaacggtacgttaaccgtaagttagtttaacgttcgtacttaacgttactttacgntaccgtacgtacggtacgggacggtacttacgggtaccgtccgttaacggttaccgggtacccgggttcggggtaaccgggtaacggttaacgggtacgggtaccgtaaccggtaaacggttgtaccggtcgtacggtaccgtacgtcgtacttccggtaccttaccgttcgtacccgttacctccgttcgtccgttacgg

SEQ ID NO: 284459 - DNA, 886 bp, Homo sapiens
  misc_feature: GYAE6OF01CCZ5H.14.57.F02.1.454.CMB.1.raw
  modified_base (600)..(600): a, c, t, g, unknown or other
  misc_feature (600)..(600): n is a, c, g, or t
tcagcgtctagtaccacgaccggtgctcgatttagctcgatatagttgggtttgggctgagagaggagcccagtcctgggatcttcgaggttgttttcatttggtgatcaggactgaacagagagaactcaccagtggtagtttggctgtagttggtcttctttcgttgtggtacttaattttaaaagatcgtcctaggtgtggaggtgcgagtcgtggttgggacggtccgggggagtcgttaggacgacggggtcccgggggtcctcgactacctcctcgtgtcgacgacgtccgtagacgttactttacgttaagttttagacgtaattcgtacgcctagtggacgtcggtccgggtcccgcgacggacccgtacgggaggggaacgggtggtaggtacgggtcggtcctacggaacgtacgtacgtacgtaggttacggttacggtaagggtaaggaacgttacgtaacggttcccggaccgttcccggttacgttaccggtacgggtacccggttcccgttacccgtacctaccgtactaccggaacgtaaccgtaaaccgttaaaccgttaacccggtaaactaaaccccgttntttacctttaaccttttaccgtaaacgtaaacgtaccggtaacgtaccgtaacggtaaaacggtaaaccggtaaccgaacgggttaacccgggtgggtttaacctttaaggttttacgggttttaaggaagtaaaaccggttaaaggtaaaccgtttaaacggtaccgttaagttaacccggttaacggtaaaccccggttaacccggtttaaggggttacccgggtttaaccgggtacctttttaccgggaagttcccgggggttaaccgggggtaaaccccggg

SEQ ID NO: 284460 - DNA, 912 bp, Homo sapiens
  misc_feature: GYAE6OF01ANGJR.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccagtggtagtttgggctgtagttggcttctttcttgtggtacttaattttaaaagtatgtcctaggtggtggaggtgcgaggtcgttgggttgggtacgggtccggggggagtcgttggtaccggacggggtccccgggggggttcctacggacctacctcgttccgttgtcgccgtaccgtcccgtgtaggtactttaccgtttaagtttttacgaacgtaaattcggtacgtacccgtaggtacggtacggtccggttaccggggtcccgaccggtacggtacccggtaccgggtaagggggacggggtcgtacggggtacggttcgggtctaacggagtacgtaagtccggtagttcggtacgtagggtagtacgtacgtcgtacgtccgtcgtccgtacggtcggtacggtcccgttccgtctaccgttccaactacgtaccgtaaccgttaactaccgaagtaacccttacgtttcgtttaacctttacaacgtaacgttacgactaacggttacccgtaaagggtaaaccgtaaccggtaaacggtcccggttacgggttaacgtttttacgttttaaacgggttcgggttaaaacggtaaacgggaaaagtttttaaaccggaaacggttaaaccggtttccgttaaaaggttccggttaaaacccggttttaaaaacccggggtttgggggtttaaccgggggtttaaacccggtttaccggttttaaaccgtacggggttttccccgggtaacggggggttaaacccggggg

SEQ ID NO: 284461 - DNA, 744 bp, Homo sapiens
  misc_feature: GYAE6OF01EF09B.14.57.F02.1.454.CMB.1.raw
  modified_base (427)..(427): a, c, t, g, unknown or other
  misc_feature (427)..(427): n is a, c, g, or t
tcagcgtctagtaccacgaccggtgctcgattttagctcgatatagttgggtttggggggaactgctcagttaggacccagagggaaccatggaagccccagctcagcttctcttcctcctgctactctggctcccagactaccgaccggagaaatttgtgttagacacagtcctccactcctaccctgttctttgtcctccgaagggaagcgacccaccctcgtcctgccgacggccatccgagtcgtataccaaccacctaacttacgtccgttggttacagacgagacgcgtacggccgacggccctccgacggtcctcctacagttacgtactgtagcgcctaccgtacccacggacggcccacggacccacgtcccgacgccgtacggtcgtacggagtccgaggtccggtacgtacggacncgtactcgtacctacctaccacctacgtacgcacgacgtacctacgtagttcgtaaggtaactttagtttaccgtacgttttacgtttaactttacgggtacttacggacggtacgtacgggtacggtaccgtacgttacggcccgttaccgtacggtttaccggggtacccggggggtaagggtacccgggttaagggttaccggtaacgggttaaccaaacgggttcggtaccggtccgtaacggtacccgaccgtaactccgttacgtttacccgttactttacccgaccgttaccctccccgtaattacccgg

SEQ ID NO: 284462 - DNA, 753 bp, Homo sapiens
  misc_feature: GYAE6OF01BDNZ8.14.57.F02.1.454.CMB.1.raw
  modified_base (624)..(624): a, c, t, g, unknown or other
  misc_feature (624)..(624): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactccaccatggacgtttgggctgagttggcttctttcgttgtggcttaattttaaaagattcgtccagtgtggaggtgcagcttggttggacgggtccggggggaggtcgttaggtacgaggggtcccggggggtccctgacctactcttccgtagtcgcagcctcgagtatttcttagtttttaggacgtaaattatcggcctaagttcggacggtcggttcggggtccccgaccggacggtccgtacccgggaaggggggaacggggtcgtgggtacggttggggttcctacgacgactaacgtcgtaggttcggtttacgtaggtaggtaacgtactacgttccggacggtcccgttcgtaccgggtaggacgggtcccgtttctacccgatccctacgagaccgtaactaacgttaccaagtaacctccttactttactttcttaacaagtcggtaacacgcctaaggaaacgaacgaaacgacggtacgggtntttcgtttaatttgtacggtagaaacggtacttaaacgtaacgttcgttagtacgtaacgttaaccccgttaagggtttacggggtaccgggtttccctttagtacgggttgttcccggggtaacgggg

SEQ ID NO: 284463 - DNA, 896 bp, Homo sapiens
  misc_feature: GYAE6OF01BWLP0.14.57.F02.1.454.CMB.1.raw
tcagcgtctagtaccacgaccggtgctcgatttagctcgatatagttgggtttggggaggaactgctcagttaggacccagagggaaccagtggaagccccagctcagcttctcttcctcctgctactctggctcccagactaccacggagtaaattgtgttgacacagtcctccactccaccctgttctttcgtcctaccgaggggaaagcgcccaccctctccagcgacggccagtcgagtagtcgtacaaacctaccgtaacttacgtaccgttggttaccgagaccgtaacggaaccgccgtacggacccgaacggtcccctacccggacggtcccgttccgttactacgttagtagtacgtactcgacctacccgccccgaaccggaccggaccccgaccggtacctacccgtccccgaacgggttacccgtacgggtttacgacggtccggggaaggccggggtcgggtaccggtacgggacgtaccggttaccttacctccgtaccctaccgaacctgaacccacggaacctacgtaccggtagtacgtacgttaagtaacgtttacgtttacggttacgttttacgtttacgttacgttacggttacgacggtcggtacggggtaaccggttacgtaaccggttccggtaccgttacccgttacccgggtttaacgggggttcccgggggggtaaaccggggttaaccgggttaacggggttaaccggtaaaccgggttaaaccgttaaaccgggggtaacggtttcggggtaaccggttccggtaaacccggttacccgtaacccgggttttaccttttacccggtttacccggtttaacccgttcccctttaacccccggtttccccgttaccccccggtaaacgg

SEQ ID NO: 284464 - DNA, 522 bp, Homo sapiens
  misc_feature: GYAE6OF02ILMXI.14.57.F02.1.454.CMB.1.raw
  modified_base (347)..(347): a, c, t, g, unknown or other
  misc_feature (347)..(347): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtntgggacagacttcactctcaccatcagcagcctagagtctgaagtattttgctagtttattacttgtcagcaggcggggcaagttcggccgctcgtacgtttcgggcgggggtaccaagggtggagttacgaacgactggtggctgcacatcgtgttcttcatcttcccgctacg

SEQ ID NO: 284465 - DNA, 517 bp, Homo sapiens
  misc_feature: GYAE6OF02H9IBU.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagtatttgctagtttattactgttcagcagcgggcaagttggccgtcgggtcacgtttcggcgggggaccgaggtggtagtcgaaacgactggtggcgtgcacatctgtcttcatccttcccgctac

SEQ ID NO: 284466 - DNA, 523 bp, Homo sapiens
  misc_feature: GYAE6OF02ICALV.14.57.F02.1.454.CMB.1.raw
  modified_base (306)..(306): a, c, t, g, unknown or other
  misc_feature (306)..(306): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggccaccggcatcccagccaggttcagtggcagcgggtctgggacatacttcactctcaccatcagcagctagagtctgaagattttgctagtttattactgttcagcaggcgggcaagttggccgcgtcacgtttcgggcgggggaccgtaagggtggagtacgaaacgacgtggtaggcgtgcgaccatctgtcttcacttccttcccgctac

SEQ ID NO: 284467 - DNA, 547 bp, Homo sapiens
  misc_feature: GYAE6OF02H2EK3.14.57.F02.1.454.CMB.1.raw
  modified_base (533)..(533): a, c, t, g, unknown or other
  misc_feature (533)..(533): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggttcgccaggctccaggggaaggggctgggagtgggtctcagcaatcagtggttctagtggaagtacattcgacgccgtctccgtgaagggccggttctccatctccagagacaattccaaagaacactcttatttcttacaaatggacagacctgaaaagacgaagacacgggcgtgtatttttgtgtagaagatacgaagtctatgataacccaagtttgggagggtcctttanagttgtcgtcgggg

SEQ ID NO: 284468 - DNA, 515 bp, Homo sapiens
  misc_feature: GYAE6OF02H6BOE.14.57.F02.1.454.CMB.1.raw
  modified_base (201)..(201): a, c, t, g, unknown or other
  misc_feature (201)..(201): n is a, c, g, or t
  modified_base (345)..(345): a, c, t, g, unknown or other
  misc_feature (345)..(345): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggtttcagcagaagcctggccaggctcccaggctcctcatgtatgatgcatcccacagggccacggcatcccagccaggttcagtgcagcgggtntgggacagacttcactctcaccatcagcagcctagagtctgaagtatttgctagtttattactgtcagcagcgggctaagttggccgctctacgtttcgggcggggtaccaagggtggagttacgaaacgacgtggtggctgcacctatcgtgtcttcatctcccgctac

SEQ ID NO: 284469 - DNA, 579 bp, Homo sapiens
  misc_feature: GYAE6OF02IE9IP.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcaggcgggtctgggacagacttcactctcaccatcagcagcctagagtctagaagtatttgctagtttattacttgtcagcaggcggggactaagttcggccgtcgtcgtacggtttcggggcgggggtaccgtaagggtggtaacggtttaccgaaacggtacgttggtcggccgttggaccgtaccgtagttccgttacggttccgtttaccgtactttcccgttaccccggtaccc

SEQ ID NO: 284470 - DNA, 508 bp, Homo sapiens
  misc_feature: GYAE6OF02H2BQ4.14.57.F02.1.454.CMB.1.raw
  modified_base (304)..(304): a, c, t, g, unknown or other
  misc_feature (304)..(304): n is a, c, g, or t
tcagcgtctagtaccacgaccggtgctcgatttagctcgatatagttgggtttggggaactgctcagttaggacccagagggaaccatggaagcccagctcagcttctcttcctcctgctactctggctcccagataccaccggagaaattgtgttgacacagtctccactcaccctgtctttgtctccaggggaaagagccacctctcctgcagggccagtcagagtgtcaacaccaaacttagcctggtttcagcagaagcctggccaggctcccaggctcctcatgtatgatgcatcccanagggccaccggcatcccagccaggttcagtggcaggcgggtctgggacagacttcactctcaccatcagcagcctagagtctgaagattttgctagtttattactgtcagcagcggggcaattggccgctcacgtttcgggcgggggaccgaagggtggagttcaaacgactgtggctgcacatctgtctcatcttcccgctac

SEQ ID NO: 284471 - DNA, 697 bp, Homo sapiens
  misc_feature: GYAE6OF02G5IMC.14.57.F02.1.454.CMB.1.raw
  modified_base (302)..(302): a, c, t, g, unknown or other
  misc_feature (302)..(302): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcgagggccagtcagagtgtacaacaccaacttagccttggtttcagcagaacgcctggccaggcctccaggcctcctcatgtangatcgcactccacgacgggcccaccggcactcccagccgtaggttaccaggtcggcgacgggccggggttgtcggggaacacggtactttcgacttcgtaccaacctactcacgcacgtacctaaggagtctaggaagttatttcgacgttaagttttacttacgttgtacaggacgacgggcgggtactaagttccgggccgtacgttaccgttaccggttttaccggggggacccggggggttaaacccgtaaggggttacgggtaacgggtttaacccgaaacgggtaaccggttggggttacgggtaccgttacggaccccgtaacccgttagttcccggtttacgggttaccctttaccgtaaccgttttccccgtaccccgggtaaccc

SEQ ID NO: 284472 - DNA, 551 bp, Homo sapiens
  misc_feature: GYAE6OF02GFWPD.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcatcccacgagggcccaccggcactcccagccaggttcagtggcaggcgggtctgggacagacttcactctcaccatcagcagcctagagtctagaagtattttgactagtttattactgttcagcgaggcggggactaagttcggccgtcgtcgtacgtttccgggacgggggtaccgaagggtggtaagttacgaaacgtacgtggtcggcgtgccacgagtctgttcttcacttccgttcccgctacg

SEQ ID NO: 284473 - DNA, 605 bp, Homo sapiens
  misc_feature: GYAE6OF02IXWNA.14.57.F02.1.454.CMB.1.raw
  modified_base (295)..(295): a, c, t, g, unknown or other
  misc_feature (295)..(295): n is a, c, g, or t
  modified_base (566)..(566): a, c, t, g, unknown or other
  misc_feature (566)..(566): n is a, c, g, or t
tcagcgtctagtaccacgaccggtgctcgatttagctcgatatagttgggtttgggggggaactgctccagttaggacccagagggaaccatggaagccccagctcagcttctcttcctcctgctactctggctcccagataccaccggagaaattgtgttgactactagtctcctaactcaccctgtctttgtctccaggggaagagccacctctccgtgcagggccagtcagagtgtcaacaccaacttagccttggtttcagcagagtcctggccaggctcccaggctcctnatgtatgatgcactccccgagacgggcccaccgggcacgtcccagcctaggttcaggtggcaggtcggtactgggacagtacttcacttctccaaccatcgacgacacgaccctagacgtctagaagtatttcgacttacggttttaactaccgttgtacacgtacgaggccgggactaagttcggaccgtctcgtacgtttcggggacggggtaccgtaagggttaggtacgttacgaaacggtacgtggtacggcgtacgactaacctnttacgtacgttcgttctacgttcccgttacccgtctacg

SEQ ID NO: 284474 - DNA, 525 bp, Homo sapiens
  misc_feature: GYAE6OF02GQLDV.14.57.F02.1.454.CMB.1.raw
  modified_base (427)..(427): a, c, t, g, unknown or other
  misc_feature (427)..(427): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagccaggttcagtggcagcgggtctgggacaggacttcactctcaccatcagcagcctagagtctgaagtatttgctagtttattacttgtcagcagcggggntaagttcggccgctcgacgtttcgggcgggggtaccgaagggtggagttacgaacgacgtggtggctgcacagtctcgtcttcacttcttcccgctac

SEQ ID NO: 284475 - DNA, 605 bp, Homo sapiens
  misc_feature: GYAE6OF02IIT3H.14.57.F02.1.454.CMB.1.raw
  modified_base (202)..(202): a, c, t, g, unknown or other
  misc_feature (202)..(202): n is a, c, g, or t
  modified_base (419)..(419): a, c, t, g, unknown or other
  misc_feature (419)..(419): n is a, c, g, or t
tcagcgtctagtaccacgaccggtgctcgatttagctcgatatagttgggtttggggggaactgctcagttaggacccagagggaaccatggaagccccagcctcagcttctcttcctcctgctactctggctccagataccacggagaaattgtgttgacacagtctccactccacctgtctttgtctccgaggggaaagngccacctctcctgcgagggccagtcagagtgtacaacacctaacttacgccttggttcagcaagaacgccgtggccaggcctcccgaggcctcctcatgtatgatgactactcccacgacgggcccaccggcactcccagcctaggtcaggtcgcaggcgggtctgggacagtacttcactctcaccatcagcacgcctagacgtcgtagaaagttnttttgacttaagttttaacttacttgtacagtcgagggccggggtactaagttcggccgtctcgtaccgtttcggggacgggggaacctaagggtggtaacgttaaccgaaacggtacgttggtacggcgttcgaccaaccgtagttccgttcgttcttacctacgtttcccgttccccgcttacg

SEQ ID NO: 284476 - DNA, 554 bp, Homo sapiens
  misc_feature: GYAE6OF02IE3BZ.14.57.F02.1.454.CMB.1.raw
  modified_base (312)..(312): a, c, t, g, unknown or other
  misc_feature (312)..(312): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccgaggcctcctcatgtatgatgcactcccacncgggccaccggcactcccagccaggttcagtggcaggcgggtcgtgggacagtacttcactctcaccatcagcagcctagcgtctagaagttatttgcttagtttattacttgtacagtcgaggcgggactaagttcggccgtctcgtacggttcgggacggggacaaggtgtacgttacgaacgtagtggtggcgtggaccgtaccgtcgttcgtcttcctacttcccgttcccgcctacg

SEQ ID NO: 284477 - DNA, 521 bp, Homo sapiens
  misc_feature: GYAE6OF02HM3QV.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacggggccaccggcactccccagccaggttcagtggcagcgggtctgggacagacttcactctcaccatcagcagcctagagtctgaagtatttgctagtttattactgtcagcagcgggctagttggccgcgtcacgtttcgggcggggacgaagggtggagttacgaacgacgtgtggctgcactatctcgttcttctactccttcccgctac

SEQ ID NO: 284478 - DNA, 590 bp, Homo sapiens
  misc_feature: GYAE6OF02ILD5R.14.57.F02.1.454.CMB.1.raw
  modified_base (200)..(200): a, c, t, g, unknown or other
  misc_feature (200)..(200): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagcgtctagtaccacgaccggtgctcgatttagctcgatatagttgggtttggggggaactgctcagttaggacccagagggaaccatggaagcccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagccttggtttcagcagaagcctggccaggctcccaggcctcctcatgtatgatgcactcccagacgggccaccggcactcccagccaggttcaggtgcaggcgggtcngggacagacttcacttcncaccatcagcagctagagtctagaagtattttgacttagtttaattactgtactagcgaggcgggactaagttcggccgtacttccgtaccggtttcggggaccgggggtaaccgtaaggggtggtaacggttacgaaaacggtacgttaggtcggcttacggacctaaccgtacgttccgtcgttccttacgtacctttccgttaccccgccttacg

SEQ ID NO: 284479 - DNA, 299 bp, Homo sapiens
  misc_feature: GYAE6OF02GJRLF.14.57.F02.1.454.CMB.1.raw
  modified_base (294)..(299): a, c, t, g, unknown or other
  misc_feature (294)..(299): n is a, c, g, or t
tcagcgtctagtaccacgaccggtgctcgatttagctcgatatagttgggtttgggggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccgccatctgagtactagcgctgagcgggctggcaaggcgcatagnnnnnn

SEQ ID NO: 284480 - DNA, 423 bp, Homo sapiens
  misc_feature: GYAE6OF02FIDBG.14.57.F02.1.454.CMB.1.raw
  modified_base (418)..(423): a, c, t, g, unknown or other
  misc_feature (418)..(423): n is a, c, g, or t
tcagcgtctagtaccacgaccggtgctcgatttagctcgatatagttgggtctcagcaatcagtggttctagtgtaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggccccatcggtcttcccccctggcaccctcctccaagagcacctctgggggcacagcggccctgggctgcctggtcaaggactacttccgtactagacgctgagcgggctggcaaggcgcatagnnnnnn

SEQ ID NO: 284481 - DNA, 555 bp, Homo sapiens
  misc_feature: GYAE6OF02IG67O.14.57.F02.1.454.CMB.1.raw
  modified_base (200)..(200): a, c, t, g, unknown or other
  misc_feature (200)..(200): n is a, c, g, or t
  modified_base (370)..(370): a, c, t, g, unknown or other
  misc_feature (370)..(370): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccagtcagagtgtcaacaccaacttagcctggtttcagcagaagcctggccaggctcccaggcctcctcatgtatgatgcactcccacgacgggccaccggcactcccagccaggttcaggtgcagcgggtctgggacagacttcactcncaccatcagcagcctagacgtctgaagtatttgactagtttattactgtcagcgaggtcgggataagttcggccgtctcgtaccgtttcggggacgggggtaccgaagggtggtacgttacgaaacgtacgtggtcggcgtcgactaccgtatccgttgttcttacgtacttccttcccgctacg

SEQ ID NO: 284482 - DNA, 545 bp, Homo sapiens
  misc_feature: GYAE6OF02JC3FV.14.57.F02.1.454.CMB.1.raw
  modified_base (308)..(308): a, c, t, g, unknown or other
  misc_feature (308)..(308): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggccaccggcatcccagccaggttcagtggcagcgggtctgggacagacttcactctcaccatcagcagcctagagtctgaagtatttgctagtttattactgtcagcgaggcgggactaagttcggccgtcgtccgtacgtttccggggccgggggtaccgagggtcggagttacgaacgtacgtggtcggactcggacacctagtcgtgttccttctacttcccttcccgtcc

SEQ ID NO: 284483 - DNA, 524 bp, Homo sapiens
  misc_feature: GYAE6OF02GZN3H.14.57.F02.1.454.CMB.1.raw
  modified_base (513)..(513): a, c, t, g, unknown or other
  misc_feature (513)..(513): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatccccagccaggttcagtggcaggcgggtctgggacagacttcactctcaccatcagcagcctagagtctgaagtattttgctagtttattacttgtcagcaggcgggcaagttcggccgctcgtacgtttcgggcgggggaccgaaggtggacgttacgaacgacgtggtggcgtgcacgatctgtcttcncttcctcccgc

SEQ ID NO: 284484 - DNA, 576 bp, Homo sapiens
  misc_feature: GYAE6OF02GIVHQ.14.57.F02.1.454.CMB.1.raw
  modified_base (307)..(307): a, c, t, g, unknown or other
  misc_feature (307)..(307): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccanagggccaccggcactcccagccaggttcagtggcaggcgggtctgggacaggacttcactctcaccatcagcagcctagagtctagaagtatttgctagtttattacttgtactagcgaggcgggctaacgttcggccgtctccgtaccgtttccggggaccgggggtaccgtaaggggtcggtaacggttaccgaaacggtacgtggtacggtcgtagaccgaccgtacgttcgtacgttcttccgtactccgtttaccccgcctacg

SEQ ID NO: 284485 - DNA, 502 bp, Homo sapiens
  misc_feature: GYAE6OF02I32K3.14.57.F02.1.454.CMB.1.raw
  modified_base (398)..(398): a, c, t, g, unknown or other
  misc_feature (398)..(398): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgttagaagcaacttagcctggtaccagcagaaacctggccaggctcccaggctcctcatctatggtgcatccaccagggccactggtcgtccccagccaggttcagtggcaggtgggtctggggacagagttcactctcaccatcagcagcctgcagtctgaagtntttgctagtttattattgtcagcagtataatactgcctcgtgacgtgcaggaccaaggtgaaatcaacgactgtggctgcacatctgtcttcatcttccgctac

SEQ ID NO: 284486 - DNA, 568 bp, Homo sapiens
  misc_feature: GYAE6OF02JBWLS.14.57.F02.1.454.CMB.1.raw
  modified_base (251)..(251): a, c, t, g, unknown or other
  misc_feature (251)..(251): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (527)..(527): a, c, t, g, unknown or other
  misc_feature (527)..(527): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccacctctcctgcagggccagtcagagtgtcacacaactacgctgttcngcanaagctcgcgacgctccncaggctcctcatgtatgatgcactcccgacacggccaccggccactcccacgccacggttcgacgtggcgacgcgggtcgtgggacgacgactcactactacaccactcacgacacgacctacgagtactagtaagtatttagtactagtttattactagtacagacgacgacgggtacgaacgttacggtcgacgtcgtacgttacggacggggacgtaacggtaggtacgtacgtaacgtaacgtcgtacggnacgtacgacgacctacgtaccgttacgtacgttcctacgtc

SEQ ID NO: 284487 - DNA, 566 bp, Homo sapiens
  misc_feature: GYAE6OF02HBOCY.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccacccgtctcctgcagggccagtcagagtgtcaacaccaacttagcctggtttcagcagagcctggccaggctcccaggctcctcatgtatgatgcatcccgacagggccaccggcatcccagccaggttcaggtgcagcgggtctgggacagacttcactctcacatcagcagacctagagtcgtagaagtatttgactagtttattactgtcagcaggcgggacagttggccgtctcgtacgtttcggggacgggggtaccgaagggtcggtaagttacgaaacggtacgtggtacgggtctcggaccgtaaccgtagttaccgttacgttccttactacgtttccgttacccgcctacg

SEQ ID NO: 284488 - DNA, 423 bp, Homo sapiens
  misc_feature: GYAE6OF02I3MDX.14.57.F02.1.454.CMB.1.raw
  modified_base (416)..(423): a, c, t, g, unknown or other
  misc_feature (416)..(423): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaagggcccatcggtcttccccctggcaccctcctccaagagcacctctgggggcacagcggccctgggctgcctggtcaaggactacttccgtactagacgctgagcgggctgggcaaggcgcatagnnnnnnnn

SEQ ID NO: 284489 - DNA, 599 bp, Homo sapiens
  misc_feature: GYAE6OF02HV1RE.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccacagggccaccggcactcccagccaggttccagtggcagcgggtctgggacagtacttcactctcaccatccagcagcctagagtctgaagtattttgctagttttattacttgtcagcgagcggggacaagttcgggccgtcttaccgtaccggttttcgggccggggggtaacctaaggggtcggaacgggtttaccgaaacggtaacgttcggtagggtccgttcggaccgtacccgaagttccgttacggttacctttcctaccgtttcccttacccccgtacctaaccg

SEQ ID NO: 284490 - DNA, 510 bp, Homo sapiens
  misc_feature: GYAE6OF02FNISC.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagatttgctagtttattactgtcagcagcgggcaagttggccgctcacgtttcgggcgggggaccaaggtggagttcgaacgtacgtgtggctgcaccatctgtcttcatcttcccgctac

SEQ ID NO: 284491 - DNA, 587 bp, Homo sapiens
  misc_feature: GYAE6OF02HTQYE.14.57.F02.1.454.CMB.1.raw
  modified_base (291)..(291): a, c, t, g, unknown or other
  misc_feature (291)..(291): n is a, c, g, or t
  modified_base (375)..(375): a, c, t, g, unknown or other
  misc_feature (375)..(375): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaaggggaagagccacctctcctgcagggccagtcagagtgtcaacaccaacttagccttggttcagcagaagcctggccaggcctcccgaggcctcctnatgtatgatgcatcccagacgggccaccggcactcccagcctaggttcagtggcaggcgggtctgggacaggtacttcacttcncaaccatccagaccagcctagagtcgtagaagtatttgactagtttattactgtacagtcgaggtcggggactaaggttcggccgtcgttaccgtaccggtttcggggaccgggggtaacagggtggtaacgttacgaaacggtacgtggtcggcgtacgacgtaacctacgtcgttagtccttacgtaccgtttccgttccccgtactacg

SEQ ID NO: 284492 - DNA, 548 bp, Homo sapiens
  misc_feature: GYAE6OF02FHQNL.14.57.F02.1.454.CMB.1.raw
  modified_base (400)..(400): a, c, t, g, unknown or other
  misc_feature (400)..(400): n is a, c, g, or t
  modified_base (474)..(474): a, c, t, g, unknown or other
  misc_feature (474)..(474): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctgggagtgggtctcagcaatcagtggttctagtggaagtacattcgacgccgtctccgtgaagggccgttctccatcnccagagacaattccaagacactctatttctcaaatggacagcctgaaagacgaagacacgggcgtgtattttgngtagaagtatacgaagttctatagacttaacccaagtttcggggacggggtcctttcgagttgtcgtacggggg

SEQ ID NO: 284493 - DNA, 727 bp, Homo sapiens
  misc_feature: GYAE6OF02I55M2.14.57.F02.1.454.CMB.1.raw
  modified_base (183)..(183): a, c, t, g, unknown or other
  misc_feature (183)..(183): n is a, c, g, or t
tcagcgtctagtaccacgaccggtgctcgatttagctcgatatagttgggtttggggccgagagaggagcccagtcctgggatcttcaggtgttttcatttggtgatcaggactgaacagagagactcaccatggtagttggctgtagttggcttctttcttgtggtacttaattttaaaagnttcgtccagttgtggaggtgcagtcttggttgggacgggtccggggggaggtcgtttagggtacgacggggtccccgggggggttccctggacctaccttcctccgtggtcgcacgccctacgaggtatttcttatttttacgacgtaattatcgaccagtgagtcgtcgggtcccgcgacggcctaccggaagggggaacggggtcgtgggtagggtcgggtcctacgacgactaactcgtaggttcggttacgtaggtaggtaagtactagttacggaccgtccgtcgtcggtacggaacgggtcccgttctccatcctaccgagacaactaacttaccaaagtaactactacttactttacttaataacgtcgaacacgtaccgtaaggaaacgaacggaacgaccgacgggtcgttagtttacgtttttgaggttaagaagtagtaacggtaagttacgtaagttacggtaacttaacccgttaaggtttcggggtacgggttcctttacgtagttcggttacgggtacggggtaaccgg

SEQ ID NO: 284494 - DNA, 561 bp, Homo sapiens
  misc_feature: GYAE6OF02IW4C1.14.57.F02.1.454.CMB.1.raw
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggcctcccaggctcctcatgtatgatgcatcccacgacggggccaccggcatcccagccaggttcagtggcaggcggtntgggacagtacttcactctcaccntcagcagcctagagtctagtaagtatttgactagtttattacttgtcagcgaggcgggactaagttcggccgtctccgtacgtttcggggacgggggtaccgtaagggtcggtaacgttacgaaacgtacgtggtacggtcgtcgacgacctagttcgtgttccttactactccttcccgctacg

SEQ ID NO: 284495 - DNA, 515 bp, Homo sapiens
  misc_feature: GYAE6OF02IESSL.14.57.F02.1.454.CMB.1.raw
  modified_base (347)..(347): a, c, t, g, unknown or other
  misc_feature (347)..(347): n is a, c, g, or t
  modified_base (502)..(502): a, c, t, g, unknown or other
  misc_feature (502)..(502): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtntgggacagacttcactctcaccatcagcagcctagagtctgaagtatttgctagtttattactgtcagcagcgggcaagttggccgctcacgtttcgggcgggggaccgaaggtggagttacgaacgacgtgtcggctcgcaccatctgtcttcntccttcccgctac

SEQ ID NO: 284496 - DNA, 531 bp, Homo sapiens
  misc_feature: GYAE6OF02JEBMW.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacgggccaccggcactcccagccaggttcagtggcagcgggtctgggacagacttcactctcaccatcagcagcctagacgtctgaagtatttgcttagtttatactgtcagcaggcgggcaagttcggccgctcgtacgttcgggccgggggactaagggtggtacgttacgaacgacgtggtggctgacacctatcgtcgttcttctactccttcccgctac

SEQ ID NO: 284497 - DNA, 737 bp, Homo sapiens
  misc_feature: GYAE6OF02INHFA.14.57.F02.1.454.CMB.1.raw
  modified_base (158)..(158): a, c, t, g, unknown or other
  misc_feature (158)..(158): n is a, c, g, or t
tcagcgtctagtaccacgaccggtgctcgatttagctcgatataggttagggttgggcgtgagagacgagccccagtcctggtactcgttctacggtgttttcatttggtgatcaggactgaacagagagaactcaccatggagtttgggctgagtgngtcttttcttgtgtcttaagtttaaagatgtcagtgtgagtgcagcgtgttggaggtccgggggaggtcgttggtacgacgtccggggggtcccgtcgacacgtcctcctcgtgctagtcctcgagtattcgtatttttagacgtaatatcgcctagtgacgtcggttcgggtcccgaccgtacggcgtaccggacggggtaaggggcgttgggtacgttcgggtcgttacgtagtcgaaacgttcgaggttaggttactaaggttaggaagtacgtacgtttcggacgtccggtacgtcccggtaggtaacgggtcccggtttactcccgtacgtcctaccgagaacgaaccaaagtttacccaaacgtaaccttacgtccttaaattttccttaacgtaaagttcggtaaacaacgtaccgtaaggaaacgtaccgaacgtacgtaacgggtacttagtttactttttagaagttaagtaaaagtagttaacggtaacgtcttaaagttcgtaacgttacccgtaaaggtttcggggtaccgggtccgttttacgaccgtttcgttaccgtacgggg

SEQ ID NO: 284498 - DNA, 529 bp, Homo sapiens
  misc_feature: GYAE6OF02G841Q.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccacagggccaccggcactcccagccaggttcagtggcaggcgggtctgggacagacttcactctcaccatcagcagcctagacgtctagaagtattttgctagtttattactgtcagcagcgggactagttggccgtctctacgttcgggcgggggtacaagggtggagtacgaacgacgtggtcggctgcaccgagtctcgtcttctacttcctcccgtcc

SEQ ID NO: 284499 - DNA, 532 bp, Homo sapiens
  misc_feature: GYAE6OF02F7GON.14.57.F02.1.454.CMB.1.raw
  modified_base (518)..(518): a, c, t, g, unknown or other
  misc_feature (518)..(518): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcatcccacacgggccaccggcactcccagccaggttcagtggcagcgggtctgggacagacttcactctcaccatcagcagcctagacgtctgtaagtatttgactagtttattactgttcagtcgaggcgggactaagttcggccgctcgtacgttcgggcgggggaccgagggtcggtagtacgaacgacgtgtggctgctacatcgtgtcttcnctccttccgcctac

SEQ ID NO: 284500 - DNA, 579 bp, Homo sapiens
  misc_feature: GYAE6OF02FEUAX.14.57.F02.1.454.CMB.1.raw
  modified_base (359)..(359): a, c, t, g, unknown or other
  misc_feature (359)..(359): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaacgcctggccaggcctcccaggctcctcatgtatgatgcactcccagacggccaccggcactcccagccaggttcaggtcggcagggccggtntcggggacagtcttcactctacacatcagcacgctagtctctagtagtattttcggacttagtttattacgtgtacaggcgacggtcgggactaggttcgcctcgtcgtacgggttcggggacggggtaacctagggtcgtaacgttaccgaacgtcgtggttacggctacgaccttacgagttccgttacggttccttctaccgttccttcccgtaccg

SEQ ID NO: 284501 - DNA, 520 bp, Homo sapiens
  misc_feature: GYAE6OF02FWWEF.14.57.F02.1.454.CMB.1.raw
  modified_base (336)..(336): a, c, t, g, unknown or other
  misc_feature (336)..(336): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagccaggttnaccccgtggcagcgggtctgggacagacttcactctcaccatcagcagcctagagtctgaagtattttgctagtttattactgtcagcagcgggcagttggccgctctacgtttcgggcgggggaccgaagggtggagttacgaacgacgtgtggctgcacatctgtccttcactcctcccgtc

SEQ ID NO: 284502 - DNA, 529 bp, Homo sapiens
  misc_feature: GYAE6OF02IJ2I9.14.57.F02.1.454.CMB.1.raw
  modified_base (301)..(301): a, c, t, g, unknown or other
  misc_feature (301)..(301): n is a, c, g, or t
  modified_base (391)..(391): a, c, t, g, unknown or other
  misc_feature (391)..(391): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcattttagcgaatatgccatgagctgggtccncaggctccagggaagggctggagtgggtctcagcaatcgagtggttctagtggaatacattcgacgccgtctcgtgaacgggtccgttcncccatctccagacgacaacttccaagaacactactatttcttcaatggacagcctagaaagacgaagacacgggcgtgtattttgtgtagaagatacgagtctatgatacccattggagggtccttcatgtctcgggg

SEQ ID NO: 284503 - DNA, 544 bp, Homo sapiens
  misc_feature: GYAE6OF02GZ14B.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagccaggttcaggtggcaggcgggtctggggacagacttcactctcaccatcagcagcctagagtctgaagtattttgctagtttattactgttcagcaggcggggcaagttcggccgtctccgtaccgtttccggggccggggggtaaccgaagggtggtagttacgaaacgacgtggtggctggccaccattctgttcttcacttccttcccgcctac

SEQ ID NO: 284504 - DNA, 543 bp, Homo sapiens
  misc_feature: GYAE6OF02F9JOC.14.57.F02.1.454.CMB.1.raw
  modified_base (476)..(476): a, c, t, g, unknown or other
  misc_feature (476)..(476): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgcaggctccagggaaggggctgggagtggggtctcagcaatcagtggttctagtggaagtacattcgacgccgtctccgtgaagggccggtttctccatctccagagacaattccaagaacactctatttctcaaatgacagcctgaaagacgaagacacgggcgtgtattttgngtgaagataacgaagtctatgaattacccaagtttcgggaggggtcctttacgattgtcgtacgggg

SEQ ID NO: 284505 - DNA, 620 bp, Homo sapiens
  misc_feature: GYAE6OF02G4M9U.14.57.F02.1.454.CMB.1.raw
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (393)..(393): a, c, t, g, unknown or other
  misc_feature (393)..(393): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctctcatgtatgatgcatcccanagggccaccggcatcccagccaggttcagtgcagcggtntgggacagacttcactcncacntcagcacgctagactcgtagtaagttntttgacttagtttacttacgtgtacgacgtacgacgggcgggtaactaaggtcgggacccgtacgttaccttaaccggggtttccgggggaccgggggtaaccgtaagggggttacggtaacgttaaccggaaaacggttccggttaggtacgggtcgttacgaccgtaaccgtacgttccgttacggttcctttaccgtacctttcccgtttaccccggacttacg

SEQ ID NO: 284506 - DNA, 529 bp, Homo sapiens
  misc_feature: GYAE6OF02H5VKR.14.57.F02.1.454.CMB.1.raw
  modified_base (495)..(495): a, c, t, g, unknown or other
  misc_feature (495)..(495): n is a, c, g, or t
  modified_base (505)..(505): a, c, t, g, unknown or other
  misc_feature (505)..(505): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaactagcctggtttcagcagagcctggccaggctcccaggctcctcatgtatgatgcactcccacgacgggcccaccggcactcccagccaggttcaggtggcaggcgggtctgggacaggacttcactctcaccatcagcagcctagagtctagaagtatttgctagtttattactgtcagcaggcgggactagtcggccgtctcgtacgttcgggacggggtacgagggtggtagttacgaacgtagtggngcgtgctacntcgtgtcttcacttccctccgtcc

SEQ ID NO: 284507 - DNA, 622 bp, Homo sapiens
  misc_feature: GYAE6OF02F7QU0.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaacttagcctggtttcagcagaagcctggccgaggctccgacggctcctcatgtatgatgcacgggggggggtcccacgacggccgaccggcactcccacgccgacggttcgaggtggcgacggcgggtcgtgggacgagacttctactctcaccactacacgcacgccgtagtacgtcgtaggtaagtagttttacgtacgttagttttaattacgttcgttcgtacgacgacggcggggacgtaacgttcggccgtcgtcgtacgtttcgggtaccgggggtacggtaagggtacggtacggttacgtaacgtacgtaggtacggtcgtacgtacgtaccgtacgtcgtcgttcgttcctacttccttcccgtcctacg

SEQ ID NO: 284508 - DNA, 556 bp, Homo sapiens
  misc_feature: GYAE6OF02HA53T.14.57.F02.1.454.CMB.1.raw
  modified_base (483)..(483): a, c, t, g, unknown or other
  misc_feature (483)..(483): n is a, c, g, or t
  modified_base (549)..(549): a, c, t, g, unknown or other
  misc_feature (549)..(549): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcattttagcgaatatgccatgagctgggtccgccaggctccaggggaaggggctgggagtgggtctcagcaatcagtggttctagtggaagtacattcgacgccgtctccgtgaacgggccggttctccatctccagagacaattccaagaacactctatttcttacaaatggacagcctagaaagacgaagacgacgggcgtgttatttttgngttagaaagataacgaagtctaatgaactacccgaagtttcgggacgggtcctttacgagttcgtntacgggg

SEQ ID NO: 284509 - DNA, 567 bp, Homo sapiens
  misc_feature: GYAE6OF02IWS5T.14.57.F02.1.454.CMB.1.raw
  modified_base (202)..(202): a, c, t, g, unknown or other
  misc_feature (202)..(202): n is a, c, g, or t
  modified_base (446)..(446): a, c, t, g, unknown or other
  misc_feature (446)..(446): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggctcctcatgtatgatgcatcccagacgggcccaccggcactcccagccaggtcaggtgcagcgggtctgggacaggacttcactctacaccatcagcagcctagactctagaagtattttgactagtttattactgtcagcgagcgggctaagttcggaccnctacgtcgtttcggggaccgggggaccaagggtcggaacgttaccgaaacggtacgtacggtggtacctacgccgtaaccgtagtacgttcggttaccttacgacttccgtccccgtaccg

SEQ ID NO: 284510 - DNA, 543 bp, Homo sapiens
  misc_feature: GYAE6OF02IE8G2.14.57.F02.1.454.CMB.1.raw
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccanagggccaccggcactcccagccaggttcagtggcagcggtcngggacagacttcactctcaccatcagcagcctagagtctgtaagtatttgactagtttattacttgtacagcgaggcgggactaagttcggccgtcgtcgtacgtttcgggaccggggggtaccgaagggtggagttacgaacgtaacgtggtcggcgtgcctacgatcgtcgtcttctacttcctcccgtcc

SEQ ID NO: 284511 - DNA, 527 bp, Homo sapiens
  misc_feature: GYAE6OF02GSIEC.14.57.F02.1.454.CMB.1.raw
  modified_base (306)..(306): a, c, t, g, unknown or other
  misc_feature (306)..(306): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggcccaccggcatcccagccaggttcagtggcagcgggtctgggacagacttcactctcaccatcagcagcctagagtctgaagtattttgctagtttattacttgtcagcaggcggggcaagttggccgctcgtacgtttcgggccgggggaccgaagggtggtagttacgaaacgtacgtggtggctgcaccatctgtcttcactccttcccgctac

SEQ ID NO: 284512 - DNA, 557 bp, Homo sapiens
  misc_feature: GYAE6OF02FZD2W.14.57.F02.1.454.CMB.1.raw
  modified_base (391)..(391): a, c, t, g, unknown or other
  misc_feature (391)..(391): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggctcctcatgtatgatgcatccccacgacgggcccaccggcactccccagcccaggttcagtggcaggcgggtctgggacagacttcactctcaccatcagcagcctagngtctagaagtatttgactagtttatactgtcagcaggcgggctaagttcggccgcgtcgtacgtttcgggacggggtacgacggtaggtacgtacgtaacgacgtaggtggtcgtcgacgtaccagttcgtcgttccgttacctacttccgttccccgtcctaccg

SEQ ID NO: 284513 - DNA, 535 bp, Homo sapiens
  misc_feature: GYAE6OF02F3EYZ.14.57.F02.1.454.CMB.1.raw
  modified_base (351)..(351): a, c, t, g, unknown or other
  misc_feature (351)..(351): n is a, c, g, or t
  modified_base (430)..(430): a, c, t, g, unknown or other
  misc_feature (430)..(430): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccacagggccaccggcactcccagccaggttcagtggcaggcgggtntgggacagacttcactctcaccatcagcagcctagagtctgaagtatttagtctagtttattactgtcagcaggcgggnaagttcggccgctctacgtttcgggcgggggtacgaaggtggagttacgaacgtacgtaggtggcgtgccaaccatcgtcgttcttctactccttcccgcctacg

SEQ ID NO: 284514 - DNA, 535 bp, Homo sapiens
  misc_feature: GYAE6OF02FZHBV.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcacgcctagacgtctagtaagtattttgacttagtttattacttgtcagcgaggcgggactagttcggccgtctcgtacgttcggggcggggacagggtcgacgttacgaacgtacgtggtcggctcgcacagtcgtcgtcttcacttccgtcccgtc

SEQ ID NO: 284515 - DNA, 545 bp, Homo sapiens
  misc_feature: GYAE6OF02FFM0L.14.57.F02.1.454.CMB.1.raw
  modified_base (308)..(308): a, c, t, g, unknown or other
  misc_feature (308)..(308): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcatcccanagggccaccggcatcccagcccaggttcagtggcaggcgggtctgggacaggacttcactctcaccatccagcagcctagagtctgaagtatttgctagtttatacttgtcagcaggcgggctaagttcggccgcgtccgtaccgttttcgggcggggggtaaccgaagggtaggacgttacgaaacgtacgtaggtggctgccacctagtctgttcttcactccttcccgcctacg

SEQ ID NO: 284516 - DNA, 528 bp, Homo sapiens
  misc_feature: GYAE6OF02JD0ZA.14.57.F02.1.454.CMB.1.raw
  modified_base (308)..(308): a, c, t, g, unknown or other
  misc_feature (308)..(308): n is a, c, g, or t
  modified_base (375)..(375): a, c, t, g, unknown or other
  misc_feature (375)..(375): n is a, c, g, or t
tcagcgtctagtaccacgaccggtgctcgatttagctcgatatagttgggtttgggggaacgtgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccanagggccaccggcatccccagcccaggttcagtggcaggcgggtctgggacagacttcactctcaccntcagcagcctagagtctacgaagtatttgctagtttatacttgtctagcgaggcggggacaagttggccgtctcgtacgtttcgggcgggggacctaagggtgagtacaacgacgtgtggctgcgtacatctagtcttcactcttcccgctag

SEQ ID NO: 284517 - DNA, 542 bp, Homo sapiens
  misc_feature: GYAE6OF02IS2OG.14.57.F02.1.454.CMB.1.raw
  modified_base (526)..(526): a, c, t, g, unknown or other
  misc_feature (526)..(526): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatccccagccaggttcagtggcaggcgggtctgggacagacttcactctcaccatccagcagcctagagtctagaagtattttgactagtttattactgtcagcgagcggggacaagttggccgtctctacgtttcgggcgggggtacctaagggtcggtagttacgaaacggtacgtggtacggctgccgtaccatctgttcttcnctccgttcccgctacg

SEQ ID NO: 284518 - DNA, 539 bp, Homo sapiens
  misc_feature: GYAE6OF02HXGX8.14.57.F02.1.454.CMB.1.raw
  modified_base (354)..(354): a, c, t, g, unknown or other
  misc_feature (354)..(354): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggcctcctcatgtatgatgcatcccagacgggccaccggcactcccagccaggttcaggtggcagcgggtcngggacagacttcactctcacatcagcagcctagacgtctagaagtatttgactagtttattacttgtcagcgaggcgggactagttcggccgctcgtacgttcgggacgggggacgtagggtggagttacgaacgtacgtaggtggcgtcgacaccagttctgttcttctacttccttcccgtcc

SEQ ID NO: 284519 - DNA, 539 bp, Homo sapiens
  misc_feature: GYAE6OF02FGFXC.14.57.F02.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacaccaacttagcctggtttcagcagaagcctggccaggctcccaggctcctcatgtatgatgcatcccanagggccaccggcatcccagccaggttcagtggcagcgggtctgggacagacttcactctcaccatcagcagcctagagtctagaagtattttgctagtttattacttgtacagcaggcggggctaagttcggccgtctccgtacgtttcgggacgggggacctaagggtggacgttacaacggacgtggtcggctggcctaccagttctgttccttcacttccttcccgacc

SEQ ID NO: 284520 - DNA, 555 bp, Homo sapiens
  misc_feature: GYAE6OF02HKWAW.14.57.F02.1.454.CMB.1.raw
  modified_base (443)..(443): a, c, t, g, unknown or other
  misc_feature (443)..(443): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattctatttttagcgaatatgccatgagcgtgggtccgccgaggctccgaggggaaggggctggagtgggtctcagcaatcagtgttctagtggaagtacattcgacgtccgtctccgtgaacgggtccgttctcatcctcagacgactaattcaaagaacactactatttcttanaaatgacagacctagaaagacgaagacgacggcgttgttattttgtgtagaagataacgagtctatagtactaaccctagttacgggacggtccttagattgtcgtacgggg

SEQ ID NO: 284521 - DNA, 539 bp, Homo sapiens
  misc_feature: GYAE6OF02IAT98.14.57.F02.1.454.CMB.1.raw
  modified_base (453)..(453): a, c, t, g, unknown or other
  misc_feature (453)..(453): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagcctgggaggtccctgagactctcctgtgcagcctctggattcaccttcagtacctatgctatgcacgtggggtccgccaggcctccgaggcggaggggctgggaggtgggtggcgattatatcacatgatggaaactaatagacgctatcgccgactcgtgaacggccgattcacctatctcagagactaattccaaagacacgcagtatctgacaaatcgaacncgactgagagctagacggacacggcttaggttcgttaagttaccgtgggtaggggtaacgaggtaggtacgggtagggtgtaacgg

SEQ ID NO: 284522 - DNA, 530 bp, Homo sapiens
  misc_feature: GYAE6OF02GGTPC.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccggggggtccctgacactctcctgtgcagcctcaggattcattttagcgaatatgccatgagctgggtccgccaggctccagggaaggggctggagtgggtctcagcaatcagtggttctagtggaagtacattcgacgccgtctccgtgaagggccgttctccatctccagagacaattccaagaacactctattctcaaatggacagcctgaaagacgaagacgacgggcgtgtattttgtgtgaagatacgaagtctatgatacccgaatttcgggagggtccttcattgtgtcgggg

SEQ ID NO: 284523 - DNA, 524 bp, Homo sapiens
  misc_feature: GYAE6OF02HIG4R.14.57.F02.1.454.CMB.1.raw
  modified_base (309)..(309): a, c, t, g, unknown or other
  misc_feature (309)..(309): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacngggccaccggcatcccagccaggttcagtgcagcgggtctgggacagacttcactctcaccatcagcagcctagagtctgaagtattttgctagtttattacttgtcagcagcggggcaagttcggccgctctacgtttcgggacgggggaccgaagggtggagttacgaacgtacgtggtggctgacaccatctgtccttctactcctcccgtc

SEQ ID NO: 284524 - DNA, 564 bp, Homo sapiens
  misc_feature: GYAE6OF02GGJUC.14.57.F02.1.454.CMB.1.raw
  modified_base (396)..(396): a, c, t, g, unknown or other
  misc_feature (396)..(396): n is a, c, g, or t
  modified_base (433)..(433): a, c, t, g, unknown or other
  misc_feature (433)..(433): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtccctgacactctcctgtgcagcctcaggattcatttttagcgaatatgccatgagctgggtccgccaggctccgaggggaaggggctggaggtgggtctcgagcaatcgagttggtctagtggaagtacagttcgacgccgtctccgtgaggccgttcncatctcagagacaattccaagaacactctatttctanaaatgacagcctagaaagacgaagacgacgggcgttgttattttgagttagaaagtataacgtaagtctatagaacttacccgtaagtttcggggacggggttacctttacgtagttcggtcgtacggggg

SEQ ID NO: 284525 - DNA, 578 bp, Homo sapiens
  misc_feature: GYAE6OF02FRODS.14.57.F02.1.454.CMB.1.raw
  modified_base (359)..(359): a, c, t, g, unknown or other
  misc_feature (359)..(359): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacgggccaccggcactcccagccaggttcagtggcaggcgggtctgggacngacttcactctcaccatcagcagcctagagtctgaagtatttgctagtttattacttgtcagcgaggcggggactaagttcggccgtcgtccgtaccggtttccggggaccggggggtaaccgtaaggggttcgggacggttaccgaaacgtacgtacgggtcgggcgtcggcctaccgtattcgttcggttcctttcgtacttcccgttcccgtaccc

SEQ ID NO: 284526 - DNA, 593 bp, Homo sapiens
  misc_feature: GYAE6OF02JGVLA.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggcctcctcatgtatgatgcatcccacgacgggccaccggcactcccagccaggttcagtggcaggcgggtctgggacagacttcactctcaccatcagcacgacctagagtctagaagtatttgtctagtttatttacgttgtacgagcgaggtcggggactaagttcggccgtcgtccgtaccggtttccggggaccggggggtaaccgtaaggggtacggtacggttaccgaaacggtaaccgtggtcggcgtcggtaccgacctagttccgtcggttccttacgtaccgttcccgttccccgtacccg

SEQ ID NO: 284527 - DNA, 540 bp, Homo sapiens
  misc_feature: GYAE6OF02FT7R8.14.57.F02.1.454.CMB.1.raw
  modified_base (307)..(307): a, c, t, g, unknown or other
  misc_feature (307)..(307): n is a, c, g, or t
  modified_base (390)..(390): a, c, t, g, unknown or other
  misc_feature (390)..(390): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggctcctcatgtatgatgcatcccanacgggcccaccggcactcccagccaggttcaggtggcaggcgggtctgggacagacttcactctacaccatcagcagcctagngtctagaagtatttgctagtttactactgtcagcaggcgggcaagttcggccgcgtcgtacgttcgggcgggggtacgagggtggtagttacgaaacgtacgtggtggcgtcgcaccgatcgttcgtcttcgactccgttcccgcctacg

SEQ ID NO: 284528 - DNA, 563 bp, Homo sapiens
  misc_feature: GYAE6OF02GYJRZ.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatcccacacgggccaccggcactcccagccaggttcagtggcaggcgggtctgggacagacttcactctcaccatcagcagcctagagtctgaagtatttgctagtttattactgttcagcgaggcggggactaagttcggccgtcttccgtacgtttccggggaccggggggtaccgtaagggtcggtaacgttaccgaaacggtacgtggtacggtcgtggaccaccgtagtcgtcgttcttctacttccttcccgctac

SEQ ID NO: 284529 - DNA, 565 bp, Homo sapiens
  misc_feature: GYAE6OF02FY118.14.57.F02.1.454.CMB.1.raw
  modified_base (258)..(258): a, c, t, g, unknown or other
  misc_feature (258)..(258): n is a, c, g, or t
  modified_base (306)..(306): a, c, t, g, unknown or other
  misc_feature (306)..(306): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctcttagcctggtaccaanagaacctggccaggctcccagcctcctcatctctgatgcttccaacgngggcccacgtggcactcccagccctaggttcaggtggcaggtgggtctgggacagacttcactctcaccatcagcctccagacgccgtggagtagttttgttagtttattactgtcagctagtatagcagctcggccctcccgtacgtttccgggacggtacgggaccgtaagggtggaacgtacgtaccgaacggtactggtacggtctcgaccacctacgtccgttcgttccttcctacttcccttccccgcctacg

SEQ ID NO: 284530 - DNA, 606 bp, Homo sapiens
  misc_feature: GYAE6OF02HYRC4.14.57.F02.1.454.CMB.1.raw
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggttcagcagagcctggccaggctcccaggcctctcatgtatgatgcatcccacgacgggcccaccgggcactcccgagccgaggttcagtggcaggcgggtcngggacagacttcactcncaccatcagcagcctagcgtctagaagtntttggcttagtttttattagttgtanagtacgtaagttataaacgttaacgtccggtacccgttccgggtaggtacccggttcgggaccgtaaacggggtaccgaagggttacggaaactacgtaaaacgtacgttacggtcggtacctacggaaccctacctacgttcgttcggttacctttctaccgttccctttacccg

SEQ ID NO: 284531 - DNA, 512 bp, Homo sapiens
  misc_feature: GYAE6OF02GST1N.14.57.F02.1.454.CMB.1.raw
  modified_base (307)..(307): a, c, t, g, unknown or other
  misc_feature (307)..(307): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanacgggccaccggcatcccagccaggttcagtggcagcgggtctgggacagacttcactctcaccatcagcagcctagagtctgaagtatttgctagtttattactgtcagcaggcgggcaagttggccgctcgtacgttcgggcgggggaccaagggtggagttacgaacgagtgtggctgacacatctgtctcatctccgctac

SEQ ID NO: 284532 - DNA, 572 bp, Homo sapiens
  misc_feature: GYAE6OF02I96VD.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggctcccaggctcctcatgtatgatgcatcccacgagggccaccggcatcccagccaggttcagtggcaggcgggtctgggacagacttcactctcaccatcagcagctagagtctagaagtatttgatagtttattactgtcagcgagcgggctaagttcggccgtcgtacgtacgtttcggggaccggggggtaccgtaagggtcgggtagttacgaacgtacgtacggtcggtcgtacggaccgtaccgtacgttaccgttcgttaccgttctaccttccgttacccgtacccg

SEQ ID NO: 284533 - DNA, 528 bp, Homo sapiens
  misc_feature: GYAE6OF02FIJ8E.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacgggccaccggcatcccagccaggttcagtggcaggcgggtctgggacagacttcactctcaccatcagcagcctagagtctgaagtattttgctagtttattacttgtcagcgagcgggcaagttggccgctctacgtttcgggcgggggaccgagggtggagttacgaacgacgtggtggctgcaccatcgtcgttccttcacttccgttcccgtcc

SEQ ID NO: 284534 - DNA, 586 bp, Homo sapiens
  misc_feature: GYAE6OF02G2MEV.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggcctccaggcctcctcatgtatgatgcactccccacagggcccaccggcactcccagcctaggttccaggtcggcaggcgggtcgtgggacaggtacttcacttctaccaccatccagcagcctagactacgtagaagtatttgacttagtttattacgttgtactagtcgacggcgggactaagttcggccgtcgtcgtaccgtttcggggaccgggggtaccgaagggtaggtaacgttacgaaacgtacgtggtacggcgtacgacaccgtactcgtcgttccttacctacttcccgttcccgcctaacg

SEQ ID NO: 284535 - DNA, 525 bp, Homo sapiens
  misc_feature: GYAE6OF02HA691.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctccccaggctcctcatgtatgatgcatcccacagggccaccggcatccccagccaggttcagtggcagcgggtctgggacagacttcactctcaccatcagcagcctagagtctgaagtattttgctagtttattacttgtcagcagcgggctaagttggccgtctcgcgtttcgggcgggggaccgaaggtggagttcgaacgacgtggtggctgcaccatcgtcgtcttcgacttccttcccgacc

SEQ ID NO: 284536 - DNA, 559 bp, Homo sapiens
  misc_feature: GYAE6OF02JILB6.14.57.F02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccagggaaangccaccctctcctgcagggccagtcagagtgtcaacaccaacttagcctggttcagcagaagcctggccaggctccaggctcctcatgtatgatgccatcccagagggccaccggcactcccagccaggttccagtcggcagcgggtctgggacnggaccttcgacttcctacaccatccagcacgtcctagacgtctagaagtatttgactagtttattacttgtacagcgagtcgggactaagttcggaccgcgtcgtacggtttcgggacgggggtaccgaaggtcggtagttacgaacgtacgtcggtcggactggacaccgagtcgtcgtcttctacgttacgtcccgtaccg

SEQ ID NO: 284537 - DNA, 566 bp, Homo sapiens
  misc_feature: GYAE6OF02J0XS8.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggctcctcatgtatgatgcatcccacgaggcccacggcatcccagccaggttcagtggacaggtccgggtctggggaccaggtaccttcaaccgtctaccaccatccaggtccaacgccctagagtccgagtaacgtatttgacttagtttattactgttcagtcagcgggacagttggccgtctcgtacgtttcggggacggggtacctaagggtggaacgttacgaacgtacgtggtcggtcgtgacaccgtatcgtcgttacttcgtactccgttccgactcg

SEQ ID NO: 284538 - DNA, 603 bp, Homo sapiens
  misc_feature: GYAE6OF02FY23A.14.57.F02.1.454.CMB.1.raw
  modified_base (367)..(367): a, c, t, g, unknown or other
  misc_feature (367)..(367): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcggtctgggacagacttcactcncaccatcagcagcctagagtctagaagtattttgctagtttattacgttgtcagcgaggcggggtacaagttcggccgtcgttccgtaccgttttcggggaccggggggtaaccgtaaagggttcgggtaacggttaccgaaaccggtaacggttagggttacgggtaccgttcggaccctaacccgtaattccgttcggtttacctttaccgtacttcccgttaccccgtacccg

SEQ ID NO: 284539 - DNA, 525 bp, Homo sapiens
  misc_feature: GYAE6OF02G6UCT.14.57.F02.1.454.CMB.1.raw
  modified_base (203)..(203): a, c, t, g, unknown or other
  misc_feature (203)..(203): n is a, c, g, or t
  modified_base (302)..(302): a, c, t, g, unknown or other
  misc_feature (302)..(302): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggtaccagcagaaacctggccaggctcccaggcctcctcatctatggtcncatcccaccgagggcccacgtggtctcccagccaggttcagtggcaggtggtctgggacaggagttcactctcaccgatcagcagcctgcagtctagaagtatttgctagtttattattgtcagctagtataataactgcctcgtggtacgtcgacgtaacggaccgtaaggtagaagtacgaacgacgtgtgctcgcactagtctgtcttctactcctccgc

SEQ ID NO: 284540 - DNA, 591 bp, Homo sapiens
  misc_feature: GYAE6OF02IVTQK.14.57.F02.1.454.CMB.1.raw
  modified_base (338)..(338): a, c, t, g, unknown or other
  misc_feature (338)..(338): n is a, c, g, or t
tcagcgtctagtaccacgaccggtgctcgatttagctcgatatagttgggtttggggctgagagaggagccccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattctatttttagcgaatatgccatgagctgggtccgcaggctccgaggggaaggggctggagtgggtctnagcaatcagttggttactaggtggtaagtactattcgacgtcccgtctcccggtggaacgggtcccgtttctccactcctccagacgacaattaccaaagaaccactcttatttcttacaaagtgacagcctagaaagacgaagacgacgggtgtagttagttttgtagtagaaagtataacgtaagtctaatacgtaactaaccctaaggtttcggggacggggttccctttacgagttcggtcgtacgggg

SEQ ID NO: 284541 - DNA, 621 bp, Homo sapiens
  misc_feature: GYAE6OF02GQ5L2.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgtctactctggctcccagataccaccggagaaattgtgttgacacagtctccactcaccctgtctttgtctccaggggaaagagccaccctctcctgcagggccagtcagagtgtcaacaccaacttagcctggtttcacgcagaagcctggccacggcctcccgaggctcctcatgtatgatgcatcccagcggccacggcactcccagccaggtcagtggcaggcggtctgggacagacttcactctcactatccagcacgccgtagacgtctaggtaagtattttcgtacttaggttttattacgttagtacaacgtcgacggtccggggtactaacgttcggcccggtccgtacgtaccggtttccggggaccggggggtaaccgtaagggtcgggtacgttaccgtaaacggtacgttcgggtcggtaccgtacggaccgtacccgtacgttccttacggttccgttaccgtacgttcccgttacccgtacccg

SEQ ID NO: 284542 - DNA, 626 bp, Homo sapiens
  misc_feature: GYAE6OF02JJ3TR.14.57.F02.1.454.CMB.1.raw
  modified_base (374)..(374): a, c, t, g, unknown or other
  misc_feature (374)..(374): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccaggcctcctcatgtatgatgcactccccagacgggcccaccggcactcccagccaggttcagtggcagcgggtctgggacagacttcactcncacatcagcagctagagtcgtgaagtatttgcttagtttattacttagttagtcgaggcgggtactagttcgggccgtcgtccgttaccggtttcggggaccgggggtaaccgtaaggggtcgggtaggttaccgaaacggtaaccgttggtacgggtacgttcggtaccgtaccgtaacgttccgttacggtttacccgtttaccgtaaccgtttaccccggtttacccccggtaccgtaccgtttaccgg

SEQ ID NO: 284543 - DNA, 530 bp, Homo sapiens
  misc_feature: GYAE6OF02HSNQP.14.57.F02.1.454.CMB.1.raw
  modified_base (306)..(306): a, c, t, g, unknown or other
  misc_feature (306)..(306): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanagggccacggcatcccagccaggttcagtgcaggcgggtctgggacagacttcactctcaccatcagcagcctagagtctgaagtatttgctagtttattactgtctagcgaggcgggacaagttggccgcgttcgacgtttcggggcggggggtaaccaaggggtggagttacgaaacgactggtcggctgcaccatcgtgtcttacacttccttcccgctac

SEQ ID NO: 284544 - DNA, 543 bp, Homo sapiens
  misc_feature: GYAE6OF02FFNKS.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccaggctcccaggctcctcatgtatgatgcatcccacaggccaccggcactcccagccaggttcagtggcagcgggtctgggacagacttcactctcaccatcagcagcctagagtctagaagtatttgactagtttatactgtcagtcgaggcgggctaagttggcccgctcgtacgttttcgggacgggggtaaccgaaggtcggagttaccgaacgtactggtcggctcgacctacctatcgtcgttccttaccacttccttcccgcctacg

SEQ ID NO: 284545 - DNA, 564 bp, Homo sapiens
  misc_feature: GYAE6OF02I0C3G.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccgaggctcctcatgtatgatgcatcccagacgggccaccggcatccccagccaggttcagtggcaggcgggtctgggacagacttcactctcaccatcagcagcctagacgtctagaagtattttgactagtttattacttgttacagtcgagcggggactagttcggccgtacgtcgtacgtttccgggacgggggtaccgtaaagggtgggaacgttaccgaaacgtaacgtggtcggcgtacggacgacctagtctcgttcttctacttcccgtcccgtacc

SEQ ID NO: 284546 - DNA, 548 bp, Homo sapiens
  misc_feature: GYAE6OF02HO9PU.14.57.F02.1.454.CMB.1.raw
  modified_base (299)..(299): a, c, t, g, unknown or other
  misc_feature (299)..(299): n is a, c, g, or t
  modified_base (403)..(403): a, c, t, g, unknown or other
  misc_feature (403)..(403): n is a, c, g, or t
  modified_base (423)..(423): a, c, t, g, unknown or other
  misc_feature (423)..(423): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtccctgacactctcctgtgcagcctcaggattcatttttagcgaatatgcatgagctggtccncaggctccgagggagggctggagtgggtctcagcaatcagtgtctagtggaagtacatcgacgccgtctcgtgaggccgttctcatctccagacacaatccaanaaccactcttatttacttanaaatgacagacctagaaacgacgaacgacgacggtacgtgttactttagtgtagtaagagtacgtagtactattacgactaacccgtaagtttgggacgggttacttcgtagtggtcgtacgggg

SEQ ID NO: 284547 - DNA, 627 bp, Homo sapiens
  misc_feature: GYAE6OF02IVKQR.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagagctggccaggctccagctctcatgtatgatgcatcccacgacggccaccggcactcccgagccaggttcagtcggcagcgggtcgtgggacaggtacttcactctacgaccagtcagcacgaccgtagtagtcgtagtaagtatttgactagtttacttacgtgtacagtcgaggtcgggactaagttcggccgtacttccgtaccggtttccggggaccggggggtaaccgaagggtcgggtaacggttaaccgaaaccgggtaacgttgggtacgggtaccggttacggaccgtaacccgtaacgttccgttacgttacccggtttacctaaccgtttcccgtttcccccggacttaacccgg

SEQ ID NO: 284548 - DNA, 694 bp, Homo sapiens
  misc_feature: GYAE6OF02GXVHX.14.57.F02.1.454.CMB.1.raw
  modified_base (310)..(310): a, c, t, g, unknown or other
  misc_feature (310)..(310): n is a, c, g, or t
tcagcgtctagtaccacgaccggtgctcgatttagctcgatatagttgggtttggggtcgtgagagaggagcccagtcctgggatcttcaggtgttttctatttggtgatcaggactgaacagagagaactcaccatggagtttgggctgagttggctctttcttgtggtctattttaaagatgtccagtgtgaggtgcagctgttggagtccgggggaggcttggtacaggccgggggggtccctggacactctcctgtgcagcctcaggattcatttttagcgtaatatgccatgagcgtgggtcccnccgaggcctccgaggggaaggggctggaggtgggtctcgagcaatcagtggttctagtggaagtacattcggacgtccgtctccgtaggaacggggtcccggtttctccgacttcctcccgtaagacgtaacaactttaccaaaagtaaaccaaccttaccttattttaccctttactaaaaacgttggaacctacgcccgtaagaaaacggaacgaaacgaccgtacggggacgttagtttaacgttttttggacgttaaggaaacgtagttaaaccggtaaggttaccttaagttacgaaacgttaaccccgttaaaggttttcgggggtaaccggggttacccgttttacgtaacgtttcggttaccggttaaccgggggg

SEQ ID NO: 284549 - DNA, 568 bp, Homo sapiens
  misc_feature: GYAE6OF02H4G34.14.57.F02.1.454.CMB.1.raw
  modified_base (414)..(414): a, c, t, g, unknown or other
  misc_feature (414)..(414): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggctattttaaaagatgtccagtgtgaggtgcagctgttggagtccgggggaggcttggtacagccgggggggtccctgacactctcctgtgcagcctcaggattctatttttagcgaatatgccatgagctgggtcccgccaggctccaggggaaggggctgggagttgggtctcagcaatctagtggttctagtggaagtacattcgacgccgtctccgtaggagggccggtttctccatctcccaganacaaattccaaagaaccactctattttcttacaaatggacagcctagaaaggacgaagacacgggcgttgttagtttttgagtagaaagataacgaagtctatgaattaacccagtttacggggacgggtccttttcgattcggtcgtacgggg

SEQ ID NO: 284550 - DNA, 528 bp, Homo sapiens
  misc_feature: GYAE6OF02I8PDN.14.57.F02.1.454.CMB.1.raw
  modified_base (349)..(349): a, c, t, g, unknown or other
  misc_feature (349)..(349): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccagagggccaccggcatcccagccaggttcagtgcaggcgggtcngggacagacttcactctcaccatcagcagcctagagtctagaagtatttgctagtttattacttgtcagcgagcgggactaagttcggccgtcgtcgtacgtttcgggcgggggtaccgaaggtggagttacgaacgacgtggtggctgcaccatcgtcgtcttcacttcctcccgtcc

SEQ ID NO: 284551 - DNA, 530 bp, Homo sapiens
  misc_feature: GYAE6OF02F4Q3W.14.57.F02.1.454.CMB.1.raw
  modified_base (350)..(350): a, c, t, g, unknown or other
  misc_feature (350)..(350): n is a, c, g, or t
  modified_base (372)..(372): a, c, t, g, unknown or other
  misc_feature (372)..(372): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtcngggacagacttcactctcaccntcagcagcctagacgtctgaagtattttcgctagttattactgtcagcagcgggctaagttggccgtcgtcgtacgtttcgggcggggtaccgaagggtggacgttacgaacgtacgtggtggctcgcacgagtcttgtccttcacttcctcccgtcc

SEQ ID NO: 284552 - DNA, 825 bp, Homo sapiens
  misc_feature: GYAE6OF02I4MLQ.14.57.F02.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
tcagcgtctagtaccacgaccggtgctcgatttagctcgatatagttgggtttggggggaacgtgctcagttaggacccagagggaaccatggaagcccagctcagcttctcttcctcctgctactctggctcccagataccaccggagaaattgtgttgacacagtctccactcaccctgtctttgtctccgaggggaaanagccaccctctcctgcgagggccagtcagagtgtcaacaccaacttagcctggtttcagcagaagcctggccaggctccaggcctcncatgtatcgatgctactcccaacgacgggcccaccggtacacgtacccacggccgtacggttaccagggtcggccgtaacggtccgggggttaccgtagggggaacctaacgggtacccgttttaccgaaccgtttccacccgtaaaccctaacgttcccgaaacgggtccaaccggtacccgtaacggtaccggttacgtaacggtaaagttacgttttggaccgtttaaacgttttaacgtttactacggttaactacggtacgtaacgggacggggttactaacggttcgggacccgtacgttacccggtttaacggtttccgggggtaaccggggggtaaccgtaaggggtttaacgggtaaacgttttaaccgggaaaacccggttaccgggttacgggttaaccggggtaccggttaccgggaaccccggtaaaccgttaccggttttacccgggtttaacgtttccccggttttaacccggttaccgttttaccccccgggtttaccccggtaccccttttaaaccggg

SEQ ID NO: 284553 - DNA, 543 bp, Homo sapiens
  misc_feature: GYAE6OF02HN8EA.14.57.F02.1.454.CMB.1.raw
  modified_base (482)..(482): a, c, t, g, unknown or other
  misc_feature (482)..(482): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtcccgccaggctccaggggaaggggctgggagtgggtctcagcaatcagtggttctagtggaagtacattcgacgccgtctccgtgaagggccggttctccatctccagagacaattccaagacactctatttcttcaaatggacagcctagaaagacgaagacgacgggcgttgttattttgngttagaagatacgaagtctatgatacccaagttcgggagggtcctttgatgtcgtacgggg

SEQ ID NO: 284554 - DNA, 561 bp, Homo sapiens
  misc_feature: GYAE6OF02GNMMG.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctcccgaggcctcctcatgtatgatgcatcccacgacgggcccaccggcactcccagccaggttcagtggcaggcggtctgggacagacttcactctacaccatcacgcacgctagacgtctagtaagttagtttgacttagtttacttacttgtacagcgaggcgggactagtcgccgtctcgtacggttcgggcggggtaccagggtcggacgtacgaacgtacgtggacggcgtcgacgaccgtatcgttcgttccgttctacgttcccttacccgactacg

SEQ ID NO: 284555 - DNA, 608 bp, Homo sapiens
  misc_feature: GYAE6OF02IIDR7.14.57.F02.1.454.CMB.1.raw
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatccccacgacgggcccaccggcatcccagccaggttcagtgcagcgggtntgggacagacttcacttctcaccntcagcagcctagagtctagaagtattttgactagttttaattacgtgttacagcgaggcggggactaagttcggccgtacgttccgtacggtttccggggaccggggggtaaccgtaaggggtacggtaacggttaccgtaaaaccggtacgttgggttacggcgtacggaccgtacccgtacgttccgttcgttacctttccgacctttcccgtttccccgtacctaccg

SEQ ID NO: 284556 - DNA, 539 bp, Homo sapiens
  misc_feature: GYAE6OF02G42R0.14.57.F02.1.454.CMB.1.raw
  modified_base (395)..(395): a, c, t, g, unknown or other
  misc_feature (395)..(395): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtaccaacagaaacctggccaggctcccaggctcctcatctatgatgcatccatcaggccactgcatcccagccaggttcagtggcagtgggtctgggactaggacttcgactctcaccatcagcagcctagacgcctgaagtnttttgctagtttaattactgtacagtacagcgtacaactggtccctcgtcgcgctcctacgtttccgggcgaagggtaccaagggtcgaagacgtacgaaacgtacgtagtcggctaggcctaaccgtatccgtgttcttaccg

SEQ ID NO: 284557 - DNA, 596 bp, Homo sapiens
  misc_feature: GYAE6OF02IYZFF.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccacacgggccaccggcactcccagccaggttcagtgcagcgggtctgggacagacttcactctcaccatcagcacgcctagagtctgaagtatttgactagtttattactgttcagcgtaggcggggtacaagttcgggccgtccgtcgtaccgtttccggggaccggggggtaaccgtaacggggttagggtacggttaccgaaaccggaacgttaggtacgggtcgttacggcctaaccgtacgttcgttacggttctttaccgtacgttcccgtttaccccgcctaaccg

SEQ ID NO: 284558 - DNA, 589 bp, Homo sapiens
  misc_feature: GYAE6OF02GNH03.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagccaggttcagtggcaggcgggtctgggacagacttcactctcaccatcagcagcctagacgtctagaagtatttgctagtttattactgtcagcaggcggggctaagttcggccgcttccgtaccgtttccggggccggggggtaaccaaggggttcggaacggtttaccgaaaacggtacgttagggtacgggcgtcggaccaaccgtacgttccgttcggttacctttaccgacgtttcccgtttaccccggccctaacg

SEQ ID NO: 284559 - DNA, 566 bp, Homo sapiens
  misc_feature: GYAE6OF02IZP62.14.57.F02.1.454.CMB.1.raw
  modified_base (307)..(307): a, c, t, g, unknown or other
  misc_feature (307)..(307): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccanacgggccaccggcactcccagccaggttcagtcggcagcgggtctgggacaggacttcactctcaccatcagcagcctagagtctagaagtatttgactagtttattactgttcagcgagcgggacaagttcggccgcttaccgacgtttccggggccggggggtaccgtaagggtcggtaacggttacgaaacggtacgtggtacggtcgtgaccgaccgtacgtcgtcgttcttcgtacttccgttcccgtcctacg

SEQ ID NO: 284560 - DNA, 632 bp, Homo sapiens
  misc_feature: GYAE6OF02JY3WM.14.57.F02.1.454.CMB.1.raw
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagcgtctagtaccacgaccggtgctcgatttagctcgatatagttgggtttgggggtagggaacgtgctcagttaggacccagagggaaccatggaagcccagctcagcttctcttcctcctgctactctggctcccagataccaccggagaaattgtgttgacacagtctccactcaccctgtcctttgtactccaggggaaagagccaccctctcctgcagggccagtcagagtgtcaacaccacttagcctggtttcagcagaagcctggccaggctccccaggcctacctcatcgtactgatgcntcccanagggccaccggtnactcccagccaggttccaagtggcctagccgggtntcggggacnggacttcgatctcaccgatcagcagcctacgagtcagagattttgcgtatttacgtacttcgtcagtccgtagaccggggtataacgttcggaccgtacgttccgtaacgttttccggggaccgggggtaacctaacgggtcgggtactttaacgggaacccgtaagttacggtcgggtaacctcgggtaccgtaacccgtagttacccgttacggttacccgttttaccgaacggtttccccttcccgggtaacccg

SEQ ID NO: 284561 - DNA, 642 bp, Homo sapiens
  misc_feature: GYAE6OF02HP2S4.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtacaacaccaacttacgccttggtttcagcagaagcctggccaggcctcccgaggcctcctcatgtatgatgcactccccacgacgggcccaccggcacgtccccgagccgtaggttccaggtcggacgacggccggggtctggggaccaggtaccttcgacttcctacaccaatcagccacgacctagacgttcgtagtaaagttattttcgacttagttttattacgttgttacgagacgagggcggggtactaagttcgggccgtacgttccgtaccgggttcggggaccgggggtaccgtaaggggttacggtaacggttacgaaacggtacgttcggtacggtcgtacgaccgtaaccgtacgttcgtacgttccttaccgtacttcccgttacccgcctacg

SEQ ID NO: 284562 - DNA, 653 bp, Homo sapiens
  misc_feature: GYAE6OF02IDIA8.14.57.F02.1.454.CMB.1.raw
  modified_base (306)..(306): a, c, t, g, unknown or other
  misc_feature (306)..(306): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctggacactctcctgtgcacgcctcaggattctatttttagcgtaatatgcatgagctgggtccnccaggctccgagggaaggggctgggagtgggtctcgagcaatcaggttggttctaggtaggaagtacagttcgacgtccgtctccgtaggaacgggtccggtttctccactctaccagaacgacaattaccaaagtaccactcttatttctactaatgacagacctagaaacgaacgaacgaacgacgggtacgttagtttaggtttttacgtggttaagaaagtacgttaacggtaaggtttacgttaaacttaggtaacctttaaaccccgttaaaggtttttcgggggaaccggggtttacccctttttaacggaacgtttcggttaccgggttaaccgggggg

SEQ ID NO: 284563 - DNA, 512 bp, Homo sapiens
  misc_feature: GYAE6OF02G15I2.14.57.F02.1.454.CMB.1.raw
  modified_base (351)..(351): a, c, t, g, unknown or other
  misc_feature (351)..(351): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggctcccaggctcctcatgtatgatgcatcccagacgggccaccggcactcccagccaggttcagtggcagcgggtcngggacagacttcactctcacatcagcagcctagagtctgtaagtatttgacttagtttattactgttcagtcaggcgggactagtcggcgctcgtacgttcgggcggggacaggtggagtacgaacgtagtgtggctgcacatctgtctnactctccnctc

SEQ ID NO: 284564 - DNA, 604 bp, Homo sapiens
  misc_feature: GYAE6OF02IP0CV.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccccaggctcctcatgtatgatgcatcccacagggccaccggcactccccagccaggttcagtggcaggcgggtctcggggacaggacttcactctcaccatcagcagcctagagtctagaagtatttgctagttttattacttgtacagcaggcgggactaagttcggcccgtcgttccgtaccgttttccggggaccggggggtaaccgtaacgggttacgggtacgtttacgaaaccggtaacgttacgggttcgggtacctacggacctacccgtaagttccgttacggttcctttacgtactttcccgttacccgtacccg

SEQ ID NO: 284565 - DNA, 572 bp, Homo sapiens
  misc_feature: GYAE6OF02IXX8X.14.57.F02.1.454.CMB.1.raw
  modified_base (303)..(303): a, c, t, g, unknown or other
  misc_feature (303)..(303): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctggacactctcctgtgcagcctcaggattcattttagcgaatatgccatgagctgggtccnccaggctccgagggaagggctggagtgggtctcagcaatcagtggttctagtggaagtacattcgacgccgtctccgtggaaggccgttctccatctcagagacaattccaagaacactctattcttacaaatgacagacctagaaagacgaacgaacgacgggacgtagttattttgtagttagaaagtagtaacgaagtcttaatagtaacttaacccgtaagtttacggggaacgggttcctttacgacgttaggtcgtaacgggg

SEQ ID NO: 284566 - DNA, 423 bp, Homo sapiens
  misc_feature: GYAE6OF02H8DK7.14.57.F02.1.454.CMB.1.raw
  modified_base (417)..(423): a, c, t, g, unknown or other
  misc_feature (417)..(423): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaagggcccatcggtcttcccccctggcacccctcctccaagagcacctctcgggggcacagcggccctgggctgcctggtcaaggctacttccgtactagacgctgagcgggctgggcaggcgcatagnnnnnnn

SEQ ID NO: 284567 - DNA, 615 bp, Homo sapiens
  misc_feature: GYAE6OF02G1ZOG.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctccagataccaccggagaaattgtgttgacacagtctccactcaccctgtctttgtctccaggggaaangccaccctctcctgcagggccagtcagagtgtcaacaccaacttagccttggtttcagcagaagcctggccaggcctcccaggctcctcatgtatgatgctactcccacgacgggcccaccggcactcccagccaggttcaggtcggcaggccgggtctagggacaggtaccttcgacctcctaccaacccatccagccacgcctagagtctagaagtatttgacttagtttattacgttgtctagcgaggcgggtacaacgttcggccgtacgtcgtaccggtttccgggggaccgggggtaaccgtaaggggtcggtaacgttacgaaaccggtacgttggtacgggcgtacggaccgtaaccgtacgttcgttacgttccttacgtaccttcccgtttaccccgtcctaccg

SEQ ID NO: 284568 - DNA, 548 bp, Homo sapiens
  misc_feature: GYAE6OF02HPD3D.14.57.F02.1.454.CMB.1.raw
  modified_base (440)..(440): a, c, t, g, unknown or other
  misc_feature (440)..(440): n is a, c, g, or t
  modified_base (516)..(516): a, c, t, g, unknown or other
  misc_feature (516)..(516): n is a, c, g, or t
  modified_base (526)..(526): a, c, t, g, unknown or other
  misc_feature (526)..(526): n is a, c, g, or t
  modified_base (547)..(547): a, c, t, g, unknown or other
  misc_feature (547)..(547): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcactcccacagggccaaccggcactcccagccaggttcaggtggcaggcgggtctgggacaggcttcactctccaccatcagcacgaccctagacgtctagaagttattttgcttaagttttattacgtgtacagtacgngggcgggtactaagttcggccgtctccgtacgtttcgggggacggggtaaccagggtcgagttacgaacgtcgtgnggctgccacngtctgtctcacttccgtcccnc

SEQ ID NO: 284569 - DNA, 573 bp, Homo sapiens
  misc_feature: GYAE6OF02HLLCH.14.57.F02.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggtttcagcagaagcctggccaggctccaggctcctcatgtatgatgcactcccagacggccaccggcactcccagccaggttcagtggcaggcgggtctgggacagtacttcactctaccaccatcagcacgcctagagtctagaagtntttagctagtttattactgtcagtcgaggcgggactagttcggccgtacgtcgtaccggtttcgggaccgggggtaaccgtaagggtaggtaacgttacgaaccggtagtacggtcggtcgtcgtaccgtaccgtagtcgttcgttccttacgtacttccctcccgtaccg

SEQ ID NO: 284570 - DNA, 563 bp, Homo sapiens
  misc_feature: GYAE6OF02FL1VN.14.57.F02.1.454.CMB.1.raw
  modified_base (356)..(356): a, c, t, g, unknown or other
  misc_feature (356)..(356): n is a, c, g, or t
  modified_base (373)..(373): a, c, t, g, unknown or other
  misc_feature (373)..(373): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagctggccaggctcccaggctcctcatgtatgatgcactcccacacgggccaccggcactcccagcccaggttcaggtcggcaggcgggtcngggacagacttcactcncaccatccagcacgcctagagtctagaagtatttgactagtttattacgttgtctagcgacggcgggacgtaagttcggccgtcgtccgtacggtttccgggacgggggtaccgaagggtggacgttacgaacgtacgtggtcggcgtcggaccaccagttcgtcgttcttcgtacttccttcccgtacc

SEQ ID NO: 284571 - DNA, 600 bp, Homo sapiens
  misc_feature: GYAE6OF02I9HIR.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacgaggccgggggggtccctgacactctcctgtgcagcctcaggattctattttagcgaatatgccatgagctgggtcccgcaggctccgaggggaggggctggagtgggtctcgagcaatcaggttgttctagtggaagtacagttcgacgccgtctccggtggaacgggtccggtttctacctactcctccgaaggacgaacctaaattacccaaagaaccacctacttaatttcttacaatgacagtcctagaaacgaacgaaagaccgacgggtcgtagtttagttttggagtagaaagtagtaacgaagttctatagtaactaacccgtaagtttacggggacgggttccctttgagttgtacgtcgggg

SEQ ID NO: 284572 - DNA, 587 bp, Homo sapiens
  misc_feature: GYAE6OF02IZUAF.14.57.F02.1.454.CMB.1.raw
  modified_base (399)..(399): a, c, t, g, unknown or other
  misc_feature (399)..(399): n is a, c, g, or t
  modified_base (476)..(476): a, c, t, g, unknown or other
  misc_feature (476)..(476): n is a, c, g, or t
tcagcgtctagtaccacgaccggtgctcgatttagctcgatatagttgggtttggggtccagtgtgaggtgcagctgttggagtccgggggaggcttggtacagccgggggggtccctgacactctcctgtgcagcctcaggattcatttttagcgaatatgccatgagctgggtccgccaggctccagggaaggggctgggagtgggtctcagcaatcagtggttctagtggaagtacattcgacgccgtctccgtgaagggccgttctccatctccagagacaattccaagaacactctatttcttcaaatggacagcctgaaagacgaagacacgggcgtgtatttttgtgtagaaagatacgaagtctatgataccaatttgggagggtccttcntgtcgtggggccaagggcgcgtggtcaccgtctcttcgacgcctccaccgaacgggcccatccggtcccttccccgnggcctacccctccctcccaagccgccaccctcgtcggggccacgacggccggcccgtcgggccgtcggccgtgggtaccaacggtacccttacgttccctactacggaccg

SEQ ID NO: 284573 - DNA, 560 bp, Homo sapiens
  misc_feature: GYAE6OF02HSTI1.14.57.F02.1.454.CMB.1.raw
  modified_base (370)..(370): a, c, t, g, unknown or other
  misc_feature (370)..(370): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgacgggccaccggcactcccagccaggttcagtggcaggcgggtctgggacagacttcactcncacatcagcagcctagagtctgaagtatttgactagtttattactgtcagcaggcggggactaagttcggcccgtctcgtaccgtttccggggaccggggggaaccgtaaggggtggtaacgttacgaaacggtacgttggtacgggctcgactaccagttcgtcgttcttctacttccttcccgctacg

SEQ ID NO: 284574 - DNA, 533 bp, Homo sapiens
  misc_feature: GYAE6OF02GAEYX.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcaggcgggtctgggacaggcttcactctcaccatcagcagcctagagtctgaagtattttgactagtttattacgtgtcagcgagcgggactagttcggccgctacgtcgtttcgggcgggggtaccaagggtggagttacgaacgtactggtcggctgcacatcgtcggttcttcacttccttcccgtccg

SEQ ID NO: 284575 - DNA, 418 bp, Homo sapiens
  misc_feature: GYAE6OF02FGZPX.14.57.F02.1.454.CMB.1.raw
  modified_base (411)..(418): a, c, t, g, unknown or other
  misc_feature (411)..(418): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctattcttcaaatggacagcctgaaagacgaagacacgggcgtgtatttttgtgtgaaagatacgaagtctatgatacccaatttgggaggggcctttcatgtctggggccaaggggacgctggtcaccgtctcttcagcctcaccaagggccccatcggtcttccccctgcaccctctccaagagcacctctgggggcacagcggccctggctgcctggtcaggctacttccgtactagacgctgagcgggctggcaaggcgcatagnnnnnnnn

SEQ ID NO: 284576 - DNA, 550 bp, Homo sapiens
  misc_feature: GYAE6OF02GQGXE.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgcaggctccgagggaaggggctggagtgggtctcagcaatcagtggttctagtggaagtacattcgacgccgtctccgtgaacgggccgttctccatcctccagagacaattccaagaacactctatttctacaatgacagcctagaaagacgaagacacgggcgttagttattttgtagtagaaagataacgagtctatgaactacccgtaagtttgggacgggtcctttcgagttggtcgtacgggg

SEQ ID NO: 284577 - DNA, 525 bp, Homo sapiens
  misc_feature: GYAE6OF02HWKKI.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgcaggctccaggggaagggctggagtgggtggcagttgtgtggtatgacggaagtaatagaagtatgccgacgccgtgaagggccgattcaccatctccagagacaattaccaacaacatgttagtatctgctaaatgaaatagcctgagagaccgaggacacggactgtagtattactgtgtcgagagagtgggaggggtggtggacgtccgaggtgtagtag

SEQ ID NO: 284578 - DNA, 566 bp, Homo sapiens
  misc_feature: GYAE6OF02FT1LX.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcactcccagcccaggttccagtggcaggcgggtctggggacaggacttcactctcaccatcagcagcctagagtctgaagtattttgctagtttattacttgtacagcagcggggactaagttcgggccgtcgtccgtacgtttccgggccggggggtaccgaagggttcgggacgttacgaacggtaacgtggtaggctacggactaccgtagtcgttcgttccttactacttccgttcccgtacc

SEQ ID NO: 284579 - DNA, 765 bp, Homo sapiens
  misc_feature: GYAE6OF02H2ZIF.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggaccagagggaaccatggaacgccccagctcagcttctcttcctcctgctactctggctcccagataccaccggagaaattgtgttgacacagtctccactccacctgtctttgtctccgaggggaanagccaccctctcctgcgagggccagtcagagtgtacaacaccaacttagccttggttcagcagaagcctggccaggcctcccgaggcctcctcatgtatgatgacactccacgacgggccaccggcacgtccccgagtcccgtaggtttccgaggtcggaccgacggggtccggggttcgtagggggacctaacgggtacctttacacccttccgtacccgaacctaattccgaaacggtccgacgtacccgtaaggtacggttaccgttagggtaaacgtttagtttttacgtaccgtttaaggttttttaacgtttaccgtttacgttacgtaacggttaccggaaggggtaccgggggtacttaaacgggtttcccgggtacccgttaccgtttacccggtttaaccgggtttccgggggtaccgggggggtaaccggtaaagggttcgggtaacggtttaaccgaaacggttaccggttgggtacggtccgtacggacccgtaaccgtacgttccgttcggttacccgtttacgtaccgtttcccgtaccccgtaccg

SEQ ID NO: 284580 - DNA, 423 bp, Homo sapiens
  misc_feature: GYAE6OF02FNQ9C.14.57.F02.1.454.CMB.1.raw
  modified_base (415)..(423): a, c, t, g, unknown or other
  misc_feature (415)..(423): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaaggcccatcggtcttcccccctggcacccctcctccaagagcacctctgggggcacagcggcctgggctgcctggtcaggactacttccgtactagacgctgagcgggctggcaaggcgcatagnnnnnnnnn

SEQ ID NO: 284581 - DNA, 598 bp, Homo sapiens
  misc_feature: GYAE6OF02FM9EZ.14.57.F02.1.454.CMB.1.raw
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatccccacagggcccaccggcactcccagcccaggttcagtgcagcgggtctgggacagacttcactctcaccatcagcagcctagagtctagaagtatttgcttagtttattacttgtcagtcgaggcggggactaagttcgggccgtccgttccgtaccggttttccggggaccggggggtaaccgtaaggggtacggtaacggttaaccgaaacggtacgtcggtacgggtcgtacggaccgtaccgtagttaccgttcggttcttaccgtacgtttcccgttaccccgtcctacg

SEQ ID NO: 284582 - DNA, 571 bp, Homo sapiens
  misc_feature: GYAE6OF02H4IAN.14.57.F02.1.454.CMB.1.raw
tcagcgtctagtaccacgaccggtgctcgatttagctcgatatagttgggtttggggggaactgctcacgttagggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtcggcagcgggtctgggacagacttcgactctcaccatcagcagcctagagtctagaagtagtttgacgtagtttatttactgttcagtcgaggcggggacaagttcggccgtcgtccgtacgtttcgggcgggggtaccgaagggtggtaagttacgtaaacgacgttaggtcggtcgtcgacgaaccgtacgtcgttcgtccgttctacttcccgtttccccgaccgtacg

SEQ ID NO: 284583 - DNA, 557 bp, Homo sapiens
  misc_feature: GYAE6OF02F46LQ.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattctatttttagcgaatatgccatgagctgggtccgccaggctccgagggaaggggctgggagtgggtctcgagcaatcagtggttctagtggaagtacattcgacgccgtctccgtgaagggtccgttctccatctccagacgactaacttccaaagaacactcttatttctacaatggactagactagaaagacgaagacgacgggcgttagttattttgtgtagaaagtataacgaagtctatagactaccgtaagttgggacgggtccttagacgttgtcgtcggg

SEQ ID NO: 284584 - DNA, 566 bp, Homo sapiens
  misc_feature: GYAE6OF02JZ14S.14.57.F02.1.454.CMB.1.raw
  modified_base (269)..(269): a, c, t, g, unknown or other
  misc_feature (269)..(269): n is a, c, g, or t
  modified_base (336)..(336): a, c, t, g, unknown or other
  misc_feature (336)..(336): n is a, c, g, or t
  modified_base (497)..(497): a, c, t, g, unknown or other
  misc_feature (497)..(497): n is a, c, g, or t
tcagcgtctagtaccacgaccggtgctcgatttagctcgatatagttgggtttgggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctggacactctcctgtgcagcctcaggnttcattttagcgaatatgccatgagctgggtccgccaggctccgaggggagggctggagtgggtctnagcaatcgagtggttctagtggaagtacattcgacgtccgtcgtccgtggaacgggtccgtctccgatcgtcagagacaataccaagaacactctattacttacaaatgacacgacgtagaagacgaagacgacgggtcgtagttattttgtagtagtaanagtaacgtaagtctaatgattaacccgtagttacgggtacgggtacctttacgacgttgtcgtacgggg

SEQ ID NO: 284585 - DNA, 595 bp, Homo sapiens
  misc_feature: GYAE6OF02FLSCF.14.57.F02.1.454.CMB.1.raw
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (457)..(457): a, c, t, g, unknown or other
  misc_feature (457)..(457): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacaggccgggggggtccctgacactctcctgtgcagcctcaggattctatttttagcgaatatgccatgagcgtcggggtcccgccgaggcctccgaggggaaggggcgtgggagtgggtctcgagcaatcgagtggttctagtggaagtacattcgacgccgtctccgtgacgggtccgttctccatcncaganacaatccaagaacactcttatttctactaaatgaacngccgtagaaacgaacgaacgacgacgggtcgttagttattttggtagtagtaaagagtaacgaagttactaattaggtaacttaacccgtaaggtttacggggacgggttcctttacgtagttcggttcgtacggggg

SEQ ID NO: 284586 - DNA, 589 bp, Homo sapiens
  misc_feature: GYAE6OF02IMBN1.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggtccagtcagagtgtcaacaccaacttagcctggttcagcagaagcctggccaggcctcccaggctcctcatgtatgatgcatcccacgacgggccaccggcatcccagccaggttcagtggcagcgggtctgggacagacttcactctcaccatcagcagcctagagtctagaagtattttgctagtttatacttgtcagcgaggcggggtactaagttcggccgtacttccgtaccgtttccggggaccgggggtaaccgtaaggggtcggtaacggttacgaaacggtacgtcgggttacggtcgttcggacctaccgtacgttcgttcgttccgtttacctacgtttcccgttccccgtcctaacg

SEQ ID NO: 284587 - DNA, 588 bp, Homo sapiens
  misc_feature: GYAE6OF02HYSKW.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttgactctttcttgtggctattttaaaagatgtccagtgtgaggtgcagctgttggagtccgggggaggcttggtacaggccggggggtccctgacactctcctgtgcagcctcaggattctaatttttagcgaatatgccatgagctgggtcccgccgaggcctccgaggggaaggggctgggagtgggtctcagcaatcagttggttctaggtggaagtacattcgacgtccgtcgtccgtggaacgggtccgttctccatcctaccagacgaactaattaccaaagaacacttacttatttctacaaatggacagcctagaaacgacgaagacgacgggtacgtgtttattttgagtagaaagtataacgaagtcttaatcgtaacttaacccgtaagtttcggggacgggttcctttagagttcgtcgtacgggg

SEQ ID NO: 284588 - DNA, 570 bp, Homo sapiens
  misc_feature: GYAE6OF02HUIKJ.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcactcccgacagggccaccggcactcccagccaggttcaggtcggcgaggccggggtctgggacagacttcgactctacaccataccgagcacgtacctagacgtcgtagaatagtttcgacttagttttacttacgtgtacgagcgacggcgggactagttcggccgactcgtaccgttcgggcgggggtaccaaggggtcgagtaccgaacgtacgtggtggctcgacgcctacgtcgttcgtccttctaccgttccgtcccgtctacg

SEQ ID NO: 284589 - DNA, 595 bp, Homo sapiens
  misc_feature: GYAE6OF02GXG6K.14.57.F02.1.454.CMB.1.raw
  modified_base (201)..(201): a, c, t, g, unknown or other
  misc_feature (201)..(201): n is a, c, g, or t
  modified_base (374)..(374): a, c, t, g, unknown or other
  misc_feature (374)..(374): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggcctcccaggcctcctcatgtatgatgcatcccacgacgggccaccggcatcccagccaggttcaggtgcagcgggtctgggacagcttcactcacacancagcagcctagagtctagaagtatttgactagtttattacgtgtacagcgaggcgggactaagttcggccgtctccgtacggtttcggggaccgggggtaaccgtaaggggtggtaacggttaccgaaacggtacgttaggtacgggtcgtacggacctaacccgtacgttccgttcggttacctttaccgtacgtttcccgttaccccggtaccttaccg

SEQ ID NO: 284590 - DNA, 545 bp, Homo sapiens
  misc_feature: GYAE6OF02JI0V2.14.57.F02.1.454.CMB.1.raw
  modified_base (200)..(200): a, c, t, g, unknown or other
  misc_feature (200)..(200): n is a, c, g, or t
  modified_base (460)..(460): a, c, t, g, unknown or other
  misc_feature (460)..(460): n is a, c, g, or t
  modified_base (516)..(516): a, c, t, g, unknown or other
  misc_feature (516)..(516): n is a, c, g, or t
  modified_base (541)..(541): a, c, t, g, unknown or other
  misc_feature (541)..(541): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccacccgagaaattgtgttgacacagtctccactcaccctgtctttgtctccaggggaaanagccaccctctcctgcagggccagtcagagtgtccaacaccaacttagcctggtttccagcagaagcctggccaggctcccgaggcctccgtcatgtatgattgcatcccgacgacgggcccaccggcactccccaggcctaggttccagtcggcagcgggtctggacagtactcgactctcacactcagccagccgtagagtcgtagaatagtttgctagtttatacgtgtactagcaggcggatagttacgcaccgtntcgttcgggcgggtacaggtcgagtacgaacgtacgtgtacggcgtacgcaacgtntcgtagtcttactacgtcttcccgntacg

SEQ ID NO: 284591 - DNA, 558 bp, Homo sapiens
  misc_feature: GYAE6OF02I8VKF.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagagcctggccaggctcccaggcctcctcactgtatgatgcatcccagacgggccacgaggcactcccgagccaggttcagtggacaggcgggtctggggacagacttcactctcacatcagcacgcctagacgtctaggaaagtatttcgacttagttttagttacttgtcagcgaggcgggtactagtcggccgtctcgtacgtttccggggcggggacctagggtcggtacgtacgaacgtacgtggtcggcgtgaccacgtactcgttacgtctttactacgttcctaccccg

SEQ ID NO: 284592 - DNA, 703 bp, Homo sapiens
  misc_feature: GYAE6OF02H2CDP.14.57.F02.1.454.CMB.1.raw
  modified_base (380)..(380): a, c, t, g, unknown or other
  misc_feature (380)..(380): n is a, c, g, or t
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (438)..(438): a, c, t, g, unknown or other
  misc_feature (438)..(438): n is a, c, g, or t
  modified_base (460)..(460): a, c, t, g, unknown or other
  misc_feature (460)..(460): n is a, c, g, or t
  modified_base (484)..(484): a, c, t, g, unknown or other
  misc_feature (484)..(484): n is a, c, g, or t
tcagcgtctagtaccacgaccggtgctcgatttagctcgatatagttgggtttggggttacggatttgatgttacctgatgcttagaggcttttcctggaagcagggcatttgttgcttcagcaccgtagtgcctcgtcatcacgcctcagccttgtattttccggtatttcgcctaggaaaaccagcctacacgacgttaaaccgggacaaccgtccgcccggccaacatagccttcctcccgttcccccttcgcacgtaaaccaccaagtacaaggaataacttaacctgtttcccatcgactacgcctttcggcctcgccgttagggcgtactcacccctgaccccattaacgtgacacggtacctcgtctccgcgnggcggtctttccncccgtntttatcgtttactagtcgtcagtcattcgactacttcgnacttacccctccagtcacgtcncctacgacagccaactaccttcanacggtcttaacgaggaacctccgtaccccctaacaaccaaacgctaaagtaacgccgtacgcctacgccccgtacgacgttcccgttaccgggtcgaccgtacggtttttaacgggttcccgtttaccccccggttttaactcctttaccccggtttcccccgtaccctaacccgtttggtaacccggttttaacgtaaacccgtttccggtaaaccgg

SEQ ID NO: 284593 - DNA, 670 bp, Homo sapiens
  misc_feature: GYAE6OF02HLIT3.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggctattttaaaagatgtccagtgtgaggtgcagctgttggaggtccggggggaggcttggtacaggccgggggggtccctgacactctcctgtgcagcctcaggtattctatttttagacgtaatatgccatgagcgtgggtcccgccgaggcctccggaggggaacggggctgggagtgggtctcgagcaatcgtagttggttctaggtaggaatactattcgacgtccgtctccggtggaacgggtccgtttctctactcctaccagacgaactaaattaccaaagaacctacttacttattttacttacaaagttcggaacacggtacctaagaaacggtaaccgaaagaaccggacgggtacgtttacgtttaagttttttcggtagttaagaaagtacgtaaacggtaagtttacttaagtacgtaaccgttaacccgtaaaggttttacgggggaacgggttcccctttttaggacgtttacggttaccgggtacggggg

SEQ ID NO: 284594 - DNA, 585 bp, Homo sapiens
  misc_feature: GYAE6OF02HKJ4H.14.57.F02.1.454.CMB.1.raw
  modified_base (388)..(388): a, c, t, g, unknown or other
  misc_feature (388)..(388): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggcctccccgaggcctcctcatgtatgatgcactcccagacgggccaccggcactcccagcctaggttcagtggcgaggcggggtctgggacaggacttcactctacaccatcngcagcctagacgtctagagtatttcgacgttagtttattactgtcagcgtaggcgggtctagtcggccgtcgtccgtaccggttcgggaccgggggtacgtaggtcggaacgtttaacgaacggtaacgttcggtcggtctacggcctaccgtagttccgttacgttccttacgtacgttcccgttaccccgtaccg

SEQ ID NO: 284595 - DNA, 558 bp, Homo sapiens
  misc_feature: GYAE6OF02F96R8.14.57.F02.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (316)..(316): a, c, t, g, unknown or other
  misc_feature (316)..(316): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgctccaggggaaanagccaccctctcctgcagggccagtcagagtgtcaacnccaacttagcctggtttcagcagaagcctggccaggctccaggcctcnatgtatgatgcatcccancgggccaccggnactcccagccaggttcagtgcagcgggtctgggacaggcttcactctcacntcagcancagcgtcngagtattgactagttattactgtacagtcgaggcggctaagtcggccgtctacgtacgttcgggaccgggggtactaagggtcggtaacggttaccaaaggtaccgtaggtacggtcgtacgccgtaaccgtcgttacgtcgttacgttccgtacgttccgtttcccgacttaccg

SEQ ID NO: 284596 - DNA, 593 bp, Homo sapiens
  misc_feature: GYAE6OF02GMOBO.14.57.F02.1.454.CMB.1.raw
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccgggagaaattgtgttgacacagtctccactcaccctgtctttgtctccaggggaaagacgccaccctctcctgcagggccagtcagagtgtcaacaccaacttagccttggttcagcagaagcctggccaggctcccaggctcctcatgtatgatcgcactcccagcgggccaccggcactcccagccaggttcagtcggcaggcggtctgggacaggacttcactcncacatcagcacgcctagngtcgagtaagtatttgactagttttattacgtgtacagcgtaggcgggtacaagttcggaccgctaccgtacgtttccggggcgggggtaccgaagggtcggtaacgttaaccgaaagggtacgttcgggtacggcgtacggacctaaccgtacgttcgttacgttccgtttaccgtacgtttcccgttccccgacgttacg

SEQ ID NO: 284597 - DNA, 608 bp, Homo sapiens
  misc_feature: GYAE6OF02IHG37.14.57.F02.1.454.CMB.1.raw
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccaggctcccaggcctcctnatgtatgatgacatccccagacgggccaaccggcactcccagccaggttcaggtggcaggcgggtctggggacnggtacttcactctacacatcagcagcctagacgtctagaagtagttttcgacgttagtttattactgttactagcgtacgggcgggactaagttcggccgtcgttccgtaccggtttccggggccgggggtaaccgtaaggggtaggtaacggttacgaaaccggtacgttacggtaggtccgtacgaccgtaaccgtacgtccgttcgttccgtttacctacgtttcccgttccccgacctacg

SEQ ID NO: 284598 - DNA, 568 bp, Homo sapiens
  misc_feature: GYAE6OF02I6XHM.14.57.F02.1.454.CMB.1.raw
  modified_base (310)..(310): a, c, t, g, unknown or other
  misc_feature (310)..(310): n is a, c, g, or t
  modified_base (407)..(407): a, c, t, g, unknown or other
  misc_feature (407)..(407): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgttagcacctccttagcctggtaccaacagaaacctggccaggctcccagcctcctcatctctgatgccttccaacgngggccacgtggccactccccagccgaggttcagtggcaggtggtctgggacagtacttcactctcaccatcacgctccctagacgtccgtaggattntttttaggtattttatcgtgtcagtcagttatgctagctcggcccttccgtacgtttcgggcggaaggtaccgaagggtgaacgtactaccgaagtacgtggtacgcgtcgacctaccgtattcgttcgttaccttcacgttccccgtacccgtctagtcg

SEQ ID NO: 284599 - DNA, 665 bp, Homo sapiens
  misc_feature: GYAE6OF02J04CF.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaagatgtccagtgtgaggtgcagctgttggaggtccgggggaggcttggtacgaggccgggggggtccctggacactctcctgtgcagcctcaggattctattttagcgtaatatgccatgagcgtgggtccgcgaggcgtccgagggaaggggcgtgggaggtcgggtctcgagactaagtcgtaggttcggttacgtaggtaggtaagtaacgtagttcggacgtcccgtcgtaccggttagggaacggggtccggtttctccacttccgtaccgaagtacgaactaacgttaccaaaggtaaacctacttacttaacttttctaactaaaacgttcggaactacgtaccgtagaaacgaacgaaacggaccgacgggtacgtagtttacttttggtagtagtaaagactaacggtagtctaagttgtaacgttaaccctaaggtttacggggacggttaccgtttacgacgttcggtccggtacgggg

SEQ ID NO: 284600 - DNA, 617 bp, Homo sapiens
  misc_feature: GYAE6OF02IKFD7.14.57.F02.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (342)..(342): a, c, t, g, unknown or other
  misc_feature (342)..(342): n is a, c, g, or t
  modified_base (375)..(375): a, c, t, g, unknown or other
  misc_feature (375)..(375): n is a, c, g, or t
  modified_base (389)..(389): a, c, t, g, unknown or other
  misc_feature (389)..(389): n is a, c, g, or t
  modified_base (399)..(399): a, c, t, g, unknown or other
  misc_feature (399)..(399): n is a, c, g, or t
  modified_base (422)..(422): a, c, t, g, unknown or other
  misc_feature (422)..(422): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgctccgaggggaaagngccaccctctcctgcagggccagtcaagngtgtacaacaccaacttagccttggttcagcagaacgcctggccaggcctccgaggctctcatgtatgatgcactccagaggccacggcactccagccagtcagtgacnggcgggtctgggacagacttcgactcacaccgntacagcaagctagntctagaagtntttgctaagtttacttatcgtanagtcgaggacgggtcctaaagttccggaccactaccgtacggtttccgggggaacgggggtaaccgtagggtacgggtaacgtttaaccgaaacgggtaaccgttgggtacggggcccttacggaacccggttaaaccacggtttaccgttacggttaccctttacccggaacttttccccggtaccccgttacc

SEQ ID NO: 284601 - DNA, 581 bp, Homo sapiens
  misc_feature: GYAE6OF02GD2WL.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattcatttttagcgaatatgccatgagctgggtccgccaggctccgaggggaaggggctgggagtgggtctcagcaatcagtggttctaggtggaagtacattcgacgccgtctccgtggaacgggtcccggtttctccatcctccagagacaattccaagaacactctaatttcttacaaatgacagcctagaaacgacgaagacgacgggcgttagttattttgtagtagaaagattaacgaagttctaatgtaacttaacccgtaagtttcggggacgggttaccctttcgagtttcggtcgtaccggggg

SEQ ID NO: 284602 - DNA, 537 bp, Homo sapiens
  misc_feature: GYAE6OF02GEQ1T.14.57.F02.1.454.CMB.1.raw
  modified_base (287)..(287): a, c, t, g, unknown or other
  misc_feature (287)..(287): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggctcctnatgtatgatgcatccccacgacgggcccaccggcactcccagccaggttcagtggcagcgggtctgggacagacttcactctcaccatcagcagcctagagtctagaagtatttgctagtttattacgtgtcagcgagcgggctaagttggccgtctcgtacgtttcgggcgggggacctaagggtcggagttacgaacgtacgtggtcggcgtgacacctgtcgtcgtcttactctccgttcccgctac

SEQ ID NO: 284603 - DNA, 744 bp, Homo sapiens
  misc_feature: GYAE6OF02J0LI6.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacaccaacttgcctggttcagcagaacgcctggccaggctccagctcctcatcgtatgataggcctactcccacgaggggccctaccggcaactccccgaaggcccgtaaggttccaaggtcgggacctaggccggggttactcggggacctagggtaccctttcgaaccgttcgttaccaacccgtacgtacaccgggtacacgcccgttagaacgttcgtacggtaaattcgttttagtacctaggttttactaacgttggttaccaggttacgacggggtaccggggtataacgggtttacggccggtaccgttacggtttaaccgggttttaccggggaccggggggttaaccgttaaacgggggttcggtaaacggttttaacccgaaacggttacccggttaggttaccgggtacccgtttacggaccgttaacccgtaaccggtttccgttacgggtttaccgttacgtaaccgttttccccggttacccggtcctttaacgg

SEQ ID NO: 284604 - DNA, 562 bp, Homo sapiens
  misc_feature: GYAE6OF02JD91H.14.57.F02.1.454.CMB.1.raw
  modified_base (298)..(298): a, c, t, g, unknown or other
  misc_feature (298)..(298): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttcttgtggctattttaaaagatgtccagtgtgaggtgcagctgttggagtccgggggagcttggtacagccggggggtccctgacactctcctgtgcagcctcaggattcattttagcgaatatgccatgagctgggtccnccaggcctccaggggaagggctgggagtgggtctcagcaatcagtggttctagtggaatacattcgacgccgtctccgtgaacgggtccgttctccactctcagacgacaatccaagaacactactattctactaaatgacagacctagaaacgacgaagacgacggacgtgttatttgagttagaagtatagaagtcgtaatgtaactaacccgtaagtttacggggtacgggtccgtttacgtacgttacggtcgtacgggg

SEQ ID NO: 284605 - DNA, 609 bp, Homo sapiens
  misc_feature: GYAE6OF02G0THQ.14.57.F02.1.454.CMB.1.raw
tcagcgtctagtaccacgaccggtgctcgatttagctcgatataggttggggtttggggaggaactgctcagttaggacccagagggaaccatggaagccccagcgtcagcttctcttcctcctgctactctggctcccagataccaccggagaaagttcgtgttgacaccagtctccactcaccctgtctttgtctccgaggggaaagagccaccctctcctgccagggccagtcagagtgtacaacaccaacttagccttggtttcagtcagaagcctggccaggcctcccaggcctcctcatcgtatgatgcatcccagacgggccaccgggcactcccgagcctaggttcagtggcaggcgggttcgcggactagtactcactccgaccactactcgacgtcgacgtaccgtagactgaggtaattagttacgatttagtttactcgttagtacgacgtcgacgggcgtataggttccgccgtacgtccgttacgggttccggggacgggtacgtaggtacggtacgtaacgaacgtggtcgtcggtactcgccgtaactcgttaccggtctttaccgcccttccgttaccccgtacccgtaccg

SEQ ID NO: 284606 - DNA, 591 bp, Homo sapiens
  misc_feature: GYAE6OF02F9JLS.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggcctcccaggcctcctcatgtatgatgcatcccacacgggcccaccggcactcccagccaggttcagtggcagcgggtctgggacagacttcactctcaccatcagcagcctagagtctagaagtattttgctagtttattacttgtcagccgagcggggtactaagttcggcccgtctaccgtaccgtttcggggaccggggggaccgtaaagggtggtaacgttaccgaaacggtaacgttcgggtcggccgtacggtaccgtaccgtagttccgttacgttcctttaccgaccttcccgtttccccgtaccc

SEQ ID NO: 284607 - DNA, 578 bp, Homo sapiens
  misc_feature: GYAE6OF02HXS9Y.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttacgcctggtttcagcagaagcctggccaggctcccaggcctcctcatgtatgatgcactcccacgacgggccaccggcactcccagcctaggttcaggtcggcaggcgggtctgggacagcttcactctcacatcagcacgcctagagtctagaagttatttgcttaagtttattacttcgttcacgacgtacggcgggacaacgttcggaccgtctcgtaccggttcggggaccgggggtaccgtaaggggtaggtacgttacgaacggtacgtcggtacggcgtcgacgaccgtacgtcgttcgtcttcctcgttcccgttcccgcctac

SEQ ID NO: 284608 - DNA, 597 bp, Homo sapiens
  misc_feature: GYAE6OF02G0HJO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggaggtccgggggaggcttggtacgaggcccgggggggtccctgacactctcctgtgcagcctcaggattctatttttagcgaatatgccatgagctgggtcccgccgaggctccgaggggaagggctggaggtggtctcgagcaatcgaggttcggttcgtaggtggaagtactagttcgacgcccgtctccggtaggaacgggtcccgtctcctactctccagacgactaactaccaacgaacactacttacttacttacaatagacacgcgtagaacgaacgaacgacgacgggtcgtagttagtttgtagtagaagtagtacgtaagtctagtagtactaaccgtaagttacgggtacgggtcctttacgtacgttcggtcgtacgggg

SEQ ID NO: 284609 - DNA, 574 bp, Homo sapiens
  misc_feature: GYAE6OF02IGF80.14.57.F02.1.454.CMB.1.raw
  modified_base (324)..(324): a, c, t, g, unknown or other
  misc_feature (324)..(324): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
  modified_base (498)..(498): a, c, t, g, unknown or other
  misc_feature (498)..(498): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattctatttttagcgtaatatgccatgagctgggtcccgcaggctccgagggaggggntggagtggtctcgagcaatcgagtggttctagtggaagtactagttcgacgtccgtctccggtaggaacgggtccggtttccnctactcctccgaganacattaccaagaacactacttatttctacaaatcggacagcctagaaagacgaagacgcggacttagttattttgngttagaagtagtaacgagtctatagtaactacccgtaagtttcggggacggtcctttacgattcggtcgtacgggg

SEQ ID NO: 284610 - DNA, 593 bp, Homo sapiens
  misc_feature: GYAE6OF02IM0BP.14.57.F02.1.454.CMB.1.raw
  modified_base (237)..(237): a, c, t, g, unknown or other
  misc_feature (237)..(237): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (372)..(372): a, c, t, g, unknown or other
  misc_feature (372)..(372): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
tcagcgtctagtaccacgaccggtgctcgattttagctcgatatagttgggtttggggggaactgctcagttaggacccagagggaaccatgggaagccccagcctcagtcttctcttcctcctgctactctggctccagataccgaccggagaaattggtgttgacacagtctccactcaccctgtctttgcctcccgaggggaacacgccacctcctcctgcagggccagtcagngtgtcacaccaactacgcctgttcagcagacgctggcaggcctcccgagcctcctnatgtangatgccactcccgagacgggccaccggcactcccgagccgtaggttccagtcggcaggtcgggtctagggacnggtacttcactcaccactatcagccacgtcctagacgtctaggaattgttgagttagtttntacgttntacgagtcgacggtcggtactaacgttcgccgtctaccggtaccggttcggggaccggggtaacgtaagggtacgtaacgttaacgaaacgtacgtaggtcggcgttaccgactactactcgttacgtcttacacgtttcccgtacctactac

SEQ ID NO: 284611 - DNA, 564 bp, Homo sapiens
  misc_feature: GYAE6OF02ISXOC.14.57.F02.1.454.CMB.1.raw
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccacccctctcctgcagggccagtcagagtgtcaacaccaacttagcctggttcagcagaagcctggccaggcctcccaggctcctcatcgtatgatgcactcccacgacgggccaccggccactccccagccaggttcaggtggcagcgggtcngggacagtactcactctcaccntacagcagacctagacgtctagaagtgtttgacttagtttacttacgttgttcagcgaggcgggactagtcggccgcttcgacggtttcgggcggggactagggtgtaacgttacgaacgtacgtggtcggtctggacctaccgagtcgttcgttcttacgtacgttcccgttcccgcctacg

SEQ ID NO: 284612 - DNA, 630 bp, Homo sapiens
  misc_feature: GYAE6OF02GWHZ3.14.57.F02.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggcctccaggctcctnatgtatgatgcactccccacgacgggcccaccggcactcccgagccgtaggttcaggtggcgaggccggggtctggggacaggtaccttcgactccgtacaccatcacgcacgcctaagacgtcgtagtaagtattttcggacttaagttttatacttgttacgacggtcgaaggcgggtactaaggttcggccgtcgtcgtacggtttccggggacgggggtaccgtaagggtcggtaacgttacgaaacggtcgttagggtaccggtcgttacgacccgtaaccgtacgttccgttacggttcctttacctaccgtttcccgttaccccgcttaaccgg

SEQ ID NO: 284613 - DNA, 596 bp, Homo sapiens
  misc_feature: GYAE6OF02GPPLU.14.57.F02.1.454.CMB.1.raw
  modified_base (289)..(289): a, c, t, g, unknown or other
  misc_feature (289)..(289): n is a, c, g, or t
  modified_base (377)..(377): a, c, t, g, unknown or other
  misc_feature (377)..(377): n is a, c, g, or t
  modified_base (402)..(402): a, c, t, g, unknown or other
  misc_feature (402)..(402): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggcctcctnatgtatgatgcactcccacgacgggcccaccggcactcccagccaggttcagtcggcaggcgggtctgggacagacttcactctcacntcagcacgactagacgtctagagtntttgacttagtttactactgtacagacgacggacgggactaggttcggccgtcttccgtacggtttccggggacgggggtaacctaaggggtacgtacggttaacgaaacggtcgtagggtaccggtcgtacggaccgtaaccgtagttccgtacgttcttaccgtacgttcccgttaccccgtacttacccgg

SEQ ID NO: 284614 - DNA, 675 bp, Homo sapiens
  misc_feature: GYAE6OF02JX0IW.14.57.F02.1.454.CMB.1.raw
  modified_base (609)..(609): a, c, t, g, unknown or other
  misc_feature (609)..(609): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtcttgtctccgaggggaaagagccaccctctcctgcagggccagtcagagtgtcaacaccaacttagcctggtttcagcagaagccgtggccgaggcctcccgacggcctccgtcagttcgtatcggatgcactcccacgcggcccacggcactcccgagccgtacgttcacggtggaccgacggcggtcgtgggaaccacggtacctaccgacgtcctaccgaacctagtaccacggcacgtacccgtaggacgttcgtagtaagttacgttttcgacgtaacgttttagtacgttcgttacgacggtacgtacgggcgggtaactaacgttcggaacccgtcgtaccgtaccggttcgggggaccggggtaaccgtaagggtacggtacggttaacgaacggtacgttacgggtacgttaccggngtaacccgtaaccgtggtttacccgtcgtttaccgttcgtaaccgtttccccggtccccgtaaccg

SEQ ID NO: 284615 - DNA, 537 bp, Homo sapiens
  misc_feature: GYAE6OF02GG4LZ.14.57.F02.1.454.CMB.1.raw
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (387)..(387): a, c, t, g, unknown or other
  misc_feature (387)..(387): n is a, c, g, or t
  modified_base (436)..(436): a, c, t, g, unknown or other
  misc_feature (436)..(436): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcatcccacncggccaccggcatcccagccaggttcagtgcaggcgggtcnggggacagacttcactctcaccatcagcagcctagctcngaatatttgcttaagtttatacgtgtcagcaggcgggactaagtggccnctctacgtttcgggcgggggacctaagggtggaacgttcaaacggtacgtcggtgggctgaccaccatccgttgttccttacctcttccgttccccgctac

SEQ ID NO: 284616 - DNA, 641 bp, Homo sapiens
  misc_feature: GYAE6OF02JB4CB.14.57.F02.1.454.CMB.1.raw
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacaccaacttagccttggttcagcagaagcctggccaggcctcccaggctcctnatgtatgatgcactcccagacgggcccacggcactcccgagcccgtaggttcaggtcggacaggtcggggtctggggacctaggtaccttcgaccttctaccgaacccgtatccgaagtccgacgtacccgtaagacgttacgtagtaagttacgttttaggacttaagttttacgttacgttcgttacgtacgtacgtacgggccggggtactacggttcggaccgtaccgtcgtaccggtttcgggaccgggggtaccgtagggtcggtacgttacgaacgtacgtggtacgggtctacgccgtaacctacgtcgttcgttccttcgtacgttcccgttcccgtacctacg

SEQ ID NO: 284617 - DNA, 608 bp, Homo sapiens
  misc_feature: GYAE6OF02F0QG8.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacgggccaccggcactcccagccaggttcagtcggcaggcgggtctgggacagacttcactctcaccatccagcagcctagagtctagaagtattttgactagttttattacgttgtctagcgagcggggactagttcggccgtcgtaccgtacggtttccgggggaccggggggtaaccgtaaaggggttcgggtaacggttaccgaaaccggtaacgttagggtcgggtccgttacggaccgtaacccgtagttccgttcggttcctttaccgtacgttcccgtttcccccggtaccc

SEQ ID NO: 284618 - DNA, 652 bp, Homo sapiens
  misc_feature: GYAE6OF02JARIN.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaangccacctctcctgcagggccagtcagagtgtacaacaaccaactacgtcgttcgttacacgacgagaacgaccgtcggaccgacggaccgtaccgccacggactacctcgactagtactagactacgtaccgactaccgaccgacggaccgaccggaccgactacccgacgaccgacggttacgacgtacggacgacgcgggtacgtagggacgtacgactacactactacaccactacacgacacgacgtacgagtacgtagtagtagtttagtactagttacgttactagtacgtacgacgacgtacgggtacgacgtacggtaccgtacgtacgtacggttacgggacggggtacggtaacggtacggtacgtacgtaacggtaacgtcgtacggtgacgtacgtacgtacgttacgttacgttacgtacgttaccgttaccgtaccg

SEQ ID NO: 284619 - DNA, 706 bp, Homo sapiens
  misc_feature: GYAE6OF02JGEN0.14.57.F02.1.454.CMB.1.raw
  modified_base (515)..(515): a, c, t, g, unknown or other
  misc_feature (515)..(515): n is a, c, g, or t
  modified_base (631)..(631): a, c, t, g, unknown or other
  misc_feature (631)..(631): n is a, c, g, or t
tcagcgtctagtaccacgaccggtgctcgatttagctcgatatagttgggtttggggtcgtgagagaggagcccagtcctgggatcttcaggtgttttcatttggtgatcaggactgaacagagagaactcaccatggagtttgggctgagttggcgtctttcttgtggctattttaaaagatgtcctagtgtgaggtgcagctgttggagtccgggggagtcgttggtacgaggccgggggggtccctggacacgtctccgtgtagcagcctcaggacttcattttagcgtaaatatagcccatcgagcttcggggtccgtcccgaggcctaccgaggggtaacggggccgtgggtaggtcgggttccgtcgtaagccgtaaatcgacggttggtttcctaagtagggaacgttactagttccggaccgtccgtctccggtaggaacgggtccgttctccagttccgcagacgacctaaacttccgaaagaacacccgttctaagtttccttanaaaacttcgggaacacggccttaacgggaaataaccggaaagaaccgacggggtaccttaggtttaaacgtttttggacgttaagaaaaggttctaaacgggtaacgttacgttanacggttaaaccgtcccttaaaagggttcggggtaacggggttaccctttacgaaggtttcggtcggtaccggggg

SEQ ID NO: 284620 - DNA, 566 bp, Homo sapiens
  misc_feature: GYAE6OF02FNFKH.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtcccgccaggctccgaggggaaggggctgggagtgggtctcagcaatcagtggttctagtggaagtacattcgacgccgtctccgtggaacgggtccggttctccatcctccagagacaatccaagacactctattctcaaatgacagcctagaaagacgaagacgacgggctagttattttgtgtagaaagtataacgtaagtctaatcggtaactacccgtaagtttcggggacggggttaccctttacggattggtcgtacgggg

SEQ ID NO: 284621 - DNA, 596 bp, Homo sapiens
  misc_feature: GYAE6OF02IW6OB.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacaggcccgggggggtccctgacactctcctgtgcagcctcaggattctattttagcgtaatatgccatgagctgggtcccgccaggctccgaggggaaggggctgggaggtgggtctcgagcaatcagtggttctaggtggaagtacagttcgacgtccgtctccggtggaacgggtcccgtttctccatcctccagacgacaattccaaagaaccactacttatttctacaaatcgacacgacctagaaagacgaagacgtacgggtcgtagtttattttggtagtagaaagtataacggaagttctaagtacgtaactaacccgtaagtttcggggacgggttcctttacgagttcggtcgtacgggg

SEQ ID NO: 284622 - DNA, 559 bp, Homo sapiens
  misc_feature: GYAE6OF02F9LJC.14.57.F02.1.454.CMB.1.raw
  modified_base (529)..(529): a, c, t, g, unknown or other
  misc_feature (529)..(529): n is a, c, g, or t
  modified_base (554)..(554): a, c, t, g, unknown or other
  misc_feature (554)..(554): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccgaggcctcctcatgtatgatgcactccccacgacgggcccaccggcactcccagccaggttcaggtggcaggcgggtcgcgggacagcttcactcacacatccagcacgcctagacgtcgtagtaagttatttgacttaagtttacttacgttgtacaggcgaggcgggactaggtcggccgctcgtccgttcggggcggggtaccgtagggtggtaacgtacgaacgtagtggtaggctgaccacgtntcgtcgttctacctacttccgtccnctacg

SEQ ID NO: 284623 - DNA, 568 bp, Homo sapiens
  misc_feature: GYAE6OF02HZX2I.14.57.F02.1.454.CMB.1.raw
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (394)..(394): a, c, t, g, unknown or other
  misc_feature (394)..(394): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggcctcccgaggcctcctcattgtatgatgcatcccagacgggcccacggcactcccagcctaggttcaggtggcaggcgggtctgggacagtacttcactcncacntcagcagcgtagngtcgtagagtatttgtactagtttattactagtcagcgaggcgggactagttcggccgtcgtcgtacggtttccggggacgggggtaaccgtagggtacggtaacgttacgaaacgtacgtggtcggcgtcgcctactacgtcgtcgttcttcgtacttcccgttcccgctacg

SEQ ID NO: 284624 - DNA, 592 bp, Homo sapiens
  misc_feature: GYAE6OF02GPSGS.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgagggccaccggcactcccagccaggttcagtggcagcgggtctgggacagacttcactctcaccatccagcagcctagagtctagaagtattttgcttagtttattacttgtacagcgacggcggggtctaagttcggccgtcttccgtaccgtttcggggccgggggtaaccgtaagggtcggtaacgttaccgaaaccgtacgtggtacgggtcgtaggaccgaaccgtacgttaccgtcgttaccgtttcctaacgtttccccgttccccggaccttaacg

SEQ ID NO: 284625 - DNA, 753 bp, Homo sapiens
  misc_feature: GYAE6OF02HI8DP.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatccccagacgggcccaccggcactccccgagtcccgagggttccaggtcggcgacggtccggggtacgtcggggaacctacggtacctttccaccgttcctaccaacccgattacccgaaggtccgaacggtacccgttaaggtacggttaccgttaaggtaaacggttagttttttacgtaacgtttaaggttttttaactttaaccgttacggttacccgtaaggtaccggtaacggggtaccgggggacttaaacgggttcgggacccgttaccggttaccgttaaccggggttttcccggggggaccgggggggtaaccgttaacgggggttacggtaacgggtttaccgaaaacggtacgttacgggttacggtccggttacgaccgtaccgtacgttccgttacgttccttccgttaaccgtttccccgttacccgaccttaccg

SEQ ID NO: 284626 - DNA, 590 bp, Homo sapiens
  misc_feature: GYAE6OF02ISPIT.14.57.F02.1.454.CMB.1.raw
tcagcgtctagtaccacgaccggtgctcgatttagctcgatatagttgggtttggggggaactggctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacacggggcccaccggcactcccagcctaggttcaggtggcaggcgggtctggggacaggtacttcactctcaccatcagcagcctagagtctagaagtattttgacttagttttattacttgtcagcaggcggggactaagttcggccgtcgtaccgtaccgtttccggggacgggggaccgtaaggggtcggaacggttacgaaacggtacgtaggtcgggtactcggacctacctagttccgttggttccttaccgtacttcccgttaccccggtcctacg

SEQ ID NO: 284627 - DNA, 543 bp, Homo sapiens
  misc_feature: GYAE6OF02FZINP.14.57.F02.1.454.CMB.1.raw
  modified_base (404)..(404): a, c, t, g, unknown or other
  misc_feature (404)..(404): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattcatttttagcgaatatgccatgagctgggtcccgccaggctccaggggaaggggctgggagtgggtctcgagcaatcagtggttctagtgaagtacattcgacgccgtctccgtgaagggtccgttctccatcncagagacaatccaagaacactctattcttcaatgacagcctgaaagacgaagacgacgggcgttgtattttgtgtagaaagatacgaagtctatgacttacccaagttttcgggaggggtcctttagatgtctacgggg

SEQ ID NO: 284628 - DNA, 568 bp, Homo sapiens
  misc_feature: GYAE6OF02GDCG2.14.57.F02.1.454.CMB.1.raw
  modified_base (494)..(494): a, c, t, g, unknown or other
  misc_feature (494)..(494): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccgagggaaggggctgggagtgggtctcagcaatcagtggttctagtggaagtacattcgacgtccgtctccgtgaacgggtccgttctccatcctccagacgacaattccaaagaacactcttatttctacaatggacagacctagaaacgaacgaagaccgacgggtcgttgttagtttttgngtagaagtagtacgaagtctatagtaactaaccgtaagtttgggacgggtcctttacgagttcgtcgtacgggg

SEQ ID NO: 284629 - DNA, 527 bp, Homo sapiens
  misc_feature: GYAE6OF02G9JIN.14.57.F02.1.454.CMB.1.raw
  modified_base (202)..(202): a, c, t, g, unknown or other
  misc_feature (202)..(202): n is a, c, g, or t
  modified_base (516)..(516): a, c, t, g, unknown or other
  misc_feature (516)..(516): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaanagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagatctgaagtatttgctagtttattactgtctagcaggcgggacaagttggccgctccgtacgtttcggggccggggtaccgagggtcggagttacaacggtacgtggtggactgctaccagtctcgtcttcncttcctcctcc

SEQ ID NO: 284630 - DNA, 805 bp, Homo sapiens
  misc_feature: GYAE6OF02IEM12.14.57.F02.1.454.CMB.1.raw
  modified_base (260)..(260): a, c, t, g, unknown or other
  misc_feature (260)..(260): n is a, c, g, or t
  modified_base (267)..(267): a, c, t, g, unknown or other
  misc_feature (267)..(267): n is a, c, g, or t
tcagcgtctagtaccacgaccggtgctcgatttagctcgatatagttgggtttggggctgagagaggagcccagtcctgggatcttcaggtgttttctatttggtgatcaggactgaacagagagaactcaccatggagtttggctgagttggctctttcttgtggctattttaaaagatgtccagtgtgaggtgcagctgttggagtccgggggagcgttggtacaggccgggggggtccctgacgactctcctgtcgnacgcctnaggattctattttagcgtaatatgccatgagccgtcgggtccgaccgaggcctccgacgggaaggggccgtagggaggtcgggtctacgagacgaagtcgagttcggtacgtaggtagggtaagtaacgttaacttcgaaccggtcccgtacgtcccggtacggaacggggtcccgggtttccgtaccgacttcctcccgaagtaacgtaacctaagttaccaaacgtaaacacctacttaactttcctttaacaaacgtttacggaacccgtaagtacccgttaaggaaaacggaaccgtaaaacgggacccgtaaccggggtaccggtttaggttttaaccggttttttaggttacgggttaaccggttaaaaaggtacggttttaaaaccgggaaaaccggtttccggttaaactttaacggggaaacccttttaaacccccggtttaaagggtttttaaccggggggtaaccgggggtttaccccttttttaaccgggtaagttacccggtttacccgggttaacccggggggg

SEQ ID NO: 284631 - DNA, 595 bp, Homo sapiens
  misc_feature: GYAE6OF02GQ8N0.14.57.F02.1.454.CMB.1.raw
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
tcagcgtctagtaccacgaccggtgctcgatttagctcgatatagttgggtttgggtgcccaagctgctggagggcacggtcaccacgctgctgagggaggcttggtacagccgggggggtccctgacactctcctgtgcagcctcaggattcatttttagcgaatatgccatgagctgggtccgccaggctccagggaaggggctgggagtgggtctcagcaatcagtggttctagtggaagtacattcgacgccgtctccgtggaagggccggttctccatctccagagacaattccaagaacactctatttcttcaaatggacagcctagaaagacgaagacacgggcgtgtattttgtgtagaaagataacgaagtctatnataccaagtttgggagggtctttnatgtcgtgggcaagggacgcgtggcaccgttctcttcagcctccaccgaacgggcccagtccggttcccttccccccgtggccctaccccgtcctacccgaagacgaccctaccgtccggtcgggggaccaccgtacggccggtccccgtcgggccgtggcccgttgggtaccgaacggtaacccg

SEQ ID NO: 284632 - DNA, 567 bp, Homo sapiens
  misc_feature: GYAE6OF02F0PZM.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccgagggaaggggctgggagtgggtctcgagcaatcaggtggttctaggtggaagtacattcgacgccgtctccgtgaacgggtccgttctccatctccagagacaatccaagaacactctatttctacaaatgacagcctagaaagacgaagacgacgggcgttagttatttttggtgttagaaagtatacggaagtctatagaacttacccgtaagtttcggggacgggttcctttacgagttcggtcgtacgggg

SEQ ID NO: 284633 - DNA, 436 bp, Homo sapiens
  misc_feature: GYAE6OF02FR97A.14.57.F02.1.454.CMB.1.raw
  modified_base (421)..(436): a, c, t, g, unknown or other
  misc_feature (421)..(436): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggagggcctttcatgtctggggccaagggacgctggtcaccgtctcttcagcctccaccaagggcccatcggtcttcccccctggcacccctcctccaagacgcacctctgggggcacagccggccctgggctcgcctggtcaaggactacttccgtactagacgctgagcgggctggcaaggcgacatagnnnnnnnnnnnnnnnn

SEQ ID NO: 284634 - DNA, 741 bp, Homo sapiens
  misc_feature: GYAE6OF02HSOX6.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgttctttgtcctccgaggggaaagacgccaccctctcctgcgacgggccagtcagagtgtacaacaccaacttagccttggttcagcagaacgccgtggccgaggcctccgaggcctcctcagtgtatgatgccacgtcccacgacggcccaccggccactcccgacgccgtaggttcgaggtcggaccgacgggtccgggttacgtggggaacctacggtaccttaccgaccttcctacccgaacctacgtccgacgtaccgtacggtcccgttaaggtaccgttacgtaaggttaaacgtttcgttttacgtacgtttaaggtttttaacttacgttacggtacgaacggtaccgggaacgggtaccggggtaacttaacgggtttcccgggtacccgttaccgttaccgtttacccggggtttaccggggggaccgggggttaaaccgtaggggtaccgggttaacgttaacccgaaacggttacgttggggtacgacgttacggacctacccgtgttaccgtcgtttaccttaccgtacgttccccgttccgacg

SEQ ID NO: 284635 - DNA, 561 bp, Homo sapiens
  misc_feature: GYAE6OF02GPYGA.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccacctctcctgcaggccagtcagagtgtcaacaccaacttagcctggtttcagcagaagcctggccaggctcccaggatcctcatgtatgatgcatcccacgagggccacggcactcccagccaggttcagtggcaggcgggtctgggacaggacttcactctcaccatcagcagcctagagtctgtaagtatttgacttagtttacttactgttacagtcagggcgggactaagttcggccgtctacgtacggtttcggggaccggggggtaccgaagggtcggtaacgttacgaaccggtatggtcggcgtacgaccaccgtagtctcgttctaccgtactccgttcccgctacg

SEQ ID NO: 284636 - DNA, 509 bp, Homo sapiens
  misc_feature: GYAE6OF02FTMG0.14.57.F02.1.454.CMB.1.raw
  modified_base (488)..(488): a, c, t, g, unknown or other
  misc_feature (488)..(488): n is a, c, g, or t
  modified_base (506)..(506): a, c, t, g, unknown or other
  misc_feature (506)..(506): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctagaagtattttgctagtttatactgtcagcaggcgggctaagttcggccgctcgtacgttcgggcggggacaggtggagtacaacgagtgtggctgcacntctcgtctcatcttccgntac

SEQ ID NO: 284637 - DNA, 569 bp, Homo sapiens
  misc_feature: GYAE6OF02HVQ51.14.57.F02.1.454.CMB.1.raw
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattctatttttagcgaatatgccatgagcgtgggtcccgccaggctccgaggggaaggggctggaggtgggtctcagcaatcaggttggttcgtagtggaatactagttcgacgccgtctccgtggaacgggtccggtttctccactctccagtacgactaattaccaagaaccactacttactttcttactaaatggacagacctagaaagacgaagacgacggtcgttagttatttgtagtagaagatacgaagtctatgactaccgagttcgggagggtccttacgagttcgtgtacggg

SEQ ID NO: 284638 - DNA, 685 bp, Homo sapiens
  misc_feature: GYAE6OF02IX3HR.14.57.F02.1.454.CMB.1.raw
  modified_base (437)..(437): a, c, t, g, unknown or other
  misc_feature (437)..(437): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaaccaccaacttagcctggttcagcagagcctggccaggcctcccgaggcctcctcatgtatgatgcactcccacgacggggcccaccggcactcccgacgccgtaggttcaggtcggacgaggcgggtcgtagggacctacggtaccttcgactcctccacctatacacgacgacgacctagtacgtacgtaggtaagttntttacgacgttaacgttttagttacgttcgttactagtaccgtacggtccgggtactaacggttcggtcccgtaccgttaccgtacgggtttaccggggaccgggggtaaccggtaacggggtacgggttaacgttaaccggtaaaccggtacgttagggtacggtccggttacgacccgtaaccgttacgttaccgttacgttacctttaccgttaccgtttccccgttaccccgtacccttaacgg

SEQ ID NO: 284639 - DNA, 598 bp, Homo sapiens
  misc_feature: GYAE6OF02GC8BY.14.57.F02.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacaccaacttagcctggtttcagcagaagcctggccaggctccaggctcctcatgtatgatgcatcccagcggggccaccggcactccccagcctaggttcagtggcaggcgggtngggacngacttcactcncaccatccagcagcctagagtcgtagaagttactttgacttagttttacttacgttcgtcaggtcgacgggcgggtctaacggttcgggcccgtcttaccgtaccgtttcggggaccggggggtaccgtaagggttgggtaacgttaccgaacggtacgttgggtcggacgttacggacctaccgacgttccgttacggtttaccttccacgtttcccgtcccgtaccc

SEQ ID NO: 284640 - DNA, 644 bp, Homo sapiens
  misc_feature: GYAE6OF02H7J67.14.57.F02.1.454.CMB.1.raw
  modified_base (196)..(196): a, c, t, g, unknown or other
  misc_feature (196)..(196): n is a, c, g, or t
tcagcgtctagtaccacgaccggtgctcgatttagctcgatatagttgggtttgggggaactgctcagttaggacccagagggaaccatggaagcccagctcagcttctcttcctctgctactctggctccagataccaccggagaaattgtgttgacacagtctccactcaccctgtctttgctccgaggggaangccacctctcctgcagggccagtcagagtgtcaacaccaacttagccttggtttcagcagaacgcctggccaggcctcccgaggcctcctcatcgtatgatgctacgtcccagacgggccaccggcactcccagcctaggttcaggtcgcaggcgggtgtagggactagtcttacacttcctcaaccagttcgacgccgagtaccgtacgacgttcgtagtaacgttagtttagtacttaagttttatttacgttcgttacgtagcgtaggcgggtactaacggttcggccgtcgttccgtacggtttccggggaccgggggtaaccgtaaggggtcggtaacggttacgtaaacggtaacgttcggttacgggtacgtacggtaccgtaccgtacgttccgttcggttacctttaccgtaccgtttccgtttacccggtaccttacg

SEQ ID NO: 284641 - DNA, 793 bp, Homo sapiens
  misc_feature: GYAE6OF02FFM87.14.57.F02.1.454.CMB.1.raw
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
tcagcgtctagtaccacgaccggtgctcgatttagctcgatatagttgggtttgggtgcccaagctgctggagggcacggtcaccacgctgctgagggaggcttggtacagccgggggggtccctgacactctcctgtgcagcctcaggattcatttttagcgaatatgccatgagctgggtccgccaggcctccgagggaagggctgggagtgggtctcagcaatcagttgtctagtggagtacattcgacgccgtctccgtgacggcggttctcatctccagagacacttcaagaacactctatttctacaaatcggacncgcctagaaagacgaagacgacgggtcgttgttatttttgngttaggaaaagtacgtaacgtaagtactaagtacgtaactaacccgtaagttttacgggggacggggttacccttttgagttcggttaccggtagggggtacccgtaaagggggtacccgtacggttacgggtaccgtaacccggtttcttacccgtttaccgaaccgggtccccgtttaaccccaacccgggtaaacggggtaccccctaagggttttaccccgggttaccccgttttacccccccggttacggggtaccccctaacccccgtttaccccgtaaccgtaaaccgggtaccggtacccctaacccggtcccggggttaccggggggacccaacccggtaccggggtaccccggttaccccgggtcggggtacccttacccgggtcccgtacgggttacccggaaaccggtttaaccccgg

SEQ ID NO: 284642 - DNA, 585 bp, Homo sapiens
  misc_feature: GYAE6OF02IFOPU.14.57.F02.1.454.CMB.1.raw
  modified_base (201)..(201): a, c, t, g, unknown or other
  misc_feature (201)..(201): n is a, c, g, or t
  modified_base (265)..(265): a, c, t, g, unknown or other
  misc_feature (265)..(265): n is a, c, g, or t
  modified_base (288)..(288): a, c, t, g, unknown or other
  misc_feature (288)..(288): n is a, c, g, or t
  modified_base (371)..(371): a, c, t, g, unknown or other
  misc_feature (371)..(371): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactctggctcccagataccaccggagaaattgtgttgacacagtctccactcaccctgtctttgtctccaggggaanagccacctctcctgcagggccagtcagagtgtacaacacctaactagcctggtttcagcagaancctggccaggctccaggctcctnatgtatgatgcactaccacgacggccaccggtcactcccagcctaggttcagtcgcagcgggtactgggacagacttcactcncacagtcagcagctagagtactgagtatttgctagttatactagtcgagtacgagcgggacgaagttgtccgactacctaccgttcgggtaccgggggacgtaacgggtaggtaacgttaacgaaacgtaacgtacggtacggtcgtcgaccgtaaccgtacgttccgttcgttaccggttcctaacgttcccgttaccccgacccgttaaccg

SEQ ID NO: 284643 - DNA, 588 bp, Homo sapiens
  misc_feature: GYAE6OF02FKDYI.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggtttcagcagaagcctggccaggctcccaggcctcctcatgtatgatgcactcccacgacgggccaccggcactcccagccaggttcaggtcggcaggcgggtctgggacagacttcactctcaccatcagcagcctagacgtctagaagtattttgacttagtttattacgtgtcgagcgaggcgggtactaacgttcggccgtcgtcgtaccggtttcggggaccgggggtaccgtaagggtcggtacgttaccgaacggtacgtacggtcggccgtcggaccgtaccgtagttccgtcgttaccgttactacgttcccgttccccgtaccg

SEQ ID NO: 284644 - DNA, 624 bp, Homo sapiens
  misc_feature: GYAE6OF02JK1ER.14.57.F02.1.454.CMB.1.raw
  modified_base (325)..(325): a, c, t, g, unknown or other
  misc_feature (325)..(325): n is a, c, g, or t
  modified_base (403)..(403): a, c, t, g, unknown or other
  misc_feature (403)..(403): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgagggaaagagccaccctctcctgcagggccagtcagagtgtcaacaccaacttagcctggttcagcagaagcctgccaggctcccgaggcctcctcatgtatgatgcactcccagacgggccaccggcacncccagccaggttcagtcgcaggcggtgcggacagacttcgactctacaccatcagcacgcctagacgtcagtaagttntttacgacttagtttattacgttgtacacgtacgaggtcgggactaacgtcggaccgtccgtacgtaccggttccggggaaccgggggtaacctaaacgggtacgggtaacggtttaaccgaaaccggtacggttacgggtacgggtacttacggaacccgtaacgttaacgtcccgtttacgtacccgttacgttaaccgttcccgttaccccgtaaccg

SEQ ID NO: 284645 - DNA, 572 bp, Homo sapiens
  misc_feature: GYAE6OF02H72MH.14.57.F02.1.454.CMB.1.raw
  modified_base (201)..(201): a, c, t, g, unknown or other
  misc_feature (201)..(201): n is a, c, g, or t
  modified_base (288)..(288): a, c, t, g, unknown or other
  misc_feature (288)..(288): n is a, c, g, or t
  modified_base (411)..(411): a, c, t, g, unknown or other
  misc_feature (411)..(411): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaangccaccctctcctgcagggccagtcagagtgtcaacaccaacttagccttggtttcagcagaagcctggccaggctccgaggctccnatgtatgatgcactccagacggccaccggcactcccagcctaggttcagtggacagggtcgggtctgggacaggtaccttcactctacacctatcgacgcacgacctagagtctagtaagttntttgactagtttatacgtgtcagcgaggcgggactagttcggccgtctcgtacggttcggggaccggggtacgtaggtggtacgtacgaacggtacgtcggtcggcgtgaccgtacctcgttcgttcggttccttaccgtactttccccgtacccgtaccg

SEQ ID NO: 284646 - DNA, 537 bp, Homo sapiens
  misc_feature: GYAE6OF02IAIRD.14.57.F02.1.454.CMB.1.raw
  modified_base (306)..(306): a, c, t, g, unknown or other
  misc_feature (306)..(306): n is a, c, g, or t
  modified_base (439)..(439): a, c, t, g, unknown or other
  misc_feature (439)..(439): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccacctctcctgcagggccagtcagagtgtcaacaccaattagcctggtttcagcagaagcctggccaggctcccaggcctcctcatgtatgatgcatcccanagggcccacggcactccagccaggttcaggtcggcaggcgggtctgggacagacttcacgttctacaccatcagccagcctagacgtcgtagaagtatttgacttagtttattacttgtcagtcgaggcgggnaagttgccgtctcgtacgttcgggcggggacgtagggtggagttacgaacgtacgtggtggcgtgcacctagtcgtcgtcttcacttcctcccgctac

SEQ ID NO: 284647 - DNA, 565 bp, Homo sapiens
  misc_feature: GYAE6OF02GZUZF.14.57.F02.1.454.CMB.1.raw
  modified_base (396)..(396): a, c, t, g, unknown or other
  misc_feature (396)..(396): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccggggggtccctgacactctcctgtgcagcctcaggattcatttttagcgaatatgccatgagctgggtccgccaggctccgaggggaagggctggagtgggtctcagcaatcagtggttctaggtggaagtacattcgacgtccgtctccgtgacgggtccgttcnccatctccagagacaatccaagacactcttattctacaatgacagctagaaagacgaagacgagggtcgttagtagtttttgagtagaaagtagttaacgaagttctaagtagtaactaacccgtaagtttcgggggacggttccctttagacgttcggtcgtacgggg

SEQ ID NO: 284648 - DNA, 839 bp, Homo sapiens
  misc_feature: GYAE6OF02J2KJO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaaaccatggagtttgggctgagttggctctttcttgtggctattttaaagatgtccagtgtgaggtgcagcttgttggaggtccgggggaggtccgttgggtacgacgggccgggggggttcccttaggaccaccgttccgtcccgttggttcgccgaacgggtccccttacgacggggtaaactttccttaaagtttttttacggaccggttaaattaacgttcggtacccctaagtttcggaacggtcccggttacgggggttccccggacccgtaagggtcccggttaccggaaacgggggtaacggggggtccgttggggtaacgggttcggggtaccgttcggacggaccgtaaagtccggtaaggttcggtttacgttagggtacgggttaaacgtacgtacgttaccggaaccggttccccgtccgttaccgggttaccgggaaacgggggtcccgggttttccctaccgtacttaccgttacccgaaggtaaccgtaacgtaaacttaaccccgaaagttaaccctacgtttacttaactttacctttacgaaaacgttacggactaaccgccgttaagaaacgacggaaagtaccgtacgggtagttacgttattttcggtagttaagaacggtatacgtaaggtactagagtaactaccgtaaggttggaaccgggtctttcgaggttacgtggtacggg

SEQ ID NO: 284649 - DNA, 880 bp, Homo sapiens
  misc_feature: GYAE6OF02JUPHX.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcgacgggccagtcagagtgtcaacaccaacttagccttggtttcagcagaagcctggccgaggcctccgaggcctcctcatgtactgatgctacgtacccacgacgggacccaccggacaccgtacccgacggtaccgtaggttaccgacggtcgggaccacgggtcgggggttacgtacggggaaccgaacgtaccgtttactaacccgtccgttaccgtaacccgtagtacccgaacggaccaacggttccctaagggttacggtaacgttaacgggtaaaacggttttacgtttttacgggtaaacccgttttaaggttttttaaccgttaaccggtttacggttaccggttaaacgtaccggggtaaaccggggtccgggggttaaccggtttaaaccgggtttccgggtaccccgggtttacccggtttaaaccgggttacccgggggtttttacccggggggggaaacccgggggggttaaaccccgtaaaggggggtttaccggggtaaaccggtttttaacccgggaaaaccgggttacggtttaccggggtaaccgggttaccggtaccggtaacccggtaacccgttacggtttaccgttacgggttaccttttaaccggaacccgttttccccggtacccggttaacccc

SEQ ID NO: 284650 - DNA, 786 bp, Homo sapiens
  misc_feature: GYAE6OF02ICXHW.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattctaatttttagcgaatatgccatgagctggtcccgccaggctccgaggggaagggctgggagtgggtctcagcaatcgaggttggttccgtaggtagggaacgttacagtttcggaaccgtccgtcctcccggtgggaaacggggtcccgggttttcctacccgtacgttccgttacccgaaggtaaacgtaacctaaaacgtttacccgaaacggtaaaacccaaccgtttactttaacctttttaccttttaaccaaaaacgttcgggtaaacctaacggtaccccttaagggaaaacggaaaccgggtaaaacgtaacccggaaccggggggttaccgtttagggttttaacgtttttttagggttaggttaagggtaaaaggtaaccgttaaacgggtaacgtttaccgtttaaggtaacgtaccgtttaaaaccccgtaagggtttttacggggggaaccgggggttcccctttttaacgggacgtttaccgggttaggtaacccggggggg

SEQ ID NO: 284651 - DNA, 623 bp, Homo sapiens
  misc_feature: GYAE6OF02I9GLZ.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaangccaccctctcctgcagggccagtcagagtgtcaacaccaacttgccttggttcagcagaacgcctggccaggcctcccgaggcctcctcagtgtatgatcgcactcccgacgacgggccaccggcactcccagtccaggttccaggtcggccacgggtccgggtctcggggactacggtaccttccgacgttccaccgaccacgtacgacgcacgtaccgtaaggtcgtacgtaagtaagttagtttacgactttaagtttacttacgtgtacaggtacgcgggtacggtacgtagttcggacccgtcgttacgtcgggttacggggccggggaactacggggtcgtaacgttacgaacgtcgtcgacggtctacgctaaccgtgttcgtacttccgtacctacgtcccgttccgactacg

SEQ ID NO: 284652 - DNA, 604 bp, Homo sapiens
  misc_feature: GYAE6OF02GB0UI.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggcctcccgaggcctcctcatgtatgatgcactccccacgacgggccaccggcactcccagccaggttcagtggcaggcgggtcgtgggacaggtacttcactctacaccatcagcacgccgtagacgtcgtagtaagtattttcgacttaagtttacttacgttgttaccgagcgtagggaccggggtactaaggttcgggaccgtccgttccgtaccggtttccgggggaccgggggtaccgtaaggggtggtaacgttacgaaacggtacgtggtacggcgtgccaaccgtagttctcgttcttcctacgttcccttcccgtctacg

SEQ ID NO: 284653 - DNA, 600 bp, Homo sapiens
  misc_feature: GYAE6OF02HQWTP.14.57.F02.1.454.CMB.1.raw
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggaaagagccaccctctcctgcagggccagtcagagtgtcaacaccaacttagtctggtttcagcagaagcctggccaggctccgaggctcctcatgtatgatgcactcccacgacgggccaccggcacgtcccagccaggttcaggtcggcacggcgggtctgggacagtacttcactctcaaccntcagacacgacgtagagtactagaagtntttgacttagtttacttacgtgtcagcaggcgggtactaaggttcggccgtcgttccgtacggtttcggggccgggggtaaccgtaaggggtcggtaacgttacgaaacggtacgttgggtacggtcgtacgacctaaccgtagttccgttgttccttaccgtacgtttcccgtttccccgaccgtaaccg

SEQ ID NO: 284654 - DNA, 595 bp, Homo sapiens
  misc_feature: GYAE6OF02IZJOS.14.57.F02.1.454.CMB.1.raw
  modified_base (344)..(344): a, c, t, g, unknown or other
  misc_feature (344)..(344): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggacttcatttttagcgtaatatgccatgagcgtgggtccgccgaggctccgaggggagggcgtgggagtgggtctcgngcaatcgagtggttacgtaggtgaagtactagttcgacgccgtctccgtggaagggtccgttctccatcctaccagagacaattaccaagaacactacttatttcttacaaatcggacagtacctagaaacgacgaacgacgacgggtcgttagttagttttcgagtagtaaagtatacggaagttctagttacgaactacccgtaaggtttcggggacgggttcctttacgaggtttcgtcgtacggggg

SEQ ID NO: 284655 - DNA, 571 bp, Homo sapiens
  misc_feature: GYAE6OF02HOU7G.14.57.F02.1.454.CMB.1.raw
  modified_base (370)..(370): a, c, t, g, unknown or other
  misc_feature (370)..(370): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacgacgggccaccggcactcccagccaggttcagtggcaggcgggtctgggacagacttcactcncaccatcagcagcctagagtctagaagttatttgcttagtttattactgttacagtcgaggcgggctaacgttcggccgtcgttcgtaccggtttccggggacgggggtaaccaaggggttcggtaacggttaacgaacggacgttggtacggctcgaccaccgtagttcgttgttccttctacgttccttcccgctaacg

SEQ ID NO: 284656 - DNA, 560 bp, Homo sapiens
  misc_feature: GYAE6OF02HZ8UU.14.57.F02.1.454.CMB.1.raw
  modified_base (436)..(436): a, c, t, g, unknown or other
  misc_feature (436)..(436): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattctattttagcgtaatatgccatgagctgggtcccgccaggcctccgagggagggctggagtgggtctcgagcaagtcagtggttctagtagggaagtacattcgacgtcccgtctccggtaggaacgggtccgttctccatcctccagacgacaattccaagaacnctctattctacaatgacagcctagaaagacgaagacgacggcgttgttaatttgtgtagaagtatacgtaagtctatgaactaacctaggttcgggacgggtcctttagattggtcgtacgggg

SEQ ID NO: 284657 - DNA, 708 bp, Homo sapiens
  misc_feature: GYAE6OF02H7I9R.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgttctttgtctccgaggggaangccaccctctcctgccagggccagtcagagtgtcaacaccaacttagccttggttcagcagagcctggccaggcctccaggcctcctcatgtatgatgcactcccagacggcccaccggcactcccgagcccgtaaggttcgaggtcggaccgacgggtccggggtcgtagggacctaggtacctttccgaccttcctaccgaaccctagtaccgacggtaccctaacgtccgtaacggtacgttaccgtaaggtaaacgtttagttttcgtacgtttaacggtttttacttaaccgttacggttaccgtaaggtaccggttacggggtaccggggtacttaaacggtttccgggacccgttccgttaccgttaccgggttttaccgggggaccgggggtaaacccgtaaggggtcggtaacgttaaccgaacggtacgttggtacggtcgtacgacccgtactagttccttaggtccttacgtaccgttcccgttaccgtacg

SEQ ID NO: 284658 - DNA, 651 bp, Homo sapiens
  misc_feature: GYAE6OF02JFUBH.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgtggagtccgggggagcttggtacgaggtccgggggggtccctggaccactcctcctgtgcagcctcgaggtattctatttttagacgaatagtgccatgacgcgtcgggtcccgccgaggctaccgaggggaagggcgtgggaggttcgggtctcagacaattcgaggtggttactaggtggaaagtactagtcggacgccgttcgtccggtaggaacggggtcccgtttctcctactcctacccgaagacgtaacgtaacttaccgaaacgaactaccttacttaatttccttacaaacgtcggtaacacgtccgtaagaaagtaaccggaaacgacgacgggtacgttgtttacgttttggagtaagtaacggtatacggaagttctaataggtaacttaacccgtaaggtttggggaccggttcctttagagttcggtcgtacgggg

SEQ ID NO: 284659 - DNA, 591 bp, Homo sapiens
  misc_feature: GYAE6OF02HGWEI.14.57.F02.1.454.CMB.1.raw
  modified_base (308)..(308): a, c, t, g, unknown or other
  misc_feature (308)..(308): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatcccanagggcccaccggcactcccagccaggttcaggtgcagcgggtctgggacagacttcactctcaccatcagcagcctagagtctagaagtatttgctagtttattactgtacagcgaggcgggacaagttcggccgtcgttccgtaccggtttccggggaccggggggtaaccgtaaggggttcggtaacggttaccgaaacggtacgttaggtcgggtcgtacggaccgtaaccgtacgttaccgtcgtttccttaccgtacgttcccgttccccgacctacg

SEQ ID NO: 284660 - DNA, 618 bp, Homo sapiens
  misc_feature: GYAE6OF02GE9KI.14.57.F02.1.454.CMB.1.raw
  modified_base (292)..(292): a, c, t, g, unknown or other
  misc_feature (292)..(292): n is a, c, g, or t
  modified_base (398)..(398): a, c, t, g, unknown or other
  misc_feature (398)..(398): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaagatgtccagtgtgaggtgcagctgttggagtccgggggaggcttggtacaggccggggggtcctggacactctcctgtgcagcctgaggattcagttttagcgaatatgccatgancgtgggtccgcaggctccgagggaaggggctggagtgggtctcgagcaatcagtggttcaggtaggagtacagttcgacgccgtctcgtgaacgggtccgtctccncttctaccgagacgactaattccaaagaactacctacttattcttacgaatcggactacgccgtaagaaacgaacgaacgtaacgacgggtacgttacgtttagtttttacggagttaagaaagtactaacggtaaacgtttctaagttacgaacgttaacccgttaaggtttacgggggaaccgggttcctttacgaacgttcggtcggtaaccggggg

SEQ ID NO: 284661 - DNA, 582 bp, Homo sapiens
  misc_feature: GYAE6OF02IOOKL.14.57.F02.1.454.CMB.1.raw
  modified_base (302)..(302): a, c, t, g, unknown or other
  misc_feature (302)..(302): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggttcagcagaagcctgccaggctccagctcctcatgtatgatgcatcccanacgggccaccggcatcccagcccaggttcaggtcgcagcgggtctgggacagacttcactctcaccatcagcacgcctagagtctgaagtattttgactagtttatactgtcagcgagtcgggcaagttggccgtacgtcgtaccgtttcgggaccgggggtaccgtaacgggtaggtaacggttacgaaaccggtacgtacggtcgggccgttacggaccgtaccgtacgttccgttacgtaccttttaccacgtttcccgttccccgtaccttaaccg

SEQ ID NO: 284662 - DNA, 747 bp, Homo sapiens
  misc_feature: GYAE6OF02GD0XX.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccacttagcctggtttcagcagagcctggccaggctcccaggctcctcatgtatgatgcatcccacagggtccaccgggcaacgtccccaagcccgtaaggttccgagtcgggtccaagggtccggggttcctcgggggaacacggaccttttcaaccttcctaccctaaccctatccgagtcccaacggcccgtaaggacggttaccgttaggtaaacggtactttttcggaccttaaggtttttaactttaaccgttggttacccacggtaccgagggtccggggggtaccttaaacggtttccggggcccgttccgttaccgttaccgggtttttccgggggacccggggggggtaaacctaacgggggttcgggtaacggtttacccgtaaaccgggtaaaccgttcggggttaacggtcccgtttacgggacccgttaaccccgaagtttcccggttaggttcccgtttaccgtaaccgtttcccgttacccccggtacccc

SEQ ID NO: 284663 - DNA, 743 bp, Homo sapiens
  misc_feature: GYAE6OF02IJ5QB.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacaggccggggggtcctgacgactcgtcctgtgcagcctccaggagttctagttttagacgaatactgccatgagctgggtccgccgacggctccgaggggaacggggcgtcgggaggtcgggtctccgtagccgaatcgaggttacggtttcgtaaggtaggaacggttacgacgtttcggacggtcccggtaccgttcccggtaggaaacggggtcccgggtttctcccaacgttccgtaccccgaggaacgtaactaacgttaacctaaacgaaaccaaccgttcttaattttccttacgtaaaacgtcggtaactaccggtactaacgaaaaggtacccggaaaaggtaaccgtaaccgggggtaccgtttacggtttaagtttttttcggtacgttaagaaaaggtacttaaacgggttacgttaacggttaacgtacgtaaaccgtaaccgttaacgggttttacggggacgggttacccgtttacgaggtttacggtaccgggttacgggg

SEQ ID NO: 284664 - DNA, 594 bp, Homo sapiens
  misc_feature: GYAE6OF02H3J3Y.14.57.F02.1.454.CMB.1.raw
  modified_base (441)..(441): a, c, t, g, unknown or other
  misc_feature (441)..(441): n is a, c, g, or t
  modified_base (454)..(454): a, c, t, g, unknown or other
  misc_feature (454)..(454): n is a, c, g, or t
  modified_base (466)..(466): a, c, t, g, unknown or other
  misc_feature (466)..(466): n is a, c, g, or t
  modified_base (549)..(549): a, c, t, g, unknown or other
  misc_feature (549)..(549): n is a, c, g, or t
tcagcgtctagtaccacgaccggtgctcgatttagctcgatatagttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttgcagtaacaccaagtacaggaatattaacctgttcccatcgactacgcctttcggcctcgccttaggggcactcaccctgccccgtataacgttggactaggaacccttggtcttccggcgagcgggtcttttcacccgtctttatcgttacttatcgtcagtcatttcgcacttctgactacctcagcatgcctcacngcacaccttcacngcttacagaacncctcccctaccaacaaccgcaataacgcgtccgctcgccgcacgtcttcggtcgctagttcggtttaaccgtccccgttttancttcccttccccgcctacgttccgtacgacgttaccgagtaccgg

SEQ ID NO: 284665 - DNA, 624 bp, Homo sapiens
  misc_feature: GYAE6OF02HANI5.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggcctcccgaggctcctcatgtatgatgcactccccacgacggggcccaccggcactccccagccaggttcaggtcggcaggcgggtctggggacaggtacttcactctacaccatcagcacgcctagacgtctagtaagtattttgcttaagttttattacgttgttcagtcgacggcgggactaagttcggccgtcgtacgtaccggtttcggggaccgggggtaaccgtaaggggttacggtaacggtttaaccgaaaccggtacgttagggtacgggtaccgttacggacctaaccgtacgttccgttcgttccgtttacctacgtttcccgtttccccgccttacg

SEQ ID NO: 284666 - DNA, 558 bp, Homo sapiens
  misc_feature: GYAE6OF02FSNYU.14.57.F02.1.454.CMB.1.raw
  modified_base (393)..(393): a, c, t, g, unknown or other
  misc_feature (393)..(393): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (479)..(479): a, c, t, g, unknown or other
  misc_feature (479)..(479): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccggggggtccctgacactctcctgtgcagcctcaggattcatttttagcgtaatatgccatgagctgggtccgccaggctccgagggaaggggctggaggtgggtctcagcaatcgagtggttctagtggaagtacattcgacgccgtctcgtgacggccgttcnccatcncagagacatccaanaacactctatttctactaatggacagcctagaaacgacgaacgacgacgggcgttgttatttttgngttagaaagatacgaagttctaatcgtaatacccgtaagtttcggggacgggttaccgtttcgattggtacgtacgggg

SEQ ID NO: 284667 - DNA, 665 bp, Homo sapiens
  misc_feature: GYAE6OF02H0CYF.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggagtccggggggaggcttggtacaggccgggggggtccctgacactctcctgtgcagcctcgaggtattctatttttagcgtaatatgccatgagcgtgggtcccgccgaggcctccgaggggaaggggctgggaggtgggtctcgagcaatcgagtgttcgtagtggaagtactattcgacgtccgtcctccggtaggacgggtccggttctcctatcctccgaagacgaactaacttaccgaaagtaacctaaccttacttacttttacttacgtaaagttcggaacacgtacccgtaagaaacgaacggaaacgacgtacgggtacgttagtttacgtttttaggtaggttaaggaaagtagtaacggtaaacgttcttaagtacgtaaccgttaacccgtaaggttttacggggtacggggttacctttaccggtagttcggttcggtaccggggg

SEQ ID NO: 284668 - DNA, 640 bp, Homo sapiens
  misc_feature: GYAE6OF02G0OPO.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggttcagcagaagcctggccaggctcccgaggcctcctcatgtatgatgcactcccacgacgggcccaccggcactcccagccaggttccaagtggaccaggccgggtcgtggggaccaggtaccttccgactcctaccaccgtactccgacggcacgtacccgtaagacggttcgtaggtaagttacgttttacgacgttaaggttttacttacctgttaccgtaaggtccgaagggtcggggtactaacggttcggcccgtaccgttccgtacggttccggggaccgggggaccgtaagggttcggaacgttacgaaacggtacgtgggtagtaccgtacgcaaccgtagttccgtacgttccttatacctcccttacccggctaacg

SEQ ID NO: 284669 - DNA, 601 bp, Homo sapiens
  misc_feature: GYAE6OF02G721N.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtacaacaccaacttagccttggtttcagcagaagcctggccaggcctcccgaggcctcctcatgtatgatgcactcccacgacgggccaccggcactcccagccgtaggttcaggtcggcaggcgggtcgtgggacagtctcactctaccaccatcacgcacgcgtagacgtctagtaagttatttgacttagtttactactgtacagcgtaggcgggtatagtcggccgtctacgtaccgttcggggaccggggtaactaggggtacgtaacgttaacgaaacggtacgtggtacggtcgtacggacctaaccgtacgttccgttacggttaccttaccgtaccgtttcccgttaccccgcttacg

SEQ ID NO: 284670 - DNA, 572 bp, Homo sapiens
  misc_feature: GYAE6OF02HUHPM.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggattcatttttagcgaatatgccatgagctgggtccgccaggctccgaggggagggctgggagtgggtctcagcaatcagtggttctagtggaagtacattcgacgccgtctccgtgaacgggccgtttctccatcctccagacgacaattccaaagaacactctatttcttacaaatggaacagcctaggaaagacgaagacgacgggtcgtagtttattttgagtagaaagtatacgtaagtctaatcgaactacccgtaagtttcggggacgggttcctttacgagttcggtcgtaccggggg

SEQ ID NO: 284671 - DNA, 434 bp, Homo sapiens
  misc_feature: GYAE6OF02HC2YS.14.57.F02.1.454.CMB.1.raw
  modified_base (424)..(434): a, c, t, g, unknown or other
  misc_feature (424)..(434): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggccaccctcctcccaagacgccacctcgtcgggggcacgagcggccctgggctgcctggtccaaggactacttccgtactagacgctgagcgggctggcaaggcgcatagnnnnnnnnnnn

SEQ ID NO: 284672 - DNA, 592 bp, Homo sapiens
  misc_feature: GYAE6OF02HHE4A.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaagcctggccaggctcccaggctcctcatgtatgatgcactcccacgacgggccaccggcactcccagccaggttcaggtcggcaggcgggtctgggacagacttcactctcaccatcagcagcctagacgtctgtaagtatttgacttagttttattactgtcagctaggcgggtactaagttcggccgtcgttccgtacgtttcggggaccgggggtaaccgtaaggggtcggtaacgttaccgaaaccggtacgttaggtcgggtcgtcggacctaccgtacttcgttacggttccttaccgtacgtttcccgtttcccggcctaccg

SEQ ID NO: 284673 - DNA, 625 bp, Homo sapiens
  misc_feature: GYAE6OF02H5VZV.14.57.F02.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagccttggtttcagcagaagcctggccaggctcccgaggcctcctnatgtatgatgcactcccagcgggcccacggcactcccagcctaggtcaggtcgcaggccgggtctgggacagacttcactcncacatcagcagcgtagngtcgtagtaagttatttgacttagttttacttacgtgtcagcgagggtcgggactacgttcggcccgtcgttccgtacgggtttcgggggaccgggggtaaccgtaaggggtcggtaacggttaaccgaaacggtacggttacgggttacgggtctaccgggtacccaacgttacgttaccgtttcggtttacctttacccgtaccgttttcccgttaccccgtaccgttacgg

SEQ ID NO: 284674 - DNA, 586 bp, Homo sapiens
  misc_feature: GYAE6OF02GR0AD.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggttcagcagaagcctgccaggctcccaggctcctcatgtatgatgcatcccacagggccaccggcactcccagcctaggttcagtggcagcggtctggacagacttcactctacacatcgacgcagcctacgacgtctagaagtactttgactagtttacttactcgttactagcgtaggcgggataagttcggcctacgttaccgtacgtttcgggtaccggggggtaccgtaagggtacggtacggttaccgaaacgaccgtaggtacggcggttacgacgtacccgtagttccgttggttaccttacttacgttccgttacccggcttaacg

SEQ ID NO: 284675 - DNA, 748 bp, Homo sapiens
  misc_feature: GYAE6OF02JXIIA.14.57.F02.1.454.CMB.1.raw
tcagcgtctagtaccacgaccggtgctcgatttagctcgatatagttggggtttgggggaactgctcagttaggacccagagggaaccatggaagccccagctcagcttctcttcctcctgctactctggctcccagataccaccggagaaattgtgttgacacagtctccactcaccctgtctttgtctccgaggggaaagacgccaccctctcctgcgacgggccagtcagagtgtcaacacctaactacgccttaggtttacacggcaacggaacgccgttcggacccgaaggcccgtacccgacgggcccttcccgtacacgttcggttaagtggaactcggaccgtacctaccccgaacgaccggggaccccgaacccggccacctaccccgagtccccgtacggttaccgaacggtcgggccgacggtccggggtcgtacggggaccgtacggtacctttacgaccgttacctaccgacctacgtaccaacgcacggtaccctaagacgttacgtagtaacgttacgtttacgtacgttaagtttactttacgtcggttactacgacggtaccggcggggtacgtaacggttcggccgtaccgttacgtaccgggtttccggggacgggggttaccgaaggtacggttacggttaaccgaacggtacgtacggtacggtcggtacgacggtaacctagttcgtacggtttaccttacaccgtttaccgtcccgtcgtaaccg

SEQ ID NO: 284676 - DNA, 700 bp, Homo sapiens
  misc_feature: GYAE6OF02F3ILH.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacagccggggggtccctgacactctcctgtgcagcctcaggattcatttttagcgaatatgccatgagctgggtccgccaggcctccgaggggaaggggctgggagtgggtctcgagcaatcaggtggttctagtggaagtacattcgacgccgtctccggtgaacggggcccgtttctccgtatcctacccagacgactaacttaccgaaagtaacctaactacttaacttttaccttactaaaacgttcggaaacctaacggacccttaaggaaaacggaacggtaaaggaacccgaacggggtccggtttagtttaacgttttttagggttacggttaggtaaaagggtacgttaacgggtaaaggtttccgttaaagttacggtaaacttaacccccgtttaaaggttttacggggggtaacgggggtttacccttttaccggtaacgttttacgggtccgttaaccgggggg

SEQ ID NO: 284677 - DNA, 635 bp, Homo sapiens
  misc_feature: GYAE6OF02F3I6S.14.57.F02.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagatacccaccggagaaattgtgttgacacagtctccactcaccctgtctttgtctccaggggaaanagccaccctctcctgcagggccagtcagagtgtcaacaccaacttagccttggtttcagcagagcctggccaggctcccaggcctccncatgtatgatgcactcccacgacgggcccaccggcactccccagtcccaggttccaggtggcaggcggtcngggcagcttcactcncacntcacgcacgcctagacgtctagaagttagttttgacttagtttacttacgttgttacgagtacgagggtccggggtactaacggttcgggcccgtacgttaccgtaccggtttccgggggaccgggggtaccgtaacgggtacggtaacgttaaccgaaacggtaccgtggtacgggtcctacggtacccaacccgtacgtttaccgttcggttacctttaccgtacgtttccccgtttaccccggccttaaccg

SEQ ID NO: 284678 - DNA, 648 bp, Homo sapiens
  misc_feature: GYAE6OF02JHM0G.14.57.F02.1.454.CMB.1.raw
  modified_base (202)..(202): a, c, t, g, unknown or other
  misc_feature (202)..(202): n is a, c, g, or t
  modified_base (290)..(290): a, c, t, g, unknown or other
  misc_feature (290)..(290): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactctggctcccagataccaccggataaattgtgttgacacagtctccactcaccctgtctttgtctccaggggaaanagccaccctctcctgcagggccagtcagagtgtcaacaccaacttagcctggtttcagcagagcctggccaggctcccaggcctcctnatgtatgatgcatcccacagggcccaccggcactccccagcctacggttcagtcggccaggtcgggtcgtgggaccagtacttcgacttcctacaacccatccagcaacgcctagacgtcgtagtaagtatttcgacttagtttacttacgttagtaccgtagtcgtacgggtcgggtacgtaacggttcggtacccgtccgttaccgtaccgggtttccggggtaccggggggtaaccgtaaggggttacggtaaccggttaacgtaaaccggtaccgttgggtacggtccgtacgacgtaaccctagttaccgttacggttaccgttacctacgttccccgtttacccgacctacg

SEQ ID NO: 284679 - DNA, 589 bp, Homo sapiens
  misc_feature: GYAE6OF02G4QR7.14.57.F02.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggttcagcagaagcctggccaggctccaggctcctcatgtatgatgcactcccacgacgggcccaccggcactccccagccaggttcaggtggcaggcgggtntgggacagtcttcactctcacatcagcacgctagacgtctagaatatttgctagtttattacgttgtctagcgtaggcgggtactagttcgggcccgtcgtccgtaccggtttccgggggaccgggggtaaccgtaaggggttcgggtacgttaccgaaacggtacggtagggtacggtccgtacggcctaaccgtacttcgttcgttaccttccacgtttcctccccgtacc

SEQ ID NO: 284680 - DNA, 643 bp, Homo sapiens
  misc_feature: GYAE6OF02IT8L5.14.57.F02.1.454.CMB.1.raw
  modified_base (545)..(545): a, c, t, g, unknown or other
  misc_feature (545)..(545): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggctattttaaaagatgtccagtgtgaggtgcagctgttggaggtccgggggaggcttggtacaggccggggggtcctgacactctctgtgcagcctcaggattctattttagcgaatatcgcatgagcgtggtcccgcgaggctaccgaggggaagggctgggagtggtctcacgcaatcgagttggttactagtaggaagtactattcgacgccgttcgcccgtaggaacgggtcccgttctccatcctaccgtagacaactaattacccgaaacgtactacctcttagtttcttacgaaatcggaacacgtacctaaggaaacgacggaaagaccggtacgggacgttagtttaacgttttggtacggtaggtaaacgngtaacggttaacgtacctttaatacggtaaacttaccccgttaaaggtttacgggggaacgggttcctttacgaacggttccgtacggtaccgggggg

SEQ ID NO: 284681 - DNA, 636 bp, Homo sapiens
  misc_feature: GYAE6OF02I7YR1.14.57.F02.1.454.CMB.1.raw
  modified_base (200)..(200): a, c, t, g, unknown or other
  misc_feature (200)..(200): n is a, c, g, or t
  modified_base (263)..(263): a, c, t, g, unknown or other
  misc_feature (263)..(263): n is a, c, g, or t
  modified_base (359)..(359): a, c, t, g, unknown or other
  misc_feature (359)..(359): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacaccgtctccactcaccctgtctttgtctccaggggaaanacgccaccctctcctgcagggccagtcagagtgtcaacaccaacttagcctggttcagcagancctggccaggctccaggctcctcatgtaatcgatcgacactcccagacggcccacggcactcccagccaggttcaggtgcaggcggtctgggaccngtaccttcacgtcacgactatcgaagccaagcctagacgtactagaacgttagtttgacgttaagtttacttaactcgtacgagacgtacggcgggtactaagtcggtaccgtcgttaccgtaaccggtttccggggaccgggggtaaccgtaagggttacgggtaacgtttaacggaaacgtaacgttcgggtacggtaccgtcggtaacctaccgtacgttacgttacgttccgttacgttaccgttcccgttacccgtaccgtacgtttaccgg

SEQ ID NO: 284682 - DNA, 587 bp, Homo sapiens
  misc_feature: GYAE6OF02GLUV9.14.57.F02.1.454.CMB.1.raw
  modified_base (444)..(444): a, c, t, g, unknown or other
  misc_feature (444)..(444): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacaggccgggggggtccctgacactctcctgtgcagcctcaggattcatttttagcgaaatatgccatgagcgtgggtccgccgaggctccgaggggaagggcgtggagtgggtctcgagcaatcagtggttactagtggaagtacattcgaccgccgtctccgtggaaggccgttctccatctccagacacaattccaaagacactcttaattcttanaaagtgacagcctagaaacgacgaacgacacgggtacgtagttagttttgtagtagtaaagtataacgtaagtctaatagtaacttaacccgtaaggtttacgggacgggttacccgtttagacgttcggtcgtaaccggggg

SEQ ID NO: 284683 - DNA, 584 bp, Homo sapiens
  misc_feature: GYAE6OF02FIY7S.14.57.F02.1.454.CMB.1.raw
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaacgcctggccaggcctcccaggctcctcatgtatgatgcatccccanacgggccacggcactcccagcctaggttcagtggcaggcgggtcngggacagtcttcactctacacctatcagcacgctagagtctagaagtatttgacttagttattacttgtcacgcgaggtcgggactaagttcggaccgtcgtccgtacggtttccggggacgggggaactaacgggtacgggtacgttacgtaacggaacgtcggtacggtcgtagacccgtacctagttacgttcgtccgtttactaccgttccgttccccgtaccg

SEQ ID NO: 284684 - DNA, 579 bp, Homo sapiens
  misc_feature: GYAE6OF02FWPVB.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctatcctgcagggccagtcagagtgtcaacaccaacttagcctggtttcagcagaagcctggccaggctccaggcctcctcatgtatgatgcatccccacgacgggccaccggcactcccagccaggttcagtggcaggcgggtctgggacagacttcactctcaccatcagcagcctagagtctagtaagtagtttgactagtttattacgttgtcagcgaggcggggctaagttcggccgtctccgtacgtttccggggacggggggtaccgaagggttggtaacgttacgaaacgtacgttggtacgggtctcggacctaaccgtacttccgttcgttccttccgtacttcccgttccccgccttacg

SEQ ID NO: 284685 - DNA, 697 bp, Homo sapiens
  misc_feature: GYAE6OF02JVIRX.14.57.F02.1.454.CMB.1.raw
tcagcgtctagtaccacgaccggtgctcgatttagctcgatatagttgggtttgggggtcgtgagagaggagcccagtcctgggatcttcaggtgttttcatttggtgatcaggactgaacagagagaactcaccatggagtttgggctgagttggctctttcttgtggctattttaaagatgtccagtgtgaggtgcagctgttggagtccccgggggaggcgttggtacgaggccggggggtccctggacacgtctcctgtgcagcctcaggtattctattttagcgtaatatgccatggagtctggggtccgccgaggcctccgaggggtagggctgggacggtgggtctcgagctaatcagtggttactaggtaggaagtactagttacggacgtcccgtctccggtaggacgggtccggttcctccagtcctccgtaagacgtaacctaacttaccaaagaacctacttaccgtaattttacctaacgaaacgttcggaactacgtacccgttaaggaaacgaaccggtaaacgtaccgggtaacggggtaaccgtttaggttttaacgtttttagggacggttaaggtaaaccgtacgttaacggtaagttccttaatacggtaaacttaccccggtaaaggttttcggggaacgggtaccttttagacggtttcggtaccgtaccggggg

SEQ ID NO: 284686 - DNA, 615 bp, Homo sapiens
  misc_feature: GYAE6OF02JXFM4.14.57.F02.1.454.CMB.1.raw
  modified_base (201)..(201): a, c, t, g, unknown or other
  misc_feature (201)..(201): n is a, c, g, or t
  modified_base (330)..(330): a, c, t, g, unknown or other
  misc_feature (330)..(330): n is a, c, g, or t
  modified_base (578)..(578): a, c, t, g, unknown or other
  misc_feature (578)..(578): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactctggctcccagataccaccggagaaattgtgttgacacagtctccactcaccctgtctttgtctccagggaaangccacctctcctgcagggccagtcagagtgtcaacaccaacttagccttaggtttccagtcagaacgcctggccaggcctcccgaggcctcctacactgtactgatgctactcccagcgggccaccggnaactcccagtccaggttccagtcggcacggtcgggtctggggacagggtaccttcacgttcaccaccatccaagtccaacgcctaagacgttctaggtaacgtagttttgacttagttttactacgtgttcctaagcctaggcggggtactaaggttcggaccgtcttacgtaccgtttcggggaccggggtaactacggggtgacggttacgaaaccggtagtaggtcggctacgtcaacccggttnttcggttacttcgtacttaccgttccgttcccgactg

SEQ ID NO: 284687 - DNA, 606 bp, Homo sapiens
  misc_feature: GYAE6OF02FVI7C.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctccaggcctcctcatgtatgatgcatcccacacgggccaccggcactcccagccaggttcagtggcaggcggtcgtgggacaggactcactctcaccatccagcagcctagtacgtctagaagtagtttgacttagtttattacttgtactagcgaggcggggtactagttcggccgtctcgtacgtttccggggaccgggggtacgtaacggggtcggtacggttaccgaaacggtacgttacgggtacgggtcgtaccggtaccgtaacccgtacgttaccgttcggttcccttacgttacctttcccgttccccggacccttaaccg

SEQ ID NO: 284688 - DNA, 641 bp, Homo sapiens
  misc_feature: GYAE6OF02IT5S3.14.57.F02.1.454.CMB.1.raw
  modified_base (228)..(228): a, c, t, g, unknown or other
  misc_feature (228)..(228): n is a, c, g, or t
  modified_base (492)..(492): a, c, t, g, unknown or other
  misc_feature (492)..(492): n is a, c, g, or t
tcagcgtctagtaccacgaccggtgctcgatttagctcgatatagttgggtttggggctgagagaggagcccagtcctgggatcttcaggtgttttcatttggtgatcaggactggacagagagaactcaccatggagtttgggctgagttggctctttcttgtggctattttaaaagatgtccagtgtgaggtgcagctgttggaggtccgggggaggcttggtacnggccggggggtccctgacactctcctgtgcagcctcaggattctatttttagcgaatatgccatgagctcggggtccgccgaggctccgaggggaagggcgtgggaggtcgggtcgtcgacgcaatcgagttggttcgtagtaggaagtactattcgacgccgtctccgtggaacgggtccggttacctccgtactcctacgagagacaaagttccaaaggaacctaacctacgttaactttacttactaaacgtacggactanaccgtaagtaaacggaacgaacgaacggaacggtcgttagttaagttttgttaggtagtaaacggtataacggtaagtcttaagtgtaactaacccgttaaggtttacggggtacgggttcccgtttagtacgttacggtggtacgggg

SEQ ID NO: 284689 - DNA, 603 bp, Homo sapiens
  misc_feature: GYAE6OF02G58ID.14.57.F02.1.454.CMB.1.raw
  modified_base (202)..(202): a, c, t, g, unknown or other
  misc_feature (202)..(202): n is a, c, g, or t
  modified_base (297)..(297): a, c, t, g, unknown or other
  misc_feature (297)..(297): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcagggccagtcagagtgtacaacaccaacgttacgccttggtttcagcagaacgcctggccagggcctccgaggcctccncgatggtactgatcgccactcccacgacgggccaccggcactcccagcctaggttcaggtgacaggcgggtctgggacagtcttcactcncaccatcacgcagaccgtagacgtctaggaattntttagacttagtttactacgtgtctagcgagggcgggtactaggttcggaccgtcttaccgtacggtttccggggaccggggtacctaaggggtcgtaacgttacgaacggtacgtggacggtctacggacctaacgtattccgtacggttccttcgaccgtttccgtacccgaccttacgg

SEQ ID NO: 284690 - DNA, 765 bp, Homo sapiens
  misc_feature: GYAE6OF02H1CVO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagcccgggggggtccctgacactctcctgtgcagcctcaggattcatttttagcgtaaatatgccatgagctgggtcccgcaggctccgaggggaaggggctggaggtgggtctcgagcaatcgaaggttggttactaggttagggaaagtactagtttcggaacgtcccgtctcccggtaggaaccggggtccgggtttcctcccgactaccgtccgacgaacggaactaaacttacccgtaaaacggtaaaccaaccgtttacctttaaacttttaccttttaaccttaaaacgttacggtaaccgtaacggtaacccgttaacggaaaaacggtaaaccgggaaacgtaaaccggaaccggggtaccggtttacggttttaagtttttttacggttaggttaggtaaaacgttaagttaaccggtaaaggttaacgttaagttacggtaacgttaaccccgttaaagggttttaccgggggggggttacccgtttttaccggtagtttacggtttaccggtaggggtaaccccggg

SEQ ID NO: 284691 - DNA, 697 bp, Homo sapiens
  misc_feature: GYAE6OF02I887J.14.57.F02.1.454.CMB.1.raw
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
tcagcgtctagtaccacgaccggtgctcgatttagctcgatatagttgggtttggggctgagagaggagcccagtcctgggatcttcaggtgttttcatttggtgatcaggactgaaccagagagaactcaccatggagtttgggctgagttggctctttctgtggctattttaaaagatgtccagtgtgaggtgcagctgttggaggtccgggggagcttggacgaggccggggggtccctggaccactctccgtgtcgcagcctcgaggacttctagttttagcgtaattancgccattgagtcgtcgggtaccnccgaggcctcggaggggaagggctgggaggtcggtcacgagacaatcgaggttggttctaggtaggaactacgtattacgaccgtccgtctccggtaggtaacgggtcccgtttctaccgatcccgtaccgagaacgactaaacgttacccgaaagtaaccctacgttactttacgtttacttacaaacgttcgggaataccgtaccttaagaaacggaccgtaaaggaccgtacgggtacgttagttttaagttttggtacgttaagtaaagtacgttaacggaaggttccgttaagttacggaaacgttaacccggttaaggttttaacgggggaccggtttccgttacgtacggtttcggttacccgggtaacgggg

SEQ ID NO: 284692 - DNA, 730 bp, Homo sapiens
  misc_feature: GYAE6OF02HFLP0.14.57.F02.1.454.CMB.1.raw
tcagcgtctagtaccacgaccggtgctcgatttagctcgatatagttgggtttggggggaacgtgctcagttaggaccagagggaaccatggaagccccagctcagcttctcttcctcctgctactctggctccagataccaccggagaaattgtgttgacacagtctccactcacctgtctttgtctccaaggggaaagagccacctctcctgcagggccagtcagagtgtacaacacaacttagccttggtttcagcagaagcctggcaggctacccgaggcctcctacatgtatgatgcactccccgagacgggtcccaccggtcaacgttccccgaagccccgtaagggttcaaggttcgggacccaagggtccgggggtacttggggggaacctagggtaaccctttcaaccgttcgtacccaaaccttaggtaccaacgggcctaacggacccgttaaggtacggttaccgtaaggtaaacggttagttttacggacggttaacgtttttaacgttacttaggttacttaacggcgaacggggtacggggaccgtaaagttccgggtacccggtccttaccggttaccggttttacgggggaccgggggggttaaccgtaaggggtaggtaacgttaaccgaaaccggtagtacggtcgggaacttcggaccgaaccgtagtacgtacggttcttacctaacggttccttaccccggtactacg

SEQ ID NO: 284693 - DNA, 573 bp, Homo sapiens
  misc_feature: GYAE6OF02F6F4S.14.57.F02.1.454.CMB.1.raw
  modified_base (353)..(353): a, c, t, g, unknown or other
  misc_feature (353)..(353): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagagcctggccaggctcccaggctcctcatgtatgatgcatcccacgacgggccaccggcactccccagccaggttcaggtggcagcggggtntgggacagacttcactctcacatcagcacgctagacgtctgtaagtagtttgacttaggttttattacgtagttcgtacgtcgagggcgggactaagttcggccgacgttactcggttcgggcgggggtaccgtaaggtggtacgttaccgaacggacgttggtaggtcgtcgacctaccgtacgttacgtcgttcttacgtacttcctacccgtctacg

SEQ ID NO: 284694 - DNA, 788 bp, Homo sapiens
  misc_feature: GYAE6OF02GBMP3.14.57.F02.1.454.CMB.1.raw
tcagcgtctagtaccacgaccggtgctcgatttagctcgatatagttgggtttgggggaggaactgctctagttacggacccaggacgggaaccagtaggaacgccccagctcagtcttctcttcctcctgctactctggcctcccagactaccgaccggaagtaaattgttgttgacacagtctccactccaccctgttctttgtcctccggaaggggaaagcgcccaccctctcctgcgacggccagtcagagtcgtacaacaacctaacttacgccgttggttacagcagaacgtccgtcggccgacggtccctacccgacggtcctcccgtcagttgtatgtagtcgactactccccgacggaccgggcccaccggcaccgtcccgacgccgtacggttcaggtcgacgacgggtcgggtcggtacgggaacacgtaccgttaccacttcctaccgaacctacgtacacgtacgacgtacccgtaggtacgtacttaaggtaacgttttcgtttcgtacgttttaagtttttaacgttaccgttagtacgtacgtaccggtacgggggtaccgggtaacttaacgggttcccgggacccgttccgtttaccggtttacccgggggttttccgggggggaacccggggggtttaaacccgtaaaggggttcgggttaacggttaaacccgaaaccggttacggttcgggtaccggtaccgtacgggtaccctaaccgttacgttccgttacgttccttaactcccgtttaccccgtcccgtaacg

SEQ ID NO: 284695 - DNA, 646 bp, Homo sapiens
  misc_feature: GYAE6OF02JJP32.14.57.F02.1.454.CMB.1.raw
  modified_base (312)..(312): a, c, t, g, unknown or other
  misc_feature (312)..(312): n is a, c, g, or t
  modified_base (361)..(361): a, c, t, g, unknown or other
  misc_feature (361)..(361): n is a, c, g, or t
tcagcgtctagtaccacgaccggtgctcgatttagctcgatatagttgggtttgggggggaacgtgctcagttaggacccagagggaaccatggaagccccagctcagcttctcttcctcctgctactctggctcccagataccaccggagaaattgtgttgacacagtctccactcaccctgtcttgtctccagggaagagccacctctcctgcacggccagtcagagtcgtacaacaccaacttacgcctggtttcagcagaagcctaggccaggcctccgaggctcctcatcgtatcgatgcactccgngacggccaccggcacgtcccagcgacgttcgagtcggcaggtcggtcgnggacacgtctcacgtctacgacctagtacagcgacgtacctagagtactaggtaagttacgtttacgacgttagtttaacttacgtacgttacgtacgacgttacgggaccgggtactaacgggttccgaaccggttcctaccgggttaacggtttcccggggaccggggggttaacgtaaccggggttcggtaaccggttaacgtaaacgggtacgtcggtacgggtacgtacgaccgtaaccgttatccgttacgttactcttacgtccttacccgtctaacg

SEQ ID NO: 284696 - DNA, 572 bp, Homo sapiens
  misc_feature: GYAE6OF02JYWSG.14.57.F02.1.454.CMB.1.raw
  modified_base (201)..(201): a, c, t, g, unknown or other
  misc_feature (201)..(201): n is a, c, g, or t
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacaccaacttagcctggttcagcagagctggccaggctccaggctcctcatgtatgatgcactcccacgcggcccaccggtcactcccagcctaggttcagtcggcgacggcgggtcgtgggaacngtactcactctcacctancagcacgctagatctagaattnttgacttagtttacgtactggttcagtcgacggtccggtntaacggttccggaccgtcgttacgtaccggttcgggggaccggggtaacagggttcggaacttacgaaacgtcgttacgtggtactcgactaccgagttcgtagtttccgtattcctaccgttccgactag

SEQ ID NO: 284697 - DNA, 604 bp, Homo sapiens
  misc_feature: GYAE6OF02H7AEF.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagngccacctctcctgcagggccagtcagagtgtcaacacaacttagcctggttcagcagaagcctggccaggctcccaggctcctcatgtatgatcgcatcccgagacgggccaccggcactcccagccaggttcaggtgcaggcgggtctagggacagacttcactcctacacactcagcacgacctagtacgtctagaagttgttttgcttaagttttattacgttgttacgagtcgtagggcggggtactaacggttcggcccggtacttccggtaccgggtttccgggggaccggggggtaaccgtacggggtaggaacgttaccgaaaccggtacgttggtacggcgtcgaccaccgttactcgttacgttaccttcctacttccgttccccgactaccg

SEQ ID NO: 284698 - DNA, 592 bp, Homo sapiens
  misc_feature: GYAE6OF02H0YEF.14.57.F02.1.454.CMB.1.raw
  modified_base (202)..(202): a, c, t, g, unknown or other
  misc_feature (202)..(202): n is a, c, g, or t
  modified_base (351)..(351): a, c, t, g, unknown or other
  misc_feature (351)..(351): n is a, c, g, or t
  modified_base (374)..(374): a, c, t, g, unknown or other
  misc_feature (374)..(374): n is a, c, g, or t
  modified_base (392)..(392): a, c, t, g, unknown or other
  misc_feature (392)..(392): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagccttggttcagcagagcctggccaggcctccaggctcctcatgtatgatgcactcccagcggccaccggcacgtcccagccaggttcaggtgcagcgggtcngggactagcttcactctcacctntcacgcagcctagacgtntacgaagtattttcgacttagttttacttacgttgtactaggcgtagggcgggactaagttccggaccgtcgtacgtacggttccggggacgggggtaccgtaaagggtcgggtaacgtaccgaaacggtacgtcggtcgggccttaggacctaaccgtcgttcgttacggtccttacgtactttcccgtacccgtaccg

SEQ ID NO: 284699 - DNA, 744 bp, Homo sapiens
  misc_feature: GYAE6OF02H30Q2.14.57.F02.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
tcagcgtctagtaccacgaccggtgctcgatttagctcgatatagttgggtttggggagggaactgctcagttaggacccagagggaaccatggaagccccagctcagcttctcttcctcctgctactctggctcccagataccaccggagaaattgtgttgacacngtctccactcaccctgtctttgtctccagggaangccacctctcctgcngggccagtcagagtcgtcaacaccaacttacgcctttgggtttacacggtcaaaggtaacgcccgtaggcccgaacgggccttaccccgacggccttccctactagtacgttaactggacttcggcctaacgtaccccacggacgggccccaaccgggacctactaccccgaacgccccgtaagggtttacccgaggttacgggacctaggggtcccgggggtttagacgggggtaccaaggtaccgtttaccaccgttcctaaccacccgtaagtaccacggaccgtaacgccgtaacgtacgttcgtaaggtaagttatttcggtacttaaggttttacttacgttagttaccgagtccgtagggtacggtaccgtaacggttcggtaccgtccgtacgttaccggttaccggggacgggggtaaccgtagggtacgtacgtaacggaacgtacggtacggcggtctacggtaccgtaccgtagttacgtcggttaccttaccgtacttccccggttactacccgg

SEQ ID NO: 284700 - DNA, 900 bp, Homo sapiens
  misc_feature: GYAE6OF02FNQ9N.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggttcagcagaacgcctggccaggcctcccaggcctcctcatgtactgatgctactcccgacgacgggcccaccggccactacccgagcccgtacggttacgaggtacgggccgacgggtccggggttacgtacggggaacctaggtaacctttaccgacccgtttcgtaccctaacccgtaagttaccgaacggtaccaaccgggtaccccttaaaggtaccggttacgttaaacgggtaaaacggttttaacgtttttacgggtaaccgtttaaacggtttttttaaaccgtttaaccggtttaacgttaaccggtaacgggtacccgggttaaacgggggggtaaccccggggttaacgtttaaaacgggttttcccgggggtaccccggttacccggttttacccgggtttaaccgggggttttttcccggggggggaaacccgggggggttaacccggggttaaaacgggggttacggggttaaacggttttaaacccggaaaaaccgggttaccgggttaacggggtttccgggtaaccgttaccgggtaacccgttaacccgttaccggtttaccggtttacggtttacccgtttaaccgtttaccctttaccccggtttaccccccgtacccgtttaaccg

SEQ ID NO: 284701 - DNA, 575 bp, Homo sapiens
  misc_feature: GYAE6OF02HOH2R.14.57.F02.1.454.CMB.1.raw
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggaaagagccacctctcctgcagggccagtcagagtgtcaacaccaacttagcctggtttcagcagaagcctggccaggctcccaggctcctnatgtatgatgcactcccgacgacggggccaccggcactccccaggcctaggttcagtcggcaggcgggtcngggacagacttcactctcacntcagcagacctagngtctagtaagtatttcgactagtttattacgtgtcgagacgacggacgggtactaagttcggccgtactccgtacggtttcggggaccggggtacgtaacgggtggtaacgttacgaacggtacgttacggtggctcgaccgacgtactcgttgtaccttcgactttccgtcccgtcctacg

SEQ ID NO: 284702 - DNA, 673 bp, Homo sapiens
  misc_feature: GYAE6OF02I8JOC.14.57.F02.1.454.CMB.1.raw
  modified_base (264)..(264): a, c, t, g, unknown or other
  misc_feature (264)..(264): n is a, c, g, or t
  modified_base (341)..(341): a, c, t, g, unknown or other
  misc_feature (341)..(341): n is a, c, g, or t
tcagcgtctagtaccacgaccggtgctcgatttagctcgatatagttgggtttggggctgagagaggagccccagtcctgggatcttcaggtgttttcatttggtgatcaggactgaacagagagaactcaccatggagtttgggctgagttggctctttctgtggctattttaaaagatgtccagtgtgaggtgcagctgttggagtccgggggagtcgttggtacaggccggggggtccctgacactctcctgtgcagcctnaggattcattttagcgaatatgccatgagctgggtcccgccaggcgtccgaggggaaggggcgtggaggtgggtctnacgacaactcgacggttggttactaggtaggtaacgtactagttccgacgtccgttcgtcccggtggtaacggggtccggtttcctcctactctacccgagtacgactaaactccaaagaacctactacttactttcgttacctaaagttacgaccgacgccgtaagaaacgaccgaacgggaacgtacgggtccgttagtttaacgtttttaggtcgttaagaaagtataacggtaacgttacttaaggttacggtaacttaaccccgttaaaggtttcgggggtaccgggttacccttttacgtaggttaccggtccggttaaccggggg

SEQ ID NO: 284703 - DNA, 581 bp, Homo sapiens
  misc_feature: GYAE6OF02I93G0.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggttcagcagagcctggccaggcctcccaggcctcctcatgtatgatgcactcccacgacgggcccaccggcacgtcccagcctaggttcaggtcggacaggcggtcgtgggacacgtactcacttcacaccatcacgcacgctagacgtcgtagtagttagtttgtacttagtttacttacgttcgttacacgtcgacggtcgggactaggttcggccgtccgtcgtacggttcgggacgggggtacgagggtacggacgttacgaacgtacgtcggtcggtcgtcgactacgtacttcgtcgttcttactacgtccgtcccgactcg

SEQ ID NO: 284704 - DNA, 788 bp, Homo sapiens
  misc_feature: GYAE6OF02FMUJ5.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgttctttgtctccgaggggaaacncgccaccctctcctgcgacggccagtccagagtcgaccaaccacctaacttacgtccgttaggttcagtacgaggaacgtccgtcggaccgacggcctacccgacggcctccgtacagttggtatcgagttcgacctaacgtccccgaacggaccgggccccgaaccgggcctaccgtacccgaccggtaccggttaggttaccgacgggtacggccggtacggggtccggggtcgtaacggggtacctacgttaccgttaccgaactttcccgaaccctaacccgagttaccgacgtaccgtaccggtactaacggtacgttacgttaacgttagtttacgtttacgttacgtttaacgtttacttacgttcgtacgtacggacgggtacgggtaccgggtacgttacggttccggtaccgtcccggttacgggttaccggggttacgggtaccggggggtaacgtaacgggttacggtaacggttaaccgtaacgttacggtggttccggaccgtaccgtaccgttaccgtacttcggttcctttaccgtacccgttactttacccgttcccgttaacccg

SEQ ID NO: 284705 - DNA, 558 bp, Homo sapiens
  misc_feature: GYAE6OF02G9ES6.14.57.F02.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggtttcagcagaagcctggccaggctcccaggctcctcatgtatgatgcatcccanacgggccaccgggcactcccagccaggttcagtggctaggcgggtctgggacagctcactcctnaccntcagcacgcctagagttctagaagtatttcgactagtttattacgtgtacacgcagtcgggactaagttcggccgctcgttacgttcggggcgggggtacccaagggtcggtagttaccgaaacgtacgtggtggctggaccacctagtcttcggttaccttacgacttccgtcccgtaccg

SEQ ID NO: 284706 - DNA, 607 bp, Homo sapiens
  misc_feature: GYAE6OF02FTQN8.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatcgcactcccacgacggggcccaccgggcactccccgagcccgtaggttcaggtcggcaggcgggtcgtgggacagacttcactctacaccatcagcacgctagacgtctagaagttacgttttgcttaagtttacttaacgttcgtaccgaggtccgagggtccggggtactaaggttaccggccgtacgtccgtacgggtttccggggacggggggtaaccctagggtacggtagttaaccgaacgtacgtgggtcggtagtcgacgtacctagtcgttacgttcttctaccttccgtcccgtacg

SEQ ID NO: 284707 - DNA, 835 bp, Homo sapiens
  misc_feature: GYAE6OF02G9PZB.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacgaggccggggggtccctgacactctcctgtgcagcctcgacggattcctatttttagacgaatatgaccatgacgcgtcgggtcccgccgaggcctaccgaggggaacggggtctagggaggtcgggtcctcgaacggtaccaaagtccgtaaggttcggtttaccgtaagggttagggtaaaacgttacgtaacggtttaccggaaccggtcccgttccgtacccgggtaggggtaaaacccgggggttcccgggtttacctaccccgtaacttcccgttaacccgaaacggtaacggaaaacccttaaacgtttaaccccgaaaaggtaaaccctaaccttacctttaacttttaccttaaccgtaaaacgttacgggaacctaacggtaccccgttaaaggaaaaccggtaaaccgaaacggtaaacccggtacggggtaaccgtttaggttttaaacgttttttggtacggttaaaggtaaaacgtaacgttaaccggtaacggttaacttaacggttaacgtaaaccgttaaccccggttaaaggtttcgggggtaaccgggttacccttttacggtaacgttcggttacgggttaacccggggg

SEQ ID NO: 284708 - DNA, 599 bp, Homo sapiens
  misc_feature: GYAE6OF02HI5HK.14.57.F02.1.454.CMB.1.raw
  modified_base (201)..(201): a, c, t, g, unknown or other
  misc_feature (201)..(201): n is a, c, g, or t
  modified_base (356)..(356): a, c, t, g, unknown or other
  misc_feature (356)..(356): n is a, c, g, or t
  modified_base (559)..(559): a, c, t, g, unknown or other
  misc_feature (559)..(559): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccgactcaccctgtctttgtctccaggggaaanagccaccctctcctgcagggccagtcagagtgtcaaacaccaaacttagcctggttcagcagaagcctggccaggctcccgagctcctcatgtatgatgcacgtcccaagacgggcccacggtcacgtcccagccgagttcagtcgcaggcggtntggggaacagtacttcactctacaccatcacgcacgacctagacgtactagtaacgttattttcggacttaagttttacgttaacttgtacctagacgtagggaccggggtataagtttcggccgtaccgttacgtacggttttccggggacgggggtaacccgtaaggggttacgacgttaacgaacggaacgtggtacggngtcgacgacccatcgtactctactactccgtcccgctacg

SEQ ID NO: 284709 - DNA, 741 bp, Homo sapiens
  misc_feature: GYAE6OF02HHZMZ.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtacaacaccaacttagccttggtttcagcagaacgccgtggccgaggcctacccgacggcctcctactagttagtagtagtactcgactacctacccgacggacgggacccgaccggccacctcccgacgaccgtacggttcgaggtcggcgacggtcgggtcgtacgggacgtacggtaccttacgaccttcctaccaccgtaactaccgacgtacgacgtaccgtaggtacgttagtaacgggtaatttacgtttacgacgtttaaggtttttacttacggtgttaaccgaggtaccgggaacggggtcgggtaaacctaggttccgggaccctcgttaccggttaccggggttttccggggggaaccggggtaaccgtaacggggttcggtaaaccgtttaaccggaaacggttcggttcgggtacggtaaccggtacgacccctaacgttcgttccgttacgtttaccgttaccttccgtttacccgttcccggacctttacgg

SEQ ID NO: 284710 - DNA, 598 bp, Homo sapiens
  misc_feature: GYAE6OF02HELG9.14.57.F02.1.454.CMB.1.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccagctcccaggctcctcatgtangatgcatcccacngggccaaccggcactcccagccaggttcagtcggcacggcgggtctgggacagactcactcnctacatcagcagcctagacgtcgtagtaacgtatttgacttagtttatacgttgtaccgagacgaggcggggtactaacggttcggcccgtctacgtaaccggtttcgggaccgggggtaaccgtaaggggtcggaacgttaacgaaacggtactaggttagggcgtacgacctaaccgtacgtcgttacgttaccttaccgtaccttaccgtttaccccgactaaccg

SEQ ID NO: 284711 - DNA, 592 bp, Homo sapiens
  misc_feature: GYAE6OF02G2N9Y.14.57.F02.1.454.CMB.1.raw
  modified_base (202)..(202): a, c, t, g, unknown or other
  misc_feature (202)..(202): n is a, c, g, or t
  modified_base (288)..(288): a, c, t, g, unknown or other
  misc_feature (288)..(288): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (403)..(403): a, c, t, g, unknown or other
  misc_feature (403)..(403): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccagggaaanagccaccctctcctgcagggccagtcagagtgtcaacaccaacttagccttggttcagcagagcctggccaggctccgagctcctnatgtatgatgcactcccacgngggcccacggcactcccagcctaggttcaggtggcaggcgggtcngggacagcttcactctcacatcgagcacgcgtagtacgtctagtaagtnttttcggattaacgtttacttacgttgtacagtcgagggtcgggtactaacgttcggacccgtcgtaccgtacggtttcggggaccgggggaccgtaaggggtacggtaacgttaacgaacgtacgtggtcggtacgtcgacctaccgtattccgtcgtttaccttccgtactttccgttaccccgtac

SEQ ID NO: 284712 - DNA, 843 bp, Homo sapiens
  misc_feature: GYAE6OF02H5TKS.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctcttcttgtggctattttaaaagatgtccagtgtgaggtgcagctgttggaggtccgggggaggcttggtacaggcccgggggggtccctgacactctcctgtgcagcctcaggtattctattttagcgtaatatgccatgagtcgtcggtcccggccgacggccgtccgacggggaacgggggtacgtcgggtacgggtcgggttgtaccccccccccccgtaggaccgtaacgttaccgtaggttcgggtttaccgttaaggttacgggtaaacggttaacgttaacgttaccggtaaccggtacccggttacccgttcccggttacgggtaacggggtacccgggttttcccgttacccgtacgttacccgtacccgtaacggtaacgtaaccgtaaaacgtttaacccgaaaacgtaaaacccgtaaccctttaaccgtttaacttttaacccgttttaaccgtaaaacgttaacgggtaaccgtaacggtacccgttaacggaaaacggtaaaccggaaaccggtaaccggaaccggggtaccggttacggtttaacgtttttacggttacggttaggtaaacgtaacgtaacggtaacggttacgttaacgttacggtaacgttaacccgttaacggtttacgggtacgggttaccgtttacgtagttcgtacggtaccgggg

SEQ ID NO: 284713 - DNA, 741 bp, Homo sapiens
  misc_feature: GYAE6OF02H77YJ.14.57.F02.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcgagggccagtcagagtgtcaacaccaacttagccttggtttcagtcagaacgcctggccaggcctccccagggtcttccctnatgtatgactgcactacccacggccggccgaccggacactcccgaagtccgaggttccaggtcgcgacggtcgggtcgtagggacacgtactcgacctcctacaccgtactccgacgaccaacggtacctaggtaccgttacgtaaggtaagttacgttttgtaacgttaggtttttaatttagtttcgttagtaacgtacttaaggttaaattaacgttaaacgttccgggtaccgttacccgggtaacgggttaccgggttaccgggaacccggtaaacggggtaaacccggtaaacggggttaacggtaaaacccgtacgggtaaaaaccggttaccggttagggtccggttaaccgaccgggtaaccgtaccgttaacgtcccgggtttaacttcccgtttaacgttacccctttaccccggttacccctaaccccgg

SEQ ID NO: 284714 - DNA, 792 bp, Homo sapiens
  misc_feature: GYAE6OF02HK207.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcgagggccagtcagagtgtacaacaccaacttagccttggttcagcagaacgcctggccacggcctcccgaggcctcctcatgtatgatcgcactacccgacgacgggcccaccggcactccccgacgcccgtaggttccgaggttcggcgtacgggtccggggttacgtacggggaaccacggttaccttaccaccgtttaccctaccgaaacccctacgtaccgaacgtaccgaacgtaccgttaaccggtacgttaccgtaaggtaaacgtttagtttttacggacctttaaggtttttaacgtttaccgttacggttacgaacgtccggtaacggggccgggggttaacttaacgggtttccgggcccgttaccgttccggttaaccgggttttccgggggggaaccggggggttaaccgttaagggggttacgggttaaaccggttaaccggtaaaaccgggttacggttcgggttaccgggtccgttacggaaccccgtaaccggttacgtttaccgtttccgtttaccttccgttaaccctttccccggttccccgacccgtttacgg

SEQ ID NO: 284715 - DNA, 617 bp, Homo sapiens
  misc_feature: GYAE6OF02GBL9E.14.57.F02.1.454.CMB.1.raw
  modified_base (294)..(294): a, c, t, g, unknown or other
  misc_feature (294)..(294): n is a, c, g, or t
  modified_base (379)..(379): a, c, t, g, unknown or other
  misc_feature (379)..(379): n is a, c, g, or t
  modified_base (411)..(411): a, c, t, g, unknown or other
  misc_feature (411)..(411): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggtttcagcagaagcctggccaggcctcccgaggctcccnatgtatgatgcactcccacgacgggcccaccggcactcccagccaggttcagtggcaggcgggtcgtgggacagtacttcactcncacatcagcacgcctagacgtcgtagtaagtnttttggacttaagttttattacgttgtacgtagcgtagggcgggtactaagttcggaccgtcgtccgttacgggttccgggggtaccgggggtaacctaaggggttagggtaacggttaccgaaacggttaccggtggtcgggacctcggaccgtacgtacgttacgttcggttcctttaccgaccgtttcccttacccgtacccg

SEQ ID NO: 284716 - DNA, 582 bp, Homo sapiens
  misc_feature: GYAE6OF02IKVZS.14.57.F02.1.454.CMB.1.raw
  modified_base (377)..(377): a, c, t, g, unknown or other
  misc_feature (377)..(377): n is a, c, g, or t
  modified_base (543)..(543): a, c, t, g, unknown or other
  misc_feature (543)..(543): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccaggctcccaggcctcctcatgtatgatgcactcccacgacgggcccaccggcactcccagccaggttcaggtgcgaggcgggtcgtgggacagtacttcacctcncaccatcagcacgctagtacgtctagaagtatttgactagtttattacgttgttcaggtcgaggcgggtacaagttcggccgtcgtccgtacggtttcggggacggggtaccgtaaggggtcgtacgtacgtaacggtacgtcggtaggtcctacggaccaccgtntaccgttgttaccttcgtacgttcccttcccgtcctacg

SEQ ID NO: 284717 - DNA, 677 bp, Homo sapiens
  misc_feature: GYAE6OF02GHKK4.14.57.F02.1.454.CMB.1.raw
  modified_base (289)..(289): a, c, t, g, unknown or other
  misc_feature (289)..(289): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctgccaggctcccgagctcctnatgtatgatgcactcccacgcgggccaccggcactcccacgccacggttcaggttcggcacgggtccggggtcgtacggggaccacggtacttccaaccgttcctacccaccactccacgacacgaccctaaggacgttcgtagtaaacgttattttcgactttagttttacttacttcggtactacggacgtacgggtccggggtacgttaagttccgggacccgttccgttaccggttaccgggtttccgggggaccggggggtaaccgtaaggggttacgggtacgtttaaccggaacgggttaacgttcgggtacgggtctacggcccgtaaccgttcgttcgttaccggttcttaccgtaccttttcccgtaccccgttaccc

SEQ ID NO: 284718 - DNA, 558 bp, Homo sapiens
  misc_feature: GYAE6OF02IZUG8.14.57.F02.1.454.CMB.1.raw
  modified_base (397)..(397): a, c, t, g, unknown or other
  misc_feature (397)..(397): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagagcctggccaggctcccgaggctcctcatgtatgatgcatcccacgacgggcccaccggcactcccagccaggttcagtgcagcggtctgggacagtacttcactctcaccatcagcagcctagagtctagaagtntttgctagtttatattgtacagtctaagtaataactaacgttcgacctcgtaggacgttcggaccgaacgggaaccaaggtagaaagtacaaacgtacgtaggtacggtactagactacctagtccgttcgttaccttactacttccgttaccccgtaccg

SEQ ID NO: 284719 - DNA, 686 bp, Homo sapiens
  misc_feature: GYAE6OF02JOPE6.14.57.F02.1.454.CMB.1.raw
  modified_base (338)..(338): a, c, t, g, unknown or other
  misc_feature (338)..(338): n is a, c, g, or t
  modified_base (489)..(489): a, c, t, g, unknown or other
  misc_feature (489)..(489): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttcttgtggctattttaaaagatgtccagtgtgaggtgcagctgttggagtccgggggagcttggtcaggccggggggtccctgacactcgtcctgtgcagcctcaggtattcattttagccgaatatgcctatgagctcgggtccgccaggcctccgagggacgggctgggagtgggtctnagcaagtcgtagtcggttactaggtaggaacgtacgtattcgacggtcctacgtcggagtaacggggccgtttcaccgactctaccaggagtacctaatcccgaaagtaacctaacgttcttaactttctaacgtaaacgtcgtaacaacnccttaaggaaaacgtaaccgaagggaccgtaaccggggtaccgtttagttttacgtttacggttagtaacgggtaaaagacgtttaacggaaaggttccgttaaaggttaccgtaaacgtttaccccgttaaaggtttacgggggtaaccggggttaccccttttagggaacgttttcgggacgttaacccgggggg

SEQ ID NO: 284720 - DNA, 784 bp, Homo sapiens
  misc_feature: GYAE6OF02HU5QP.14.57.F02.1.454.CMB.1.raw
tcagcgtctagtaccacgaccggtgctcgatttagctcgatatagttgggtttggggggaactgctcagttaggaccagagggaaccatggaagccccagctcagcttctcttcctcctgctactctggctccagataccacggagaaattgtgttgacacagtctccactcacctgttctttgtctccgaaggggaaagacgcccacctctcctgcgacgggccagtcagaggtcgtaccaaacacctaaacgttacgccgttaggttttacagaccaaggaaacggtccctagggacctaacgggcctaccccgagggtccttccgttacaagttcggtaattcggaacttcggacctaactacccccgaacggaccggggaccccaaccgggccaacctccccgaacggtacccggttaacggttaccgaacgggttccgggaccgaacggggtccggggttacgtagggggaacctaacgggttaacccttaccgtaaccgttccctaccctaacccgtaattaccgaacggaccgtaacggtaccgttaaggtacgtttacgtaaggtaaacgtttacgtttttacgacgtttaaacgttttacgtttacgtagttacgtacgtacggacgggtacgggactaaggttcggcccgtacgttccgtacgggtttcggggacggggtaacgtagggtacgtaacgttaacgaacggtcgtaggtcggactcgactacgttacgttacgtcgttcgtacgtaccttccgtacccgtactacg

SEQ ID NO: 284721 - DNA, 640 bp, Homo sapiens
  misc_feature: GYAE6OF02HDCUE.14.57.F02.1.454.CMB.1.raw
  modified_base (251)..(251): a, c, t, g, unknown or other
  misc_feature (251)..(251): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtcctgacactctccngtcgcagcctcaggtattctattttagacgtaatatgccatgacgcgtcggtcccgccaaggcctaccggaggggaaggggcgtgggacggtgggtctcgagacaatcgagttggttatagtggaactacgattcgacgtccgtcgtccgtaggaacgggtccgttctccactccacagacactaacttaccgaaagaccaaccttacttactttacgtttaacaagttacggaactacgaccgtagaaaacggaacgaagtaacgacgggtcgttagtttagttttagtagttagtaaacgtagtaacggtaacgtacgttaactagtaacctaacccgttaaggttcggggtacgggttcctttaatacggttggtacgtaccgggg

SEQ ID NO: 284722 - DNA, 618 bp, Homo sapiens
  misc_feature: GYAE6OF02I3RIF.14.57.F02.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (423)..(423): a, c, t, g, unknown or other
  misc_feature (423)..(423): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcacgggccagtcagagtgtacaacaccaacttagcccttggttcagcaagaagcctggccaggcctcccgaggcctcctcatgtatgatgcatcccanacgggccacggcactcccagccgaggttcagtggcacggcgggtctaggggactaggtaccttcgactcctccaccatccgagcacgcctaaggcgtctaggaagttntttacgacttaagttttacttacgttagtcgacgtcgacggcgggtactaaggttcggccgtcgtacgtaccggtttccgggggaccgggggtaaccgtagggtacggtaacgttaaccgaacggtacggtggtcgggtacctacggactaccgtacttcgttacgttccttacgcgtttcccgtacccgtaccc

SEQ ID NO: 284723 - DNA, 588 bp, Homo sapiens
  misc_feature: GYAE6OF02H6V9U.14.57.F02.1.454.CMB.1.raw
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (438)..(438): a, c, t, g, unknown or other
  misc_feature (438)..(438): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggataaattgtgttgacacagtctccactcaccctgtctttgtctccaggggaaanagccaccctctcctgcagggccagtcagagtgtcaacaccaacttagcctggtttcagcagaagcctggccaggctcccaggctccncatgtatgatcgcactcccagacgggccaccggtcacgtcccagccaggttcaggtggcagtcgggtactgggacnggtacttcgactctcacntcagcacgctagntctgatatttgacttagtttattactgtacagcgaggcgggnaagttcggaccgtcgtacgtccggttacggggaccggggtaccgtaagggtcggtaacgttacgaaacgtacgtggtaggtccgtaggtaccgtaccgtacgttacgttcgttacgttacgtacgttcccgttacccggtaccttaccgg

SEQ ID NO: 284724 - DNA, 584 bp, Homo sapiens
  misc_feature: GYAE6OF02FPKFV.14.57.F02.1.454.CMB.1.raw
  modified_base (203)..(203): a, c, t, g, unknown or other
  misc_feature (203)..(203): n is a, c, g, or t
  modified_base (353)..(353): a, c, t, g, unknown or other
  misc_feature (353)..(353): n is a, c, g, or t
tcagcgtctagtaccacgaccggtgctcgatttagctcgatatagttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccaggtcagagtgttagaagcaacttagcctggtaccagcagaaacctggccaggctcccaggcctcctcatctatggtgcatccaccagggccactggtgtcccagccaggttcagtggcagtgggtcngggacaggagttcactctcaccatcagcagcctgcagtctgaacgtatttgcttagtttattattgttcagtctagttaacttaattaacgttgggtcccttaccggttcggtaccggtttccggaccggtaacgggtaccgtaagggttacggaaacgtaccgtaaaacggtaacgttacggtacggtacgtagaccgtacctacttaccgttcgttccttacgtaaccg

SEQ ID NO: 284725 - DNA, 555 bp, Homo sapiens
  misc_feature: GYAE6OF02JMALY.14.57.F02.1.454.CMB.1.raw
  modified_base (202)..(202): a, c, t, g, unknown or other
  misc_feature (202)..(202): n is a, c, g, or t
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
  modified_base (506)..(506): a, c, t, g, unknown or other
  misc_feature (506)..(506): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggctcctcatgtatgatgcactccccagngggcccaccggcactcccgagcctagggttcaggtcgcaggcgggtctgggacagtacctnactcncacatcagccagccagagtctagaatgttgctagtttactatcgtacacgcacggtcgggactagttcggcgtctcctcggttacgggccggggactagggtgacgttacaacgtacgtggtcgtcgtnacgtaccgtatcgttcggttacttaccgtacgttccgtacccgtctacg

SEQ ID NO: 284726 - DNA, 623 bp, Homo sapiens
  misc_feature: GYAE6OF02GN1M7.14.57.F02.1.454.CMB.1.raw
  modified_base (346)..(346): a, c, t, g, unknown or other
  misc_feature (346)..(346): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagcgtctagtaccacgaccggtgctcgatttagctcgatatagttgggtttggggctgagagaggagcccagtcctgggatccttcaggtgtttcatttggtgatcaggactgaacagagagaactcaccatggagtttgggctgagttggctctttcttgtggctattttaaagatgtccagtgtgaggtgcagctgttggaggtccgggggagcgttggtacaggccgggggggttccctggaccacgtctccgtgtgctagcctcaggtattcattttagcgaatatgcccagtgagcgtgggtccgccaggctccgaggggaagggctgggagtgggtcncgtagcaaattcaggttgtacgtagtggaatcagttcgcgctcgcgtggaggtccgtcnccgntcncacganactaatccaagaactctacgtatttactctaaagtccgaatacggtcctaaggaaacacggtaaacgaccgtaacgggtaccgttgtttaacttttgggactaaggaaacgtacgttaaccgaaaggtttcgtaactaggtaaccttaacccgtaaggtttcgggtaccgggtacctttacggagttggttaccggtaaccgggg

SEQ ID NO: 284727 - DNA, 871 bp, Homo sapiens
  misc_feature: GYAE6OF02G7JF0.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggcttaattttaaagatgtccagtgtgaggtgcagctgttggaggtccggggggaggtcttggtacgaggccgggggggtccctgacactctcctgtgcacgcctcgaggtattctaagtttttacgacgtaaattatcgacctaatggagtccgttcggggtcccgccgaggcctaccggaagggggaacggggccgtgggaggttcggggtctacgaggtacctaaagtccgtaggttcggtttacgtaggttagggaaacgttaatacgttaccgaccggtcccgttccgtacccgggttagggaaaccgggggttccccggtttctacccgtacgttcccgtacccgaaacgggactaaaccgttaaacttaaccccgaaaaggtaaaccttacctttacctttaacgttttaccttaaccgaaaagttacgggaacctaacggtacccgttaaggaaaaacggtaacccggtaaaacggaccggtaaccgggggttaccgttttaagggttttacgtttttttaacggagggttaaggaaaagggtttaccgtaaaccgggtttaaaggtttaccctaaaggtttccggtaaaaacccgtttaccccggtttaaaaggggttttaccgggggggtaaccgggttttaaccccgtttttacggaaaccggtttttcgggtaccccggggttaaccggggggg

SEQ ID NO: 284728 - DNA, 849 bp, Homo sapiens
  misc_feature: GYAE6OF02G617O.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggggaaangccaccctctcctgcagggccagtcagagtgtacaacaccaacttagccttggttcagcagaacgcctggccaggcctccccgaggcctcctcatgtatgatgcactcccgacgacggggcccaccggcactccccgagcccgtaggttcaggtcggacgacggtccggggtcgtaggggaccaggtaccttacgacgttcctaccaaccctactaccgaacgaccgaccggtacccgtacggtaacggttaccgttaaggtaaaggtttacgttttttacggaaccgtttaaggttttttaaccgtttaaccgttaggttacccgtaacgggtaccgggtaaccgggggtaccggggggtaacttaaaccgggttttccggggaccccgttaccggtttacccgggttaacccgggggttttttacccgggggggggaacccggggggggttaaacccggtttaaacgggggggttaacgggtttaaacccgggtttaacccgggtaaaaaccggggtttaccggttcggggttacgggtcccggtttacgggaaccccgttaacccgttaccgtttcccgtttacgggtttacccctttaccggttaacccgttttcccccgtttaccccggtacccgttaaccg

SEQ ID NO: 284729 - DNA, 596 bp, Homo sapiens
  misc_feature: GYAE6OF02I8B5U.14.57.F02.1.454.CMB.1.raw
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagagcctggccaggctcccaggcctcctcatgtatggtgcatccaccgagggccacgtggtcgtcccagccaggttcagtggcaggtggtctgggacngtagttcactctcacatcagcncgctgcagtctagagtatttcgcttagtttattattcgtctagtactagttaactaataacgttcggtcccgttaccggtggtacccggttcgggaaccgtaacggggaaccgtaagggtacggtaaacgtaccgaaacggtacgtaggtcgggtactacggacctaccgtagttcgttcgttacctttaccgtacttcccgttaccccgtaccg

SEQ ID NO: 284730 - DNA, 591 bp, Homo sapiens
  misc_feature: GYAE6OF02JFVXM.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacacgtctcctgtgcagcctcaggattcatttttagcgtaatatgccatgagcgtgggtccgccgaggcctccgaggggaaggggctgggagtcgggtctcagcaatcgagtggttctaggtgaagtacattacgacgccgtctccgtaggaacgggtccgttctccatcctccagacgacacttacgaaacgacactacttattcttacaatgacagctagaaagacgaagacgacggcgttagttagtttgtagtagaaagtagtaacgaagtctaagtacgtaacgtaaccgtaagggttacggggggtacctttacgtagtacgtcggtacgggtaacccggg

SEQ ID NO: 284731 - DNA, 920 bp, Homo sapiens
  misc_feature: GYAE6OF02HVUQ3.14.57.F02.1.454.CMB.1.raw
  modified_base (314)..(314): a, c, t, g, unknown or other
  misc_feature (314)..(314): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagacgccaccctctcctgcgagggccagtcagagtcgtacaacaccaacttacgccttggtttaccagcaagaagcctaggccaggcctccgaggtcctccgtcagtgtatgntcgcactcccgacgacggccgacggcactccacggcctacgggttcacggtcgacgacggtcgggtacggtacggggactacggtaccgtttacaacccgttcctacctaacccgtagtacccgacgaccgaccggttaccgtaacgggtaccgtttaccggttaacggtaaacggtttacgtttttaaccgggtacgtttaaaccgggtttttttaacgttttaaccggtttacgttaaccgggttaaccggtacgggtttaaaccggggggtaccggggggttaaaccttaaaccgggggttttaccggggttacccccgggttaccccgtttacccgggttttaacccgggggggttttacccggggggggaaaccccgggggggggtttaaaccccggttaaagggggttaccgggggtttaaaaccggttttaaaccccgggtaaaaacgggtttaccgggttacgggggttaccggggttaacccgttacccggtaaccggtaaacccggtttaaccggtttccggttttaccggtttaccccgtttaaccgtttaaccccggttttaccccggttccccccgggtactttaaccccggg

SEQ ID NO: 284732 - DNA, 638 bp, Homo sapiens
  misc_feature: GYAE6OF02I2833.14.57.F02.1.454.CMB.1.raw
  modified_base (229)..(229): a, c, t, g, unknown or other
  misc_feature (229)..(229): n is a, c, g, or t
  modified_base (354)..(354): a, c, t, g, unknown or other
  misc_feature (354)..(354): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagngtgtcaacaccaacttagcctggtttcagcagaagcctggccaggctcccaggcctcctcatgtatgatgcactcccgagacgggcccaccggcactcccagccaggttcagtggcaggcggtcngggacagacttcgactctacacctatcgacgcacgaccgtaagacgtactagaagttattttggacttaagttttacttacgttagttacaggtaccgtagggtaccggggactaaacggttcgggcccgtacgtttaccgtaccgggttttccgggggaccgggggtaaccgtaaggggtcggtaacgttaacgaaaccggtacgttaggtccggtacgtccggacctaccgtagtttccgttacgttaccttccgtaacgtttccccgtacccgacttaccg

SEQ ID NO: 284733 - DNA, 681 bp, Homo sapiens
  misc_feature: GYAE6OF02I8DQS.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaanagccaccctctcctgccagggccagtcagagtgtcaaaccgaccaacttacgccttgggttcacgtcagaacgcctggaccaggcctcccagtcctcctcatgtatgactgcgtactcccaacgtacggggacccaccgggacactacccgacgccgtaacggttcctaaggtcggtacgacggtcgggtcgtacgggacacggtacttcgacgtacctaccaccgtactccgagtaccaacgtacccgtagtacgtactacggtaagttagttttacgacttacgtttaagtacgttcgttaacgtacgtaccgtagggtccgggtacttaaacggtcggttacccgtccgttaccgtacggtttccggggacgggggtaaccgtagggtacggtacgttaacgaaacgtacgttcggacggtcgtacgacgtacgttacgtcgtacgttcctacgtacgtcccgttaccgaccgtacg

SEQ ID NO: 284734 - DNA, 529 bp, Homo sapiens
  misc_feature: GYAE6OF02JXOVS.14.57.F02.1.454.CMB.1.raw
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (364)..(364): a, c, t, g, unknown or other
  misc_feature (364)..(364): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaanagccacctctcctgcagggccagtcagagtgtcaacaccaacttagcctggttcagcagagcctggccaggctcccaggctcctcatgtatgatgcatcccanacgggccaccgcatccccagccaggttcagtcggcaggcggtctgggaccagaccttcactntacaccatcagcagcctacgacgtctgaagtatttgctagttattactagttcagcagcgggtcaagttcggacgtctcgtacgttcgggacggggtacgacgggtagtagttacgaacgacgtggtagctgactacagtctagtctcctacgtcttccgctacg

SEQ ID NO: 284735 - DNA, 555 bp, Homo sapiens
  misc_feature: GYAE6OF02HEOZL.14.57.F02.1.454.CMB.1.raw
  modified_base (457)..(457): a, c, t, g, unknown or other
  misc_feature (457)..(457): n is a, c, g, or t
  modified_base (541)..(541): a, c, t, g, unknown or other
  misc_feature (541)..(541): n is a, c, g, or t
tcagcgtctagtaccacgaccggtgctcgatttagctcgatatagttgggtttggggctgagagaggagcccagtcctgggatcttcaggtgttttcatttggtgatcaggattgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtcccgccaggcctccgaggggaaggggctgggagtggggtctcgagcaatcaggttggttctaggtgggaagtacattcgacgtccgtctccgtgaacggggcccgtttctccatcctccagagacaattccaagaacactctatttctacaaatgacnacctagaaagacgaagacacgggcgtgttattttgagtgaagatacgaagtctatgaataccaagtttcgggacggtccgtttnagttgtcgtcgggg

SEQ ID NO: 284736 - DNA, 566 bp, Homo sapiens
  misc_feature: GYAE6OF02G3WEX.14.57.F02.1.454.CMB.1.raw
  modified_base (361)..(361): a, c, t, g, unknown or other
  misc_feature (361)..(361): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgctccgaggggaaagagccaccctctcctgcagggccagtcagagtgtacaacaccaacttagccttggtttcagcagacgcctggccaggcctcccgaggcctcctcatgtatgatgcactccccgacgacgggccaccggcactcccgagcctaggttcagtggcaggcggtngggacagtacctcactctcacatcacgcagctagngtctagagtnttgacttagtttactctagtcagcgaggcggtacacgttcggccgtctccgtacgttcggggaccggggtaactagggtcgaacgttacgaaacgtacgttggtaggtcgtcgactaccgtacttcgtcgttcgtactaccgttccgttcccgacttacg

SEQ ID NO: 284737 - DNA, 739 bp, Homo sapiens
  misc_feature: GYAE6OF02JAEJV.14.57.F02.1.454.CMB.1.raw
  modified_base (202)..(202): a, c, t, g, unknown or other
  misc_feature (202)..(202): n is a, c, g, or t
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacacctaacgttgccttggttcagtcaagaacgccgtggccaggtcctcccgaggcctcctcactgtatgatcgcacgtccacgacggccaccggacactcccgagccgtaggttccaggtcgacgagccggggttctggggaacctaggtaccttcgaccgtttccnccaaccgtnttacccgagacccgtacgtcccgtaacgtacgttacgtagggtaaccgttacttttaccggacgtttaacgtttttaactttaccggttacgttacgaaggtaccggtaccggggttacggggtacgttaacgttcccgggtacccgtaccggttaccggtttacccggggtttccgggggtaaccggggggtaacccgttaaagggggttacgggtaacggttaacccgtaaacggttcgtacgggttaacgggtccttacggaccgtaaccgttaccgttacgttcggtttaccctttacggtacctttccccggtcccgtacg

SEQ ID NO: 284738 - DNA, 604 bp, Homo sapiens
  misc_feature: GYAE6OF02G3D9Y.14.57.F02.1.454.CMB.1.raw
  modified_base (407)..(407): a, c, t, g, unknown or other
  misc_feature (407)..(407): n is a, c, g, or t
  modified_base (457)..(457): a, c, t, g, unknown or other
  misc_feature (457)..(457): n is a, c, g, or t
  modified_base (490)..(490): a, c, t, g, unknown or other
  misc_feature (490)..(490): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggagtccgggggagcttggtacgaggccgggggggtccctgacactctcctgtgcagcctcaggattcatttttagcgaatatgccatgagctgggtccgccaggctccgaggggaaggggcgtggaggtgggtctcagcatcagtggttctagtggaagtacattcgaccgccgtctcgtggacgggtccggttctccatcncagacgacaatccaaagaaccactacttactttctactaaagtcggaacncgtacctaagaaacgacggaaagaccgacgggngttacgttagttttgtgtagaaagtataacggtaagtactaagttcgtaacttacccgtaaaggttttcggggaacggggttccttttaccgaagttcggttcggtaccggggg

SEQ ID NO: 284739 - DNA, 749 bp, Homo sapiens
  misc_feature: GYAE6OF02HST9Y.14.57.F02.1.454.CMB.1.raw
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagngtgtcaacaccaacttagcctggtttcagcagagcctggccaggcctccaggctcctcatgtangatcgactactcccacgcgggacccaccggcactccccgagtccgaggttcagggtcggaccgagggccggggttacgtcggggaactacggtaccgtttccaacgttccctacgaaacccctcgttaccaaggtcccgaacggtaccccgttaaggtaaccgtttcgtaacgggtaaagttttacgtttttacggaccttttaaggttttaactttaaccggtttcggttactacggaccggtagggtccgggggaacttaacggttccggggcccgttaccgttccggtaccggtttaccggggggaccgggggggttaacccgaaagggttccgggtaacggtttaaccggaaacgggttaaccggtagggtcggtaccgttccggaccgtaaccgtaacgtttccggttacgttacccgttactacccgttttcccgttaccccgaccg

SEQ ID NO: 284740 - DNA, 687 bp, Homo sapiens
  misc_feature: GYAE6OF02I4PO8.14.57.F02.1.454.CMB.1.raw
  modified_base (202)..(202): a, c, t, g, unknown or other
  misc_feature (202)..(202): n is a, c, g, or t
  modified_base (633)..(633): a, c, t, g, unknown or other
  misc_feature (633)..(633): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
  modified_base (654)..(655): a, c, t, g, unknown or other
  misc_feature (654)..(655): n is a, c, g, or t
  modified_base (657)..(658): a, c, t, g, unknown or other
  misc_feature (657)..(658): n is a, c, g, or t
  modified_base (661)..(662): a, c, t, g, unknown or other
  misc_feature (661)..(662): n is a, c, g, or t
  modified_base (664)..(664): a, c, t, g, unknown or other
  misc_feature (664)..(664): n is a, c, g, or t
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
  modified_base (671)..(672): a, c, t, g, unknown or other
  misc_feature (671)..(672): n is a, c, g, or t
  modified_base (676)..(676): a, c, t, g, unknown or other
  misc_feature (676)..(676): n is a, c, g, or t
  modified_base (681)..(682): a, c, t, g, unknown or other
  misc_feature (681)..(682): n is a, c, g, or t
  modified_base (685)..(686): a, c, t, g, unknown or other
  misc_feature (685)..(686): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacacgcagtatctgcaaaatgaacagcctgagagctgaggacacggctgtgtattactgtggganagatggaggtcgaatattgtagtggtggtagctgctataactggatcgacccgtgggccacgggaaccctggtccaccgtcctcctcgagccctaccaccgaacgggcccctaacgttccggtccctttcccccgtacgggccccacccccgttacccgttaccccgaaacggtaaccggcctaaaccccggttccggttacgggggggaccccaaccgaaccggggcccggggtcccccgtttcgggggacccgttcgggtcccggttacgggtttaacccggaaaacggggttaccccgtttaaccgtttacccgggtttaacccgtaaaccgggtaccggtaacccgtttgggaaaccgggcccgggggtaaccggttcgggacccgaaacggggccggaacccgtaagttaaccgggagcgacgcgngcgagngngangacncgnacnncnntcnncncnncngnngacncgcgnnctnng

SEQ ID NO: 284741 - DNA, 743 bp, Homo sapiens
  misc_feature: GYAE6OF02JIRLL.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccacggagaaattgtgttgacacagtctccactcaccctgtctttgtctccgaaggggaaancgcctacctctcctgcgagggccagtcaggagtcgtacaacaccaattcgccttgggtttccagccaggacgtcctggaccaggcctcccgaggcctcctcagttgtacgtcggatcggaccaacgtcccgacggacgggccaccggcacgtcccgagccgtaggttcaaggtggcacggccggtgtagggacacgtaccttacaccgtctaccgaaccagtccgacgctaacgtaccgtaacgtacggtacgtacggtaacgttacgttttacgaccgtttaagttttaacgttacgttgtacgtaacggttccgaacggggtaccgggtaacttaacgggttcggacccggttacttacccgggtttaaaccgggtttccggggggaaaccggggggttaccttaaacggggggttccgtaaacgggttaacccggtaaaaggtaccggtttcggggtacggtaccgttacggaccgtacccgtacgttacggttaccgttcgttaaccgtcccgtttacctttcccggacttaccgg

SEQ ID NO: 284742 - DNA, 708 bp, Homo sapiens
  misc_feature: GYAE6OF02IQASS.14.57.F02.1.454.CMB.1.raw
  modified_base (286)..(286): a, c, t, g, unknown or other
  misc_feature (286)..(286): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagatacccaccggagaaattgtgttgacacagtctccactcaccctgtctttgtctccagggaaagagccaccctctcctgcaggccagtcagagtgtcaacaccaacttagcctggttcagcagagcctgcctaggctcccgagcctccncatcgtatgatcgcactccacgacgggtccaccggcactcccacgtccgaaggttcacggtcggaccgaggtccgggtacgttaggggccaacggtacgttcctacgtaccgtccctaacctaacttccgaacgtcgacgtcctaaggtacttaccgtagtaaacggttcgttttagaccttaaggtttaaccgttccttagttacccgagtacccggtaagggaccggggtactaacgggttccggacccgtcgttaccggttaccggtttaccgggggaaccggggggtaacccgtaaaggggttcggtaaacgttaacccggtaaacggtaccggttaggtccggtaccgtacggtacccgtaacctacgttcgttacggttccgttaccgtaccgtttccccgttacccgccgttacg

SEQ ID NO: 284743 - DNA, 698 bp, Homo sapiens
  misc_feature: GYAE6OF02FSLOP.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaacttgtgttgacacagtctccactcaccctgtctttgtctccagggaaagagccaccctctcctgcagggccagtcagagtgtacaacaccaacttgcctggtttcagcacgaagtcctggccaggcctccgaggcctctcatgtatgatgcactccaacgcggccaccgctactccagtccaggttcaggtcgcgacggtcggtcgtacgggacagacttcacctcaccaccatcgacgcgacgtaccgtagaccgttcgtaaggtaaacttacgtttcgacgtttaagttttaaccgttaacgttcggttacaacggtaccgtaacgggtaccggggtaccttaaacggtttcgggtacccgtacgttacccgttaaccgggttttacccgggggggaaccggggggttaaccgtaaacggggtttacggtaacgttaacccgaaacggttacggttcggtaccgggtacctacggtaccctaaccgtacgttccggttacgttacccttaccgtaccgtttccccgttaccccgacgtaaccg

SEQ ID NO: 284744 - DNA, 590 bp, Homo sapiens
  misc_feature: GYAE6OF02GNVAM.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgaggggaaanagccaccctctcctgcagggccagtcagagtgtacaacaccaacttagccttggtttcagcagaagcctggccaggctcccaggctcctcatgtatgatgcatcccacacgggccaccggcactcccagccaggtcagtggcagcgggtctggggacaggacttcgactctacgaccagtcagcacgacctagagtctagaacgtatttcggctagtttacttactgtacgtagacacgggcgggtactaagttcgggccgtcgtaccgtaccggttttccggggacggggggtaacccgaaagggttagggtaacgttaccgtaaacgaacgttggtcggcgttcgactacgtagtcctcgttcttacgtacttcctcccgtacc

SEQ ID NO: 284745 - DNA, 745 bp, Homo sapiens
  misc_feature: GYAE6OF02F44HF.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggaggtccgggggaggcgttggtacgaggccgggggggtccctgaccactctcctgtgcagcctcgaggattctatttttagcgaatatgccatgagtctcgggtccgccgaggcctaccgaggggaaggggctgggaggtgggtctcgaggcaatcaggttggttctaggtggaaacgtactagttcggaccgtccgtctccggtaggtaacggggtcccggtttcctcccgtacttccgtacccgaaggaacgtaacctaaacttacccgaaaagtaaccctaacttacccttaattttaacctttacgtaaaacgttacggaacaacggtaccgtaacggaaaacggtaacgggaaacgaaacccggacggggtaaccgtttaggtttaacgttttttcggttaaggtaacgggtaaaagtacgttaaacggtaaaccgttcgttaaacttacggtaaaccttaacccgttaagggttttacgggggacggggtttacccttttacggacggtttaccggttcggttaacccgggggg

SEQ ID NO: 284746 - DNA, 793 bp, Homo sapiens
  misc_feature: GYAE6OF02FYMV3.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaacgcctggccaggcctacccaggcctcctcatgtatgatgcactccccgacgacggcccaccggcacgtccccagacccgtaggttcacggtcggacgacggtccggggtcgtcggggacacgtaccgtttcgaaccttccgtaccaaccctaacttaccgaacggccgtaacggtacccgttaaggacgttaccgttaagggtaaacgtttacgtttttcggaaccgtttaagggtttttaactttaaccgtttggttaccgtacggtaccggtaacggggtaccgggggtaacttaacgggttccggggtacccgttaccgtacccggtttaaccgggttttcccggggggacccgggggggttaaacccggtaaaggggttcgggtaaaccgttaaccggtaaaaccgggtacgttacgggtaccggtaacgtttaccggaacccgttaacccgttaacgttcccggttttacgttacccgtttacccgtaaccgtttccccgtttacccccggtacccttaaccg

SEQ ID NO: 284747 - DNA, 711 bp, Homo sapiens
  misc_feature: GYAE6OF02IQXB5.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagactaccaccggagtaaattgtgttgacacagtctccactcaccctgtctttgtcctcgaggggaaagcgccaccctctcctgcgacgggccagtcagagtgtacaacactaactagccttggttacagcagtacgccgtggccgaggcctccgacggtcctctacagtacgtactcgaatgctaactcccacgacgggaccaccggactacgtcccaaccggtccgtaggttaccagggtacggacgacgggtcggtaccggtgggaaacctaggtaccttacgaaccgtcctacaccgtacgccagacgacgtacgtagacgtcgtagtaaacgttgttacgtacttaaggtttactacgttcgtacgtaacgtacggaacggtacggggtaactaacgggttcggacccgttacgtacgtaccggggttacggggacggggttaaccggaacggttacggttaacggttaaccggaacggttaacgggcggttaacgggtaccgtacggaacctaacggtattcggtttaccgttcgttacccgttaaccgttccgttaaccccggtacg

SEQ ID NO: 284748 - DNA, 696 bp, Homo sapiens
  misc_feature: GYAE6OF02G579L.14.57.F02.1.454.CMB.1.raw
  modified_base (478)..(478): a, c, t, g, unknown or other
  misc_feature (478)..(478): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcacctgtctttgtctccgaggggaaagagccaccctctcctgcagggccagtcagagtgtcaacaccaacttagcctggtttcagcagaagcctggccaggcctcccgaggcctcctcatgtatgatcgcactcccacgacggccgaccggccaacgtcccagacccgtacgggttacacgggtacggcgagggtaccggggttcgtacggggacaccgggtacttaccgacttcctaccgaccctactacgacggaccaacggtaccgttaaggtaacgttacggttaggttaaacggtttnttttaacggacgtttaagtttttaacgttacgttaggttacacggttacgacgggtacgggtacgtaacgggttccggccgttacgtccgtacgggttccggggaccggggggtaaccgtacggggtcggtaacgttacgtaaacggtcgttaggtcggtcgtacgaccgacgttcgttacgttcgtcttaccgttcttcccgttacccgtccttacg

SEQ ID NO: 284749 - DNA, 580 bp, Homo sapiens
  misc_feature: GYAE6OF02GJSQ3.14.57.F02.1.454.CMB.1.raw
  modified_base (354)..(354): a, c, t, g, unknown or other
  misc_feature (354)..(354): n is a, c, g, or t
  modified_base (491)..(491): a, c, t, g, unknown or other
  misc_feature (491)..(491): n is a, c, g, or t
tcagcgtctagtaccacgaccggtgctcgatttagctcgatatagttgggtttggggtccagtgtgaggtgcagctgttggagtccggggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgataccaagtttggagggcctttcatgtctggggccaagggcgctggtcaccgtctcttcacgcctcaccaagggcccagtccgtccttcccctggccctaccctcctccaacgacncaccctcgtcggggccacgacgcggaccctggggccttcggccgttggtccgaagggtaccttaccgttaccgtaccgtcggtaaccgg

SEQ ID NO: 284750 - DNA, 682 bp, Homo sapiens
  misc_feature: GYAE6OF02I06BH.14.57.F02.1.454.CMB.1.raw
  modified_base (293)..(293): a, c, t, g, unknown or other
  misc_feature (293)..(293): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttacgcctggtttcagcagaagcctggccgaggcctcccgaggctccncatgtatgatgctactcccgacgacgggcccaccggacctactcccaggaccctaggttcaggtggccgaggcggggtgtacgggactacggtacttcgactccgtctaacccgtactccgagaccacgtaccgtagtaagtcgtaaggtaagttacttttgacttaagtttttacttacgttagtcgtagtccgggaggtaccgggggtactaagtccgggtccctccgttaccgttaccggggttccgggggtaaccggggggtaaccgttaagggtacgggttaacgttaaccgggtaaaccggtaccgttggtacgggtccttaccggacctaaccgacgttcggttacgttcgttacccacgttcccgtttaccccgccttacg

SEQ ID NO: 284751 - DNA, 601 bp, Homo sapiens
  misc_feature: GYAE6OF02GR8MS.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagngccaccctctcctgcagggccagtcagagtgtcaacaccaacttagcctggtttcagcagaagcctggccaggcctcccgaggcctcctcatgtactgatgcactcccacgacgggcccaccggcacgtcccagcccgtaggttcagtcggcgaggtcgggtctgggacagtacttacactcaccacatcacgcacgcctagcgtacgtagaacgtagtttgacttagtttactactgtcagcgacggcgggtctaaggttcggccgtccgttcgtaccggttccgggggacggggtaaccgaaggggttcgtaaggttaccgaacggtacgtggtcggtcgtacgacctaccgtattccgttacgttaccttccgtacttcccgtacccggactaccg

SEQ ID NO: 284752 - DNA, 562 bp, Homo sapiens
  misc_feature: GYAE6OF02FO0LM.14.57.F02.1.454.CMB.1.raw
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggagcttggtacaggccggggggtccctgacactctcctgtgcagcctcaggattctatttttagcgaaatatgccatgagcgtgggtcccgccgaggctaccgagggaaggggctgggaggtgggtctcgagccaatcgagtggttctaggtggagtacnttcgacgcctctcgtgacggccgttcnccatcncagagactatcaanacactacttattctanaatgactagcctagaagacgaagacgacggtcgttagttagtttttgagttagaaagtctaggtcggaaattcgtatgtaactacccgtaaggtttgggacgggttcctttacgacttggtccgg

SEQ ID NO: 284753 - DNA, 886 bp, Homo sapiens
  misc_feature: GYAE6OF02HYGD2.14.57.F02.1.454.CMB.1.raw
  modified_base (213)..(213): a, c, t, g, unknown or other
  misc_feature (213)..(213): n is a, c, g, or t
tcagcgtctagtaccacgaccggtgctcgattttagctcgatatagttgggtttggggtagaactgctctagttaggacccagaggggaaccatggaagccccagctcagcgttctcttcctcctgcctacgtcctggctcccagactaccaccggagaaaattcgtgttgactacagttctccactcacctgtctttgtctccaggggaaanacgccgacccgtctccgtgcgagggccagtacagtagtacgtacaacgaaccaaacttagaccttagggttttccaaggtcgaaggtaacgtcccgttgggcccaacgggccgttacccccgaagggtcccttaccccgttactacgttcggttaagtacggtaaacttccggaccctaaagttaccccccgtaacggaaccgggggtccccctaacccggggtaccaaccgttacccccaacgggtaccccgtaacgggttttcccgaagggttcggggaacccaaccgggggtaccgggggtttaccgttacgggggaacctaaacggttaccgttttacccgtaacccgtttcccgttacccgaaccccggtaagttcccgaaacgggttccgtaacggtacccgtttaacggtaaccggtttccggttaacgggtaaacggtttaacggttttacgtaccgtttaacgttttaacctttaaccgttacggtacgtacggtaccgtacgggaccggggtaccgtaaacggttccgggcccggttccgtccgtaccggtttccgggccgggggtaaccgtacgggtacggtacgtaccgaacgacgtacggtcggtacgtcgacgtaccgtacgttcgtcggttccttaccgcctttccgtcccgtaaccg

SEQ ID NO: 284754 - DNA, 910 bp, Homo sapiens
  misc_feature: GYAE6OF02JFB8L.14.57.F02.1.454.CMB.1.raw
  modified_base (97)..(97): a, c, t, g, unknown or other
  misc_feature (97)..(97): n is a, c, g, or t
  modified_base (202)..(202): a, c, t, g, unknown or other
  misc_feature (202)..(202): n is a, c, g, or t
tcagcgtctagtaccacgaccggtgctcgatttagctcgatatagttgggtttgggggaggaactgctcagttaggacccagagggaaccatggaanccccagctcagcttctcttcctcctgctactcgtggctcccagactaccaccggagaaattgtgttgacacagtctcactcacctgtcttgctccgagggaaacngcctaccctctcctgaccacgggccagtcgagtacgttcgtccaaacacctaacttacggcccttgggtttaccaggtcctaggtaacgtccgtacgggcctaaggccgttacccgaggtcctacccgtcaagtggtactacgtatcgacttactccccgaacgtcggcccaacggtcctacgtacccgaacgtcctaaggttccgaggtcggccgtacggggtaccggttcggtacggggtaacctacgggtaacctttccgtaaccgtaccgttaccgtaaacccgttacgtaaaaccgtcggtaaccgtaacgtaacccgtaaacgggtaccggttaacccttaagggttaaacgtttaccgttttaaacgggtaccggttttaacgttttaacggtttaccgttaacggtttaccggtacggttaaccccgttaagggggaccccgggtaagttaacccgggttccggggtaaccccttttcccgggtttaaacccgggttacccgggggtttttaccgggggaaaccccgggggggtttaaacccgtaaggggtttaaaccggggttaaccgggtttaacccggtaaacgggttaccggttacggggtaaccggttaccggttaacggacccgttaaaccgttaacgttaccggttaaccgtttccgttaacccggttccgtttacccgtaccccggttaccg

SEQ ID NO: 284755 - DNA, 622 bp, Homo sapiens
  misc_feature: GYAE6OF02JXFJZ.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaattacgcctggttcagcagagcctgccaggctccaggctcctcatgtatgatgcactccagcggaccaccggcactcccagtccaggttcagtcggcacggcggtacgtgggacaggtacctcactcacaccatccgagaccacgtcctagacgtcagtaacgttatttgtacgttagttttacgttacgttcgttacgagtccgagggtccggggtaactaacgttccgggcccgttcgtccggttaccgggttcggggaccggggggtacgtaacggggtacggtaacgttaccgtaacggtacgttacgggtcggtacgtacgtaccgtaccgtacgttacgttcgtaccgtttacgtcgttacccgtccggtacc

SEQ ID NO: 284756 - DNA, 773 bp, Homo sapiens
  misc_feature: GYAE6OF02FG7IR.14.57.F02.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactccaccctgtctttgtcctccaggggaaanagccaccctctcctgcagggccaggtcagagtgtcaacaccaacttagccttggttcagcagaagcctggccaggcctcccgaggcctccctnattgtatgatgcactcccgacgacgggcccacggcacgtaccccgaggtccctaagggtttccaaggttcgggaccgtacgggtccgggggttcgtacgggggaacctaacgggtacctttacccacgttacccgttaccaacccgtagtaccaacgggcctaacggtacccgttaaggtacgtttacgtagggtaaacgtttagttttacgaccgtttaacggtttttaacgttacttacggttaccaggtaccgtaaggggtaccggggtactaacggtttccgggtaacccgtcgttacccggttaccggttttaccggggggaccggggggtaaacccgtaaggggttacggttaaccgggttaaccgaaaccgggtacgttacgggacgggttaccgtaccggaacccgtaaccgtacgttcgttaccggttccttaccgtaccgtttccccgttacccgtaccgttaaccg

SEQ ID NO: 284757 - DNA, 634 bp, Homo sapiens
  misc_feature: GYAE6OF02GRL6O.14.57.F02.1.454.CMB.1.raw
  modified_base (203)..(203): a, c, t, g, unknown or other
  misc_feature (203)..(203): n is a, c, g, or t
  modified_base (292)..(292): a, c, t, g, unknown or other
  misc_feature (292)..(292): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagatacccaccggagaaattgtgttgacacagtctccactcaccctgtctttgtctccgaggggaaangccaccctctcctgcagggccagtcagagtgtcaacaccaacttacgcctggtttcagcagaacgcctggccaggcctcccaggctccncatgtatgatgcactcccacgacgggccaccggcactcccgagcccgtaggttcaggtcggactaggccgggtcgtgggacaggtacttccacttcctacaccatcacgcacgcgtagacgtcgtagtaacgtattttacgacgttaagttttacttacgttgtacgtacgtacgtgggcgggtactaggttccgggccgtacttaccgtacgggtttaccggggcggggggaacctaaggggttacggtacgttaacgaaccggtacgttggacggtcgtacgtaccgaacgtacgttcgttaccgttcttccgtaccgttacccgttcccgtaccttacg

SEQ ID NO: 284758 - DNA, 630 bp, Homo sapiens
  misc_feature: GYAE6OF02HPK4W.14.57.F02.1.454.CMB.1.raw
  modified_base (368)..(368): a, c, t, g, unknown or other
  misc_feature (368)..(368): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagccttggttacagcagaagcctggccaggcctccccgaggcctcctcattgtatgatgcactcccacgacggcccaccggcactcccaggccctaggtcaggtcggacacggcgggtcgngggactagtacttcactctaccaccagtcacgcacgaccgtagacgtctagtaagtatttagtacttaagttttacttacgttgtacgagtccgagggtcgggacgtaagttcggtacccgtcgttcgtacccggtttcggggacccgggggtaaccgtacgggttcggtaacggttaccgaaaccggtaacgttacggtacgggtcgtacggccgacgtacgtacttacgttccttacgtaccttacccgttcccgtaccg

SEQ ID NO: 284759 - DNA, 687 bp, Homo sapiens
  misc_feature: GYAE6OF02INZMK.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttggaggtccgggggaggcttggtacgaggccggggggtccctgacactcctcctgtgcagcctcgaggatttctatttttagacgaatatcgccatgagcgtgggtcccgccaggcctccggaagggggaggggctgggaggtggtcctcgagcaatcgaggttggttactaggtggaacgtactagttcgaccgtccgtctccggtaggaacgggtcccggtttactccgtacttcccgtaccagaacgtaactaaccgttaccaaacgaaccacctttacttaacttttacctaactaaaagttcggaactacggtaccgttaaggaaaacgtacggaaacgtaccgaacgggtcgttagtttaacgtttttgtacggtaagtaaagtagttaaccggtaaggttcttaagtacgtaacgttaacccgttaaggtttcgggggtacgggttcctttacgacgttcggtaccggtaacggggg

SEQ ID NO: 284760 - DNA, 657 bp, Homo sapiens
  misc_feature: GYAE6OF02HG4E9.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacgacgggcccgggggggtccctggaccactcctcctgtgcagcctcgaggtattctagtttttagacgtaaattatcgccagtgagtcgtcgggtcccgaccgaggcctccggaaggggagggcgtaggaggttcgggtctcgacgacaatcgagttgttacgtaggtaggaacgttacagttcggacgtccgtcgtccggtaggaacgggtcccgttctccacgtctacgaagacgaactaacttaccgaagaacctacttacttactttactacaaagtcgaactacgactaagaacgaacgaacgacgacgggtcgttagtttagtttacgtagtagtaaagtacgttaacgtaagttactagtaggtaacttaacccgtagggtttacgggacgggttccctttagagttcggttacggtaccgggg

SEQ ID NO: 284761 - DNA, 599 bp, Homo sapiens
  misc_feature: GYAE6OF02G7NY7.14.57.F02.1.454.CMB.1.raw
  modified_base (478)..(478): a, c, t, g, unknown or other
  misc_feature (478)..(478): n is a, c, g, or t
  modified_base (518)..(518): a, c, t, g, unknown or other
  misc_feature (518)..(518): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccgggggggtccctgacactctcctgtgcagcctcaggtatttctatttttagacgtaatatgccatgagcgttgggtcccgccgaggcctccgaggggaaggggctgggaggttgggtctcgagcaatcgagtggttagtaggtaggaagtactattcggaccgccgtcgtccgtaggaacgggtccgtttctccactcctaccagacgacaacttaccaagaacactcttatttctactaatgacancctagaaagacgaagacgacgggtcgttagttagttttgngtagaagtatacgtaagtactatagtaacttacccgtaagtttacggggacgggttccgtttacgagttggtcgtacgggg

SEQ ID NO: 284762 - DNA, 655 bp, Homo sapiens
  misc_feature: GYAE6OF02ISJWX.14.57.F02.1.454.CMB.1.raw
  modified_base (301)..(301): a, c, t, g, unknown or other
  misc_feature (301)..(301): n is a, c, g, or t
  modified_base (419)..(419): a, c, t, g, unknown or other
  misc_feature (419)..(419): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcgagggccagtcgagagtcgtacaaccaccaacttagccttggtttcagacagaagcctggccaggcctcccaaggcctccctnactgtactgatcgcactacccacgacgggaccaccggcactcccacgaccgtaggttcgaacggtggccgacggaccggggtcgtacgggacctagtacttctactcctacacctacncagcgacgtctaaggactacgtagaagttagtttagagttaagtttactttacttaggtactagacgtacgggtcggggactaaggttccggaccgtcgtcgttacgggttccggggaccgggggtaaccgtaacgggttaggtacggttaacgaaaccggtaggttcggtcggcggtaccggtaccacgttaacgttcgttacgttaccgttccactttcccgtacccgtacccg

SEQ ID NO: 284763 - DNA, 587 bp, Homo sapiens
  misc_feature: GYAE6OF02GAZLU.14.57.F02.1.454.CMB.1.raw
  modified_base (539)..(539): a, c, t, g, unknown or other
  misc_feature (539)..(539): n is a, c, g, or t
tcagcgtctagtaccacgaccggtgctcgatttagctcgatatagttgggtttgggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttggtacgaggccgggggggtccctgacactctcctgtgcagccctcaggattctattttagcgtaatatgccatgagcgtcggtccgccaggctccgagggaggggcgtggagtgggtctcgaggcaatcgagtcggttactaggtaggtaagtactagttcgacgccgtctccgtggaacggtccgttctcctactcctcgagacgaacaattaccaaagaactactacttactttctactaaatcgacagacctagaaagacgaagacgacgggtcgttgttagttttgtagtagaagtatacgaagtctagtanaacgttacctaaggtttgggacggttccttagtacgttgtcgtacggg

SEQ ID NO: 284764 - DNA, 662 bp, Homo sapiens
  misc_feature: GYAE6OF02IWPY5.14.57.F02.1.454.CMB.1.raw
  modified_base (302)..(302): a, c, t, g, unknown or other
  misc_feature (302)..(302): n is a, c, g, or t
  modified_base (354)..(354): a, c, t, g, unknown or other
  misc_feature (354)..(354): n is a, c, g, or t
  modified_base (462)..(462): a, c, t, g, unknown or other
  misc_feature (462)..(462): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttggagtccgggggaggcttggtacaggccggggggtccctgacactctcctgtgcagcctcgaggtattctatttttaggacgtaatatcgaccagtgngcgtgggccgccgaggcctaccgaaggggaaggcgtgggagtgggtctacgngacaagtcgagtggttctagtggaagtactagttcggacgtccgtactccgtaggacgggtccgttctccgattccgtaccgagacacgtaaactccgaaacgaaacnccgttacttaagtttcttacgaaacgttcggaacaacgtccgtaaagaaacggaaccgaaagacccgacgggtaccgttgtttactttttaggacgtaggtaaactacgtaagaacgttcctaagttacgaacgttaaacccgttaggtttacgggaacggggttcctttaacgtacggttacggtcggttaaccggggg

SEQ ID NO: 284765 - DNA, 829 bp, Homo sapiens
  misc_feature: GYAE6OF02HWG2O.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccacctctcctgcagggccagtcagagtgtacaacaccaacttagccttggtttcagcagaagcctggccacggcctccgaggcctcctcatgtatgatgacacgtcccacgacgggcccaccggcacctacccgcgccgtaggttccaaggtcgggacgacgggtccggggtacgtacggggaactaccgtaaccgtttctaccgttccgtaaccgtaaccccgattaaccgaacgggtacccctacggtacccgttaacgtacggtaaccttaacgggaaaacggttttactttttacggtaccgtttaaacggttttttaacgtttaccggtttacgttaccgtaaacgggcgtaaccgggggtacggggtaacctaacgggttttccgggaccccggttaaccgtttcccgggtttaaccggggttttccgggggggaacccggggggggttaaccgttaacggggggttaaacggttaccgggtttaaaccgaaaccccgggtttagggttaacgggttccggtacggttaacccggtccgttaaaccgtacggttttccgttacggtttacccgttaaccgttacccgtttccccgtttacccccgggtatttaacccggg

SEQ ID NO: 284766 - DNA, 718 bp, Homo sapiens
  misc_feature: GYAE6OF02J1LO3.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcacgggccagtcagagtgtacaacaccaacttagcctggttcagcagaacgcctggaccacggcctcccgaggcctccctacattggtaactggtactgactactacccgacggaaccgggccccgaacccgggactaccttacccgacgtacccgtaggggtttaccacgggtcggccgtaacgggtaccgggggtccttacggggaaccgtaacgggttaacctttaccggaaccgtttcccttaacccgaacccgtacgtaccgaacgtcccgaacggtacccgtaagggtaaccgttcgtaaggtaaacgtttcgttttacgaccgttaagttttactacgttacgttacgagtcgaaggtcgggactaggtcgcctgtaccgtacggttcggggaccgggtaacagggtacgtacgttacgaacgtagttcgggtcgtactacgactaaccgttgtaccgttcgttacttaccggtactttacccgtcccgtaac

SEQ ID NO: 284767 - DNA, 728 bp, Homo sapiens
  misc_feature: GYAE6OF02JRJPN.14.57.F02.1.454.CMB.1.raw
  modified_base (325)..(325): a, c, t, g, unknown or other
  misc_feature (325)..(325): n is a, c, g, or t
  modified_base (620)..(620): a, c, t, g, unknown or other
  misc_feature (620)..(620): n is a, c, g, or t
tcagcgtctagtaccacgaccggtgctcgatttagctcgatatagttgggtttggggcgtgagagaggagcccagtcctgggatcttcaggtgttttcatttggtgatcaggactgaacagagagaactcaccatggagtttgggctgagttggctctttcttgtggctattttaaagatgtccagtgtgaggtgcagctgttggagtccgggggagcgttggtacgaggccggggggtccctggactactccgtcctgtgcagtcctcgaggtattctagtttttagacgtaatatcgaccagtgacgcgttcgggtcccgacncggcctccggaaggggaacggggtcctaggggaggtcgggtctacgacggtacctaagtccgaaggttcggttacgtagtggtaaacgtacgtattaccggacggtccgtcgtccggtagggaacgggtcccgttacgtccagtcctaccgaataccggtactaacgttaccgaaactaaccgtacttacttacgtttaacttacaacgttgaaacgtacgtaccttaagaaacgtaaccgaacgaccgtaacggggtactttacgttagttttacggtagtacgttaaaacggnttaaacggtaacgttcttaagtaccggttaaaccttaacccggttaaggtttaccgggggttaacggtacccttttaccggaacgtttcgggtacccggttaccgggg

SEQ ID NO: 284768 - DNA, 788 bp, Homo sapiens
  misc_feature: GYAE6OF02I7TG5.14.57.F02.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggcttaatttaaaagatgtccagtgtgaggtgcngtctggttgggacggtccgggggaggtcttaggtacgacgggtccgggggggtccctgactactcctcctgtgcacgcctacaggntttcttattttaggcgtaaactacgttcgacctagtaggtacgtccgttcggggtcccgccgacggaccgtaccgggagggggaacggggtcgtaggggtacggttcggggtcctaggacgacctaagtcgtacggtttcggttacgttaaggtagggtaaacttacgtaacgttccgggaaccgttcccggttacccgtcccggtaggggtaacccggggttcccgtttaccctaccgtactacccgtccgaaggaaccgtaaccttaccgttaaccgaaacgtaacctacttacgtttaactttcctaacgtaagtccggtaacacggtacgtaaaggaaaacgacgaaacggtacgtacggggtcgtttagttttacgttttaggtagttaaggaaagtagttaacggtaacgttggtaattaccgggtaacctaaccgggtttaagggtttcggggtaccggtttcctttaggacggtttcgggtacgggtaacccggggg

SEQ ID NO: 284769 - DNA, 616 bp, Homo sapiens
  misc_feature: GYAE6OF02GGY0I.14.57.F02.1.454.CMB.1.raw
  modified_base (423)..(423): a, c, t, g, unknown or other
  misc_feature (423)..(423): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagccttggtttcagcagaacgcctggccaggcctcccgaggcctcctcatgtatgatgcatccccacgcgggcccaccggcactcccgagcccaggttcagtcggcaggcgggtcgtgggacaggtacttcgactcctacacctatcacgcacgcctagtacgtctaggtaaagttnttttgacgttagttttactagtcggttacagcgtagggcgggtactaaggttcggcccgtgttccgtaccggtttcgggggaccggggtaacctaaggggttcggtaacgttaccgaaacggtacgtggtacggctacgtaccaacgttacgttcgtcgtttccttaccgtacgttccccttacccggctacg

SEQ ID NO: 284770 - DNA, 811 bp, Homo sapiens
  misc_feature: GYAE6OF02HX1DA.14.57.F02.1.454.CMB.1.raw
  modified_base (204)..(204): a, c, t, g, unknown or other
  misc_feature (204)..(204): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggcctcccagataccaccggagaaattgtgttgacacagtctccactcaccctgtcctttgtctccaggggaaangccaccctctcctagccacgggccaaggtcagagtcgtacaaacaccaacttacgccgttggtttacagccaaggaacgtcccgtaggccctaacgggccctaccccgaggtccttaccctcaagtttcggtattgagttcgtaccaccgtccccgtaacggacggggcccctaaccgggccacgtaccccacgggtcctaggggttaccacggttaggggaccgtaggggtccgggtacgtacggggtaccaaagggtccctttacgacctccgtacaaccctaattccgaacgcccgaacggtccccgtaaagggtacttcggtaacgtaagggtttacctttttaaggtccgtttaaacgtttttaacgttaacctttggttaccgaacgggtaccgtaacgggggtacggggtaacttaacggggtttcggcccttaaccggtttacccgtaccgggttttccgggggaaccgggggttaaccggaaaggggtttacgggtaacgggtttaacctaacgggtaacttcgggttcggccgtaacgtacccgaaccttagttaccgttacgtcctttacggtaacctttccccggtaccctaccg

SEQ ID NO: 284771 - DNA, 743 bp, Homo sapiens
  misc_feature: GYAE6OF02GFKU9.14.57.F02.1.454.CMB.1.raw
tcagcgtctagtaccacgaccggtgctcgatttagctcgatatagttgggtttggggggggaactgctccagttaggacccgagacgggaaccattggaagccccagctcagcttctcttcctcctgctactctggctcccagagtaccaccgggagaaattggttcgttgacacagtctccaactcaccctgtctttgtctccaggggaagagccacctctccgtgcagggccagtcgagagtgtcaacaccaacgttagccttggtttcagtcagtaacgccgtaggccacggctcccgacggcttccgtcacgtgtactcgagtcggcacgtcccgacgacgggccctaaccggactaactcccgaacgcccgtaagggttacgaaggtcggaccgtacgggtccggggtaccgtacggggaacgaacggtaccttccgtaacctcctaccacccactacgacgactaacgcccgtaaaggcgttacgtaggtaaacgttactttagactaacgttttaacttaccgttaggtaacgtacggaccgtaacgggccggggttaacttaaggtttccgggaccgttaccttccgttaccgggtttcgggggacccgggggtaacggtaagggtcggtaacgtacgtaaacggacggttcgggtacggccgttacggtaccctaacgttacgttcgttacggtttccgtttacccggacgtttcccggttacccacgtttccg

SEQ ID NO: 284772 - DNA, 716 bp, Homo sapiens
  misc_feature: GYAE6OF02F8K9K.14.57.F02.1.454.CMB.1.raw
tcagcgtctagtaccacgaccggtgctcgatttagctcgatatagttgggtttgggggagggaactgctcagttaggacccagagggaaccatggaagccccagctcagcttctcttcctcctgctactctggctcccagataccaccggagaaattgtgttgacacagtctccactcaccctgtctttgtctaccaggggaaagacgccaccctctcctgaccgaggccagtcagagtgtacaacaccaacttagacctggtttcagtacgagaagcctcggaccagggctaccccgaaggcctaccctcacgtgttactggatcggactacgtcccgaacgtaccgggacccgaccgggcctaccgtccccacggtacccgtaacgggttacgaggtccggacgacgggtaccggggttcggtcggggaactaacggtaccgtttaaccgaccgttaccctccgaaccctacgttaccgacggcccgtaacgtacccggtaagacggtacccgtagggtaaagttacgtttttacgacgttaagttttacgttacttgtcctaaggacagggcgggtactaggttcgaccgtcgtcgttaacggttccggggacgggggtaacctagggtcggtaagttccgaaacgtacgtacggtcgggcgtacggactacccgattcgtacggttctacgtccgttacccgtcccgtaccg

SEQ ID NO: 284773 - DNA, 740 bp, Homo sapiens
  misc_feature: GYAE6OF02I19N9.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattctattttagcgtaatatgccatgagctcgggtcccgccgaggtctccgaggggaaggggctagggagtgggtctcgagcaatcgaggtggttactagtggtaatacggggattccggacgtccgtctccggtaggaacgggtcccggtttactccctagttccctacgaagacgacctaaacgttacccaaaggtaacctaaccttaccgttaacttttacctttaaccgtaaaagttcggtaaacctacggtacccttaaggaaaaacggtaaccggaaacggaaccgtaaccgggggttaccgtttaggtttaacgttttttgggtaacgtttaaggtaaaacggttacttaaacggtaacggttacgttaaacgttcggtaaaccttaaccccggttaaaggtttttcgggggaaccgggggtttacccttttacggtaacggtttggttaccgggttaaccgggggg

SEQ ID NO: 284774 - DNA, 567 bp, Homo sapiens
  misc_feature: GYAE6OF02G6VV4.14.57.F02.1.454.CMB.1.raw
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgtggagtcgggggagctggtacaggccggggggtccctgacactctcctgtgcagcctcaggattcatttttagcgaatatgccatgagctgggtccgccaggctccaggggaagggctggagtgggtctnagcaatcnggtggttcagtggaagtacattcgacgccgtctccgtggaacggccggtttcnccatctccaagagacaattccaagaacactcttatttctacaaatggacagccttaggaaacgacgaagacgacgggtacgtagttattttgtagttagaaagtatacggaagttctatagaacttaccctaagtttcggggagggttccctttagacgttcggtgtaccggggg

SEQ ID NO: 284775 - DNA, 629 bp, Homo sapiens
  misc_feature: GYAE6OF02JOFJG.14.57.F02.1.454.CMB.1.raw
  modified_base (254)..(254): a, c, t, g, unknown or other
  misc_feature (254)..(254): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (389)..(389): a, c, t, g, unknown or other
  misc_feature (389)..(389): n is a, c, g, or t
tcagcgtctagtaccacgaccggtgctcgatttagctcgatatagttgggtttgggcacggtgggcatgtgtgagttttgtcacaagatttgggctcaactctcttgtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaacgntcagtccctagttcgtcgtataacaaattcgacacagagtattccaagacagactcacgattaccgnggaacaatcacgccanacgcctacatggattgagtcgcctgagtagtttcgaccgacgacggtccttntacttcgtgtcggacgaaggtacgaacgtccgtactaacggaataaactgtaccgtccttcgtacccttacgtcgtaaccgtacggtacgggaccgtaacgggtaccctaggtccgtaccctaccgttcctcgaaccgtcccgaccgaccgtacgggccctacggttcccggtcccttaccccgtcgaccctacccgtacccgttaccgaacggaccgtactacccggtggtacccgggg

SEQ ID NO: 284776 - DNA, 624 bp, Homo sapiens
  misc_feature: GYAE6OF02F59R2.14.57.F02.1.454.CMB.1.raw
  modified_base (290)..(290): a, c, t, g, unknown or other
  misc_feature (290)..(290): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctccncatgtatgatgcatcccacagggccacggcactcccagccaggttcagtggcaggcggtcngggacagacttcactcncaccatcagcacgcctagagtctagaagtattttgactagtttattacgttgtacagccgtaggccgggataacgttcgggaccgtcgttaccgtaccggtttccggggaccgggggggtaacccgaaaggggttacgggtaacggttaaccgaaaccggttaacggtacgggtacgggtaccgttacggaccctaaccgtacgttacgttcggttacccgtttaccgtaaccgtttcccgttacccccgtacccg

SEQ ID NO: 284777 - DNA, 658 bp, Homo sapiens
  misc_feature: GYAE6OF02G7PAA.14.57.F02.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (316)..(316): a, c, t, g, unknown or other
  misc_feature (316)..(316): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagcgtctagtaccacgaccggtgctcgatttagctcgatatagttggggtttggggggaacgtgctcagttaggacccagagggaaccatggaagccccagctcagcttctcttcctcctgctactctggctcccagataccaccggagaattgtgttgacacagtctccactcaccctgtctttgtcctccgaaggggaaanacgccacccttcncctgcacgggccagtcagaggtgacaacactaactagcctggttcagcagaacgcctggccaggtcnccgagctcctnatgtatgaatgcactccgancgggccncggnacgtcccagccaggtcagcgcnggcggtcgnggaccagcttacgactcgtacacagcctagcgataccgtaggacgtctagtaaagttcgttgacggttaatttaacgttactacgtacgtacggtaccgaggggaccgggtacaacgggtttcggccccggtacttacccgggtttacgggtttaccgggggacccgggggtaacgggtaaaaccggttaggggaccgtttaaacggaaaaccgtttaggacgggttacgggtctcggtaaccaccccgttagttaccttcggttaccgtttacaccgtttcccggtaccccttacaacg

SEQ ID NO: 284778 - DNA, 713 bp, Homo sapiens
  misc_feature: GYAE6OF02IYXJS.14.57.F02.1.454.CMB.1.raw
  modified_base (332)..(332): a, c, t, g, unknown or other
  misc_feature (332)..(332): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (371)..(371): a, c, t, g, unknown or other
  misc_feature (371)..(371): n is a, c, g, or t
  modified_base (390)..(390): a, c, t, g, unknown or other
  misc_feature (390)..(390): n is a, c, g, or t
tcagcgtctagtaccacgaccggtgctcgatttagctcgatatagttgggtttggggctgagagaggagcccagtcctgggatcttcaggtgtttttcatttggtgatcaggactgaacagagagaactcaccatggagtttggctgagttggctctttctgtggctattttaaaagatgtccagtgtgaggtgcagctgttggagtccgggggagcttggtacaggccggggggtccctgacacgtctcctgtgcagcctcaggattcatttttagcgaaatatgccatgagctggtcccgcagctaccgagggaaggctggagtgggctnagnaagtcagtgtctagngaagtactctcgacgccgtcncgtacggaaggtcccgttntccgagttccaccgtaagcgtaaacgtaaacttcccgaaaacgtaaaccgtaaccttctttaaacgttttacttaacctaaaaacggtttcggaaacccacggtacccgttaaaggaaaacgggaaaccggaaaaggtacccgtaaacccggggtacgtttaaccgggttttaagtttttaaggttaagtaagtaaaaaggttaccgttaaccgtaaaagttaccctttaagtaaccgtaaaccgtttaaaccccgttaaggttttacggggggaaccgggtttcccttttaacgacgtttacgggttccggtaacccggggg

SEQ ID NO: 284779 - DNA, 669 bp, Homo sapiens
  misc_feature: GYAE6OF02ISXEG.14.57.F02.1.454.CMB.1.raw
  modified_base (293)..(293): a, c, t, g, unknown or other
  misc_feature (293)..(293): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcagagtgtcaacaccaacttagccttggttcagcagaacgcctggccaggcctcccgagcctccncatgtatgatgcactcccacgacggggccaccggcacgtccccagcctaggttccaggtcggcgaggccgggtcgtcgggactagtaccttcactctaccacctatccgaacgcacgaccgtaggtacgtcgtagtaagttattttcgacgttagttttaacttacgttacgtactaggaccgtacgggtcggggacttaacggttcgggtcccgtaccgttccgttaccggttccgggggacccggggggtaacccgtaaggggttacggtaacgttaaccgaaaccggtacgttgggtacggccgttacggacctaaccgtacgttccgttacgttcctttaccgtacccgtttcccgttccccgtaccgtacg

SEQ ID NO: 284780 - DNA, 809 bp, Homo sapiens
  misc_feature: GYAE6OF02GNHXI.14.57.F02.1.454.CMB.1.raw
  modified_base (179)..(179): a, c, t, g, unknown or other
  misc_feature (179)..(179): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagntgtccagtgtgaggtgcagctgttgggacggtccgggggagtcgttggtacgacgggcccggggggtcctgaccacttcctcctgtcgcacgtcctcgaaggtatttacttatttttacgacgtaacttagtcgaccgtatggacgtccggtcggggttccccgaccgacggtcccgtaccgggaagggggaacggggtcgtaggggtacgggttcgggtcctaccggacgtaccgtaagttccggtaggtttcggttacgttaacgggtagggtaaacgttaccgtacgtttaccggaccccggtccccgttccggttaccccgggtacgggtaaaccggggttccccggttttaccgtacccgtacgttcccttaccgaacggaacgtaacctaaacgttaaccaaaccgaacccttaccgttacttaaccttttactaacgtaaacgtcggaacctacggtaacctaaggaaacggtaacggaaacgtaccgggtacgggttgtttagtttacgttttggagttaacgaagtacgttaaccggtagttacgttaagtcggttaaccttaaccggtttaaggttacgggtaccgggttacccttagtacgttcggtacggtaccgggg

SEQ ID NO: 284781 - DNA, 615 bp, Homo sapiens
  misc_feature: GYAE6OF02IJ683.14.57.F02.1.454.CMB.1.raw
  modified_base (549)..(549): a, c, t, g, unknown or other
  misc_feature (549)..(549): n is a, c, g, or t
tcagcgtctagtaccacgaccggtgctcgatttagctcgatatagttgggtttgggggtacgatttgatgttacctgatgcttagaggccttttcctggaagcagggcatttgttgcttcagcaccgtagtgcctcgtcatcacgcctcagccttgatttttccggattttgcctggaaaaccagcctacacgcttaaaccgggacaaccgtcgcccggcaacatagccttctccgtcccccttgcagtaacaccaagtacaggaatattaacctgtttcccatcgactacgcctttcggcctcgccttagggtcgactcaccctcgccccgtattaacgttggactacggtaacccttggtctttccggcgagcggggcttcgttccacccgtcttttactccgtttacttatgtcagtctattcgctactttctgactacctcagcatgacctcacagcacactcacagtccttaacacgaacctcctacccctacccaaacaaccgcacttaacgccgtacgctcgacccgctacgcttcgggacnctagttcggttttaccgccccgtttatccttccgttccccgccttacttctcgtacgtacctacgg

SEQ ID NO: 284782 - DNA, 674 bp, Homo sapiens
  misc_feature: GYAE6OF02HCJGO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttgggagtccgggggagcttggtacaggccggggggtccctgacactctcctgtgcacgcctcgaggacttcatttttagcgaatatcgccatgagcgtcgggtccgccaggcctccgaggggaagggctgggaggtgggtctcgaggcaaagtcgtagttggttctaaggtgggaagttactagttccgacggtcccgtcgtcccggtaggaacgggtcccgtttctacccgaattcctcccgtaaggaacgaacctaactttacccaaaaggtaaccctaactttaccttaagtttttccttaaccgaaagttcggacaacggtccctaaggtaaacgaacgaaacgaccgtaacggggtcgttagtttaacgtttttagtacgttagaaagttacgtaacgaagtcttaagtcgtaactaacccgttaagttcggggacgggttcctttagtacgttgtcgttacggggg

SEQ ID NO: 284783 - DNA, 798 bp, Homo sapiens
  misc_feature: GYAE6OF02ICI6P.14.57.F02.1.454.CMB.1.raw
  modified_base (178)..(178): a, c, t, g, unknown or other
  misc_feature (178)..(178): n is a, c, g, or t
  modified_base (334)..(334): a, c, t, g, unknown or other
  misc_feature (334)..(334): n is a, c, g, or t
  modified_base (782)..(782): a, c, t, g, unknown or other
  misc_feature (782)..(782): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggctattttaaaagntgtccagtgtggaggtgcgagcgtggttgggacggtccgggggaggtcgttggtacgagggcccggggggtccctggacacgtctccgtgttggcacggtcctcgacggtaattcgttacgtttttaacgcgtaaatcgttcggacctagttcggnggtccgttcgggtacccacccgtacggtacccgtacggtaacggggaacggggtcgtacgggtacggttcgggtaccgtcgtaccggtaacgtaacgtcgtaaggttcgtttacgtacggtaacggtaaacgtaaccgttaacggttaccggaaccgttccccgttccgttacccgggtaacgggtaaaccgggggttccccggtttaccgtacccggtaacgttccgtaacccggtaaaggtaacccggtaaaaccgttacgttaaacccgaaaacgttaacccgtccttaacttttaccgtttaaccgttacgtaaagtaccggtaatacgtacccgttaaaggaaacgtaacgaacgcggtacgggtcgttagttagtttcgagtaagtaacgagtaacgagttctagtacgtacgtactaaggttcgggaccggttcttaacgnttaccggtggtaccgg

SEQ ID NO: 284784 - DNA, 663 bp, Homo sapiens
  misc_feature: GYAE6OF02IFFOQ.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctccctgataccaccggagaaattgtgttgacacagtctccactcaccctgttctttgtctccgaggggaagacgcccaccctctcctgcgacgggccagtcagagtcgtaccaacaacctaacttacgccttggtttcaggaccaagaacgtccgtcggaccacgggcctacccgaggcctccgtcacttgtatgactcgacactcccgacgaccgggcccaccggcacctcccgacggccgtacggtaccgaggtcggcgacggtcgggtcgtacgggacgacgtactctacctcaccaaccagtccagccacgtacagtacgtcgtagtaagttatttcgacgttatttagtactacgtcacggcgacgggtcgggactaaggtccggccgtacgttaccggtacgggtttccgggggaccggggtaaccgtaggggttagaaccgttacgaaacgggacgttgggtaccggcgtaccgaccgtaacctgtcgttcgtcgttaccgaccgttcccgttaccccgataccg

SEQ ID NO: 284785 - DNA, 589 bp, Homo sapiens
  misc_feature: GYAE6OF02F91GO.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccgaggctcctcatgtatgatgcactcccacgacgggcccaccggcactcccagccaggttcagtcggcaggcgggtctgggacagacttcactctacacctatcgagtacacgcctagacgtctagaagtatttgactagtttactacgtagtacagtcgacggcgggtactaagttcggccgtacgtcgttacggtttccggggaccggggtaaccgtaagggtcggtaacgttaccgaaacggtacgttggccggtcgacgtcctacctagttcgttcgtccttacgtacttcccgttcccgcctacg

SEQ ID NO: 284786 - DNA, 662 bp, Homo sapiens
  misc_feature: GYAE6OF02GGZ8K.14.57.F02.1.454.CMB.1.raw
tcagcgtctagtaccacgaccggtgctcgatttagctcgatatagttgggtttggggggaactgctcagttaggacccagagggaaccatcggaagccccagctcagcttctcttcctcctgctactctggctcccagatacccaccggagaaacttgtgttcgacacagtctccactcaccctgtcctttgtcctccaggggaaacagccaccctctacctgccagggccagtcagatgtcaacaccaacttagcctggtttaccaggcaggacgcctggccagcctccaggctcctactatgtactgatcgctatcccgacgacgggccaccggcactcccgagcccgtaggttccgagtcggcacggtccggggttctacggggacaacggtacctttacggaccttaccgtccaaacccgttcgtaccgaccggtaccgacggtacctaacgggttacgttcgtaaggtaacgttacgttttacgaccgttaaagtttacgtttacgtacggttacacgtagaccggtccgggaactaacggttcgcccgtgtccgtacggttccgggacggggtaccgaggtggtaacgttaccgaagtacgtcggacgtcgtgacctacgacttcgtacgttccttagtctccgtcccacgtaccg

SEQ ID NO: 284787 - DNA, 746 bp, Homo sapiens
  misc_feature: GYAE6OF02GFBDU.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttattttaaaagatgtccagtgtgaggtgcagctggttgggaggtccgggggaggcgttggtacaggccgggggggtccctgacactctcctgtgcagcctcaggtattctatttttagcgtaatatgccatggagtcgtcgggtccgccgaggcctccgaggggaaggggctgggagtgggtctcgagacaatcgaggttggttacgtaggtagggtaaacgtactacgttcggaaccggtcccgtccgtccggtcggtaaacggggtcccggtttcctccgacgttcctaccgaaggaacgaacctaaacttacccgaaacgaaacctaccttacctttaacgtttttccttaaccgtaaaacgttcgggaacctacggtacccgtaaggtaaaacggaacggaaacggaccggtaaccggggtacgtttaggtttaacgttttttcggtaggttaaggtaaagtacgtaacggtaaacggttacttaaggttacgaaaccgttaacccgttaaaggttttacggggggacgggtttacccgttttacgacggtttacggtcggttaacccgggggg

SEQ ID NO: 284788 - DNA, 872 bp, Homo sapiens
  misc_feature: GYAE6OF02HFP60.14.57.F02.1.454.CMB.1.raw
  modified_base (262)..(262): a, c, t, g, unknown or other
  misc_feature (262)..(262): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttggaggtccgggggagcgttggtacgagggccgggggggtccctgacacctctcctggngcagcctgaggtattctattttagacgtaatagtgccaagtgacgcgtacgggtcccgcgacggcctaccggaaggggaacggggctggggtaggtcggggtcttacgacgtacaacgttacgtagggttcggttacgttaggtagggtaaacgtaacgtacgttaccgaaccggttcccggtacgttcccggttaagggtaaccgggggttccccggttttacctcccgtaacgttacccgtacccggtaaaccgaacggtaaaccgtaaaactttacccgaaaaacggtaaacctaaacccgtaaccgttaacgttaaaccgtttacgtaccggtaaccgtaacggtaacgttaccgaaacccgtaaccggtacccggtaacgggtaaaccgggaaccggacccgggaaaaccgggtaacccgggtaaacccggttcccgggttaaagtttaaaccggtttaccgtacggtttaccgggaaaccggttaaaaccccggtaccgttaaaaccgggtttaaggtttttttaccgggaaggttttttaacgggtttaaagttttaaacccggttttaacccggttttaccgttaaccggttttaaccgggg

SEQ ID NO: 284789 - DNA, 727 bp, Homo sapiens
  misc_feature: GYAE6OF02IVB4T.14.57.F02.1.454.CMB.1.raw
  modified_base (228)..(228): a, c, t, g, unknown or other
  misc_feature (228)..(228): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgttggagtccgggggagcttggtacgnggccggggggtccctgacactctcctgtgcagcctcaggtattctaatttttagcgtaaatatgccaatgagtcgtgggtcccgccaggctccgaagggaaggggcctgggacgtcgggtctcgagcaatcgaggtggtttcaaggtggaagtactattccggaccgtaccgttctaccggtagtaacgggggcccgtttctcccaagtccctaccgtaagtaacgtaacctaaacttacccgaaaacgtaaaccgaaccttaccttaacttttacctttaaccgtaaaaacttccgggtaaactaacgtacccgttaagaaaacggaaccgtaaacgtaacgaccggggtacgttagtttacggtttttaggtagttaacggtaaaaggtacgttaaaccggtaaaggttaaccgttaattacggtaaacttaaccccggtaaagtttacgggggtacggggtacccttttacggaacgtttcgggtactacgggggg

SEQ ID NO: 284790 - DNA, 638 bp, Homo sapiens
  misc_feature: GYAE6OF02H7SH6.14.57.F02.1.454.CMB.1.raw
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (441)..(441): a, c, t, g, unknown or other
  misc_feature (441)..(441): n is a, c, g, or t
  modified_base (458)..(458): a, c, t, g, unknown or other
  misc_feature (458)..(458): n is a, c, g, or t
  modified_base (497)..(497): a, c, t, g, unknown or other
  misc_feature (497)..(497): n is a, c, g, or t
  modified_base (584)..(584): a, c, t, g, unknown or other
  misc_feature (584)..(584): n is a, c, g, or t
tcagcgtctagtaccacgaccggtgctcgatttagctcgatatagttgggtttgggggggaactgctcagttaggacccagagggaaccatggaagcccagctcagcttctcttcctcctgctactctggctccagataccaccggagaaattgtgttgacacagtccccccctcactccaccctgttctttcgtctaccgaaggggaaagacgtccacctctcctgcgacgggcctagtcgagagtacgtacaaaccacctaaacgttacgccgttggtttcagccgaaggaacgcctcgggccaggggtccctaccngggcctccgttcagttcgtancgattgccactcccacgacgggcctaccggcactcccagcccgtaggttcaggtcggacgtaggtcgggtacgtcgggacagtctcgactccgtcaacctnccgagcacacgtaggtntcttaggaatgtttacgacttagttaagttactgttacngacgcggtcgggtactaggtgcccgtgtccgtacgggttcgggacggggaacgtacgggtagtacgttaacgaacgtacggttcggnggtcgtcgaccgaactgtcgtattccctagttccgtacgttccctacgttaccg

SEQ ID NO: 284791 - DNA, 750 bp, Homo sapiens
  misc_feature: GYAE6OF02H4752.14.57.F02.1.454.CMB.1.raw
  modified_base (714)..(714): a, c, t, g, unknown or other
  misc_feature (714)..(714): n is a, c, g, or t
tcagcgtctagtaccacgaccggtgctcgattttagctcgatatagttgggtttggggaggaactgctcagttaggacccagagggaaccatggaagccccagctcagcttctcttcctcctgctactctggctcccagataccaccggagaaattgtgttgacacagtctcactcaccctgtctttgtctccgagggaaagagcccaccctctcctgacgagggccaggtcagtagtcgtacaacaaccaacttagccttggtttacagcaagaacgtccgtggaccagggccctacccgaggtccttccgacattacggtaactggtaattccggactaccgttcccccaacggaccggggaccccacccggggtccaaccgttcccgacggtaccgtacggttaccggaagttcgggaccgacgggtccggggtaccgttacggggaacgtacgtaaccgtttccgtaaccctcgtttacccgacccgaacttacccggaagccgtaaccgtacccgttacgggtaactaccggtaaggtaaacgttcgttttacggactttagtttaaccgttttagcgtttacgacgtccggtacgggtaccgggtagttaacgttcggaccggtcctcggtaccgggtttaccggggacgggtacggtaggtacggtacgttaacgaccgtacggtggttccgagttccgaccgtacngttacttcggttacctagtaccttccgtcccgtacg

SEQ ID NO: 284792 - DNA, 938 bp, Homo sapiens
  misc_feature: GYAE6OF02ISUKA.14.57.F02.1.454.CMB.1.raw
  modified_base (146)..(146): a, c, t, g, unknown or other
  misc_feature (146)..(146): n is a, c, g, or t
  modified_base (194)..(194): a, c, t, g, unknown or other
  misc_feature (194)..(194): n is a, c, g, or t
  modified_base (403)..(403): a, c, t, g, unknown or other
  misc_feature (403)..(403): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccagtggtaggttggngtgtaggttcggtcttctttcgttggtggtactttaaattttaaaagngttcgtaccgtaggttggtaggtaggtcgacgacggtcgtttaggttacgggtacggggtccgggggaggttcggtttacgggtacggaccggggggtccccggggggttccctacggaacctaccgttcccgttccgttcggtcgaccgtacgttccgtacggaggttactttacgtttaagtttacggacgtaatacgtcgactagngacgtcgtccgggtccgcggacgtccgtacggaaggggtacggtcgtagggtacggttcgggttcacggagtaccgtaacgttcggtaggtttacggttaagttaacgggtaagggttaaaccgttacgttacggttacccggggaccggtaaccggggttaacggggaacccgggtccgttaaccttacccgaaccgttaccttcccgtaaccggaacgaacgttaaacccttaacctaaccccaaaacgttaacgttaggtttaccggtttagttaaccgtttcgaacggtaaacttaaacggtacgtaacgtaccggttacgtagggtaaaccggacccggtaaccgggaacggtaaccggtacgtacggtttaggttaaccgttaacgtttacggttagttaacccggtacgtaaaggggtaacgggttaacggggggttaggggggtttaacggggggttagtttaaacccggtccggtttaaacgggtaacgggtttttacggtaacggttttacgggtttaaaccggg

SEQ ID NO: 284793 - DNA, 681 bp, Homo sapiens
  misc_feature: GYAE6OF02IPG4V.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctcttttcttgtggctaattttaaaagatgtccagtgtgaggtgcagctgttgggaggtccggggggaggcgtttggtacgacgggcccgggggggtcccctggaccacctcctcctgtcgcagcctcaggtattctattttagacgtaatagtcgccatgagcgttcgggtcccgccgaggcctccggaaggggaacggggtcgtagggaggtcgggtctcgacgactaatcgaggttggtttcgtaggtggtaaagtacgtagttaccggaccggtacccgttccgtccggtaggaacggggtcccggtttctaccgtatccctacgacgaacgaactaaattaccgaaagaacctactacttatttacctaacaaacgtggaacacgtaccgtaagaaaacgacgaaacgacgacggtcgttacgtttaattttcgtagtagaaagtacgtaacggtaagtactaatacgtaactaacccgttaaggtttcgggacgggttccttacgacgttcgacggtacggg

SEQ ID NO: 284794 - DNA, 791 bp, Homo sapiens
  misc_feature: GYAE6OF02IGWA7.14.57.F02.1.454.CMB.1.raw
tcagcgtctagtaccacgaccggtgctcgattttagctcgatatagttgggtttggggggggaactgctcagttaggacccagagggaaccatggaagccccagctcagcttctcttcctcctgctactctggctcccagataccaccggagaaattgtgttgacacagtctcactcaccctgtctttgtctcgagggaagagccaccctctcctgcgagggccagtcagagtgtacaacacctaacttacgtccttggtttcagcaagaagccgtaggccagggcctacccgacggtcctccgtcattgtatagatgccacgtacccgacgaccggggcccgtaaccgggacctacgaccccgaggacccgtagggtttaccagggtcggcgacgggtcgggggtctacggggactacggtaaccgtttcaccttcgtaccgtaacctctacgacgtcccgaacgtaccgtttaaggtaacggttcgtaagttaaaggttaacgtttttacggtacgtttaagttttaacgttttacggttacgttacgtacgggtacgtacgggccgggggtaacgtaacggtttcggggcccgtaccgttaccggttaaccgggtttccgggggtaacccgggggggtaaacgttaaccgggggttaacggttaaccggggtttaaacggtaaaccgggttacggtacgggtttacgggtcgttccggaacccgttaaccgtacgtttacgtcggtttaccgttaccgtttaccgttcccgttaccccggccttacgg

SEQ ID NO: 284795 - DNA, 749 bp, Homo sapiens
  misc_feature: GYAE6OF02JWG41.14.57.F02.1.454.CMB.1.raw
  modified_base (179)..(179): a, c, t, g, unknown or other
  misc_feature (179)..(179): n is a, c, g, or t
  modified_base (681)..(681): a, c, t, g, unknown or other
  misc_feature (681)..(681): n is a, c, g, or t
tcagcgtctagtaccacgaccggtgctcgatttagctcgatatagttgggtttggggctggagagaggagcccagtcctgggatcttcaggtgttttcatttggtgatcaggactgaacagagagaactcaccgatggagtttgggctgagttggctcttcttcgtggctatttaaagntgtccagtgtgaggtgcagctgttggaggtccgggggaggcgttggtacgaggtccgggggggtcctgacacgtctccgtgtgacgagcctcgaggtattctattttagacgtaatagtcgacctagtagacgtcgtccgggtcccgaccgacggtccgtaccggaggggaaggggccgtaggggagggttcgggtcttacggagtaacgtaagtacgtaggttcggttacgttaaggggtagtaaacgttaaccgtagtttaccggaacccggttacccgtcggttacccgggtagggtaaaccgggggttcccgtttacgtcccgtaactttcccgaacccggaagtaacggtaacctaactttaaccgaaacgttaacctaccttcttaactttccgtaataaacgtgacgtacgtaccgaaagtaaacgaaagtaccgacgaccgggttagtttcgttagttttaggacgtaagtaactacgtaacggtacgtgttanacgtaacttaccgggttaaggtttacggggacggtttacccttagtacggttcggtaggtaacccggg

SEQ ID NO: 284796 - DNA, 720 bp, Homo sapiens
  misc_feature: GYAE6OF02H0IYV.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcagggccagtcagagtgtcaacaccaacttacgccttggtttcagcagaacgcctggccaggcctcccgaggcctcctcatgtatgatgacacgtcccacgcgggccaccggcactcccgagccgtacggttcgaggtcggcgacggtcgggtcgtgggtacacgtacttacacttctaccacctacgtaccagcctacggtacctaggtacgtcgtaagtaacggttatttttaggacttaagttttacgtttacgttcgttacgtacgggcgtaacgggtacggggtaccgttaacgggttcgggacccgtacgtttacccggttaaccggggtttccggggggacccgggggggtaacccgtaagggggtacgggttaaacggttaaccggtaaacggtaaccgggttcggtacgggtaccgtcggtaacccgtaaccgttaccgttaccgttaccgtttcctttaccgtacgtttacccccttccccggtaccttccgg

SEQ ID NO: 284797 - DNA, 806 bp, Homo sapiens
  misc_feature: GYAE6OF02FQJ35.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctcactcaccctgtctttgtctccgaggggaaagagccaccctctcctgcagggccagtcagagtgtcaacaccaacttagcctggttcagcagagcctggccaggcctcccgaggcctcctcagtgtatgagtgccactccccgacgacgggcccaccggcaccgtaccccgaaggcccgtaagggtttccaagggtcgggaccgacgggttccgggggttacgtagggggtaaccgaacgtaacccgtttaccgacccttacccgtaccaacccctaagttaccgaaccggacctaaccgggtacccgttaaaggtaccggtttcgtaaacgggttaaacggtttacgttttccgggtaaaccgtttaaaggttttttaaaccttaccggtttagggttaacccaagggtaccggtaacgggtacccgggggtactaaaccgggtttcccgggacccgttccgttaaccccggtttacggggttttacccggggggaacccggggggttaaaccggtaaacgggggttcggttaaacgttaacccgggaaacggttaacggttgggtaacgggtctacggcaacccgtagtttcgtacgtttcgttaccgtactttccccgttcccgtaccgtaacg

SEQ ID NO: 284798 - DNA, 938 bp, Homo sapiens
  misc_feature: GYAE6OF02I4UN0.14.57.F02.1.454.CMB.1.raw
  modified_base (196)..(196): a, c, t, g, unknown or other
  misc_feature (196)..(196): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctcttttctgtggcttattttaaaagatgtcagtgtgaggtgnagtctggttggaggtccggggggaggtcgttagggtaccgacgggtcccggggggggtccctaggacctacctccttcccgtggtcgccgacggtccctccgaagggtactttaccgttaagtttttaacggaccgtaaaagtacttacggacccctaattcgggaaggtccggttccgggggtaccccggtcccggaacggggtacccgtacccggggtaagggggggaaccggggggtacgttacggggggtaacgggttcggggtacctacgtaagggtaactaaacgttcgtaaggtttcgggtttacggttaaaggttaacggggtaaaccgttacgtaacgtttaccggtaccggtacccggttccggttacccgggttacggggaaaccgggggttcccggttttactacccgtaccttaccggttacccgaagaacgtaacctaaacgttaaccgaaaccgaacctacttaaccttttactttacttaaacgtaacgttacgggaaccacggtaaccgtaacgggaaaacgtaaaccggaaacgtaaccgggtacggggttacccggtttaaggtttttccggtttttaaggttacggttaaagggaaaacgttagttaaaccggtttaaagggtctttaaacgttacggtaaacccgttaacggtttaagggttaacgggggtttaacgggttacccgtttaggtacggttagggttccgggtaacccggggg

SEQ ID NO: 284799 - DNA, 710 bp, Homo sapiens
  misc_feature: GYAE6OF02GGTEE.14.57.F02.1.454.CMB.1.raw
  modified_base (195)..(195): a, c, t, g, unknown or other
  misc_feature (195)..(195): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtncagctgttggagtccgggggagcttggtacaggccggggggtcctggacactcctcctgtagcagcctcaggattctatttttagcgtaattatgccctatcgagctcgggttcccgaccgaggcctccggaggggaacgggcgtagggacggtgggtccgtcgagacgaatccgaggttcggttcgtagtagggtaacgtactagttcgacgtccgttaccgtccggtacggacggggtacccggtttcctaccgtacgttacctccgaaggacgaacctaaacttaccgaaacgtaaccgtacctactttaacgttttacctaactaaacgttaggacctaacgtaccgtaagaaaacggacggaaagaccggtacgggtacgttgtttaagtttttggtagtagaaaaggttacgtaacggtaaggtaccttagtacggtaaccttaacccgtaaggttttacgggggtaccgggttaccttacgttacggttacgtcgggttaaccggggg

SEQ ID NO: 284800 - DNA, 833 bp, Homo sapiens
  misc_feature: GYAE6OF02FKPZC.14.57.F02.1.454.CMB.1.raw
  modified_base (251)..(251): a, c, t, g, unknown or other
  misc_feature (251)..(251): n is a, c, g, or t
tcagcgtctagtaccacgaccggtgctcgatttagctcgatatagttgggtttggggctgagagaggagcccagtcctgggatcttcaggtgttttcatttggtgatcaggactgaacagacgagaactcaccagtggagtttgggctgtaggttggcttcttttcttgtggtcttaattttaaagatgtaccagtgtgtagtgcagtctgtggaggtcggggagctggtacaggccggggggtcctgacnctctcctgtgcacgtcctctacggtacttctattttttagacggtaacttagtcgacctagtcggagtccggtcggggtacccggtccgacgggccgtaccggaagggggaacgggggcgtcggggaaggttcggggtctacggtacgacgaacttcgaacggttcggtttcgtaagggtttagggtaaacggttaaccgttacggtttaccggaaccggttaccccggttccgttacccggtagggtaaacccggggtcccgggttttcctaccgtacttccgtaccgtaaggtacggtaaacctaacgttacccgaaaacgtaaaccgtaccttactttaacttttaccgtttaactaaaagttcgggaacctacggtaccttaacggaaaacggtaaccgtaaacggaacggtaaccgggttacggtttagtttaacgttttttacggacggtttaaagaaaccgttaagtaaccggttaagttcgtaagttacggtaaccctttaaaccgtaaacggttttgggggaaccgggtttacccgttttaacgtacggttacggttccggttaaccgggggg

SEQ ID NO: 284801 - DNA, 598 bp, Homo sapiens
  misc_feature: GYAE6OF02FYDUB.14.57.F02.1.454.CMB.1.raw
  modified_base (401)..(401): a, c, t, g, unknown or other
  misc_feature (401)..(401): n is a, c, g, or t
tcagcgtctagtaccacgaccggtgctcgatttagctcgatatagttgggtttgggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgtggagtccgggggagcttggtacaggccggggggtccctgacactctcctgtgcagcctcaggattcatttttagcgtaatactgccatgagctgggtccgccaggctccgaggggtaaggggctggaggtgggtctcgagcaatcaggtgttctaggtggaatacattcgacgccgtctccggtagacgggtcccgtntcctactctccagagacaattaccaagtaacactacttactttacttacaaattagactacgcctagaaacgacgaagacgacgggacgttgttaacttttggtagttagtaaatacgtaacgaaggttctattagaacttaccgtaaggtttacggggggtcctttacgtagttacgttacggtgggtaacccggg

SEQ ID NO: 284802 - DNA, 662 bp, Homo sapiens
  misc_feature: GYAE6OF02IQJPM.14.57.F02.1.454.CMB.1.raw
  modified_base (179)..(179): a, c, t, g, unknown or other
  misc_feature (179)..(179): n is a, c, g, or t
tcagcgtctagtaccacgaccggtgctcgatttagctcgatatagttgggtttgggggctgagagaggagcccagtcctgggatcttcaggcgttttcatttggtgatcaggactgaacagagagaactcaccatggagtttgggctgagttggctctttctgtggctattttaaaagntgtccagtgtgaggtgcagctgttgggaggtccgggggaggtcttggtacacgggccgggggggtccctggacactctcctgtgcacgcctcgaggtacttctatttttacgacgtaaatatcgccatgagtcgtcgggtccgccgacggctccggagggggaacggggtcgtgggaggtgggtcctcgacgacaatcgaggttcggttctaaggtaggaacgtactagttcgaccgtccgttcgtccggtagggaacggggtcccgtttactccgtattcctacccgaagacgaactaaacgttaccaaagtaacaccttcgttatttactacaaacttcggactagtacctaagaaacgtacgaagaccgtaacgggtcttagtttattttgagtacgaaagtagtacgtaaggtcttaagtactaacgttaaccgtaaggtttaggggacggttaccttcgagttcggtagtaccggggg

SEQ ID NO: 284803 - DNA, 634 bp, Homo sapiens
  misc_feature: GYAE6OF02G2OQT.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgttctttgtctccaaggggaaagagcccaccctctcctgcagggccagtcagagtgtcaacaccaacttaggccttgggtttacagcagaagcctggccagggcctcccgaggcctcctcagtgtactgactgccatcccacgtaccgggccaccgggctactccccgagccgtaggttccaggtcggacgcgggcggggtctgggggacctacggtacctttacgacctcctaccacctacttcgaacgctacggacccgttagcgttacgtagtaacggttactttggacttagttttaattcgttacgtcagccggaggtccgggattaggtccggaccgtcttacggtcggtttcggggccggggtactaagggtcggtacgtacgaacggtacgtggtcggactcgactaccgtgtcgttcgttcttacgccttaccgttcccgtacc

SEQ ID NO: 284804 - DNA, 775 bp, Homo sapiens
  misc_feature: GYAE6OF02JVEZV.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtacaacacaacttagccttggtttcagcagaacgcctggccaggcctcccgaggcctacctcgatgtatcgatcgactactaccccgacggacgggacccaccggcaccgtacccgacgcccgtaggttacgaggtcggacgcggtccgggttacgacggggaactacggtaccttaccgtaccgttaccgaccgtaccctacgtaccgacgtacccgtaacgggtacccgttaagtacgttaacgttacggtaaacgtttacgttttacgacgtttaaggtttttactttaaaccgtcggttacgaccgggttacggaccgggttacgggtaccgtaaagggttccggtacccgttccgttaaccggttacccgggggtttaccggggggaacccgggggttaacgttaacgggggtacggttaaaccggtaacgggtaaaccggttggttcgggtaccggcggttaccgaccggtaccttacgttccggtactttccggttacccttaccgggtttccctttaccccggaccgtttacgg

SEQ ID NO: 284805 - DNA, 966 bp, Homo sapiens
  misc_feature: GYAE6OF02I86RC.14.57.F02.1.454.CMB.1.raw
  modified_base (180)..(180): a, c, t, g, unknown or other
  misc_feature (180)..(180): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttgcttctttcttgtggcttaattttaaagntgtccagtgtgaggtgcagctggttggaggtccgggggagtcgttaggtacgacgggtcccgggggggtccctagaccgtaccgttctccgtggtcgacacgtcccgttcgaaggtacttttacttaagttttttaacgaccggttaaattacgtacggtcctaagtacgggtacggtccggtttccgggggtaccccgtaccggacgggtaccccgttaacccgggtaaaggggggggaaccgggggtctaacggggttacggggtttaccgggggttcccttacggaacgggtaacgaaccggttaaccgtaaggtttcgggtttaccgtacggggttaaagggttaaacggttaaccgttacgttaaccgggtaccccgtacccgggtttcccgttaccccgggtaacggggtaaccgggtttcccgggttcccttaacccgtaactttccccggtaaacaacggtaaacggtaacccgtaactaacccgtaaacctaaccgttaacccttactttaacttttacgtaaaccgtaaagttacgaaacctcggttaaccgtaaaacgggtaaacgtaaaccgggtaaaccgtaaccgggtaaaccgggtttacgtttaaaggggtttttacgtttagggttaacgtaaacgggttaaaattacccggttaaagttaaccggttaacggtaaacgttttacgaaacccggtttaaccgttttaaagggttcggggttaaccgggtttacctttacgggttaacgtcggtttcccggtaaccgggg

SEQ ID NO: 284806 - DNA, 707 bp, Homo sapiens
  misc_feature: GYAE6OF02FOONR.14.57.F02.1.454.CMB.1.raw
tcagcgtctagtaccacgaccggtgctcgatttagctcgatatagttgggtttgggtgcccaagctgctggagggcacggtcaccacgctgctgagggaggcttggtacagccgggggggtccctgacactctcctgtgcagcctcaggattcatttttagcgaatatgccatgagctgggtccgccaggctccgagggagggctggagtgggtctcagcaatcagtggttctagtggaagtacattccgacgccgtctccggtggaacgggccgttcctccatcctccagacgacaattaccaagaacacttactattttcctacaaagtggaacacgcctagaaacgacgaagacgacgggtcgtagtttagttttggtgtagaaagagtaacggaagttctatagtaacttacccgtaagttttacgggggacgggtccttttagacgttgtacggtcggggaccgaacggggtaccgtcgtcgggtccgtaccggttccttacttccgacgcccgttaccccaaccggaacggggtcccctacggttcccggttcccttcccccgtgggtacccctaccccgttccctacccgtaacgacccgtaccgtacccgtcgggtcgggggacccaaccggaccggtcccggtacccgttcggggacccttccgggtaccccgtcgggttaccgtaacggtaccccgg

SEQ ID NO: 284807 - DNA, 624 bp, Homo sapiens
  misc_feature: GYAE6OF02H424C.14.57.F02.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaanagccaccctntcctgcagggccagtcagagtgtcaaacacctaacttagccttggttcagcagagcctggccaggcctccgaggctacctcattgtatgactcgcactccagcggccacggcactccagccgtagtcaggtcgcgaggtcgggtcgaggacagtccttcacgtcaccgaccataccgagtccgacgtccgtaggtacgtacgtagtaagttacgttttgaacgtttaggttttacttagttcgtacgtacgcggaggtcgggtactaagttcggcccgtcgtaccgttacggttaccgggggacggggtaaccgtagggtacgggtaacgttaccgaacggttacttcgggtcgttaccgcggccttaacgcttcgttacgttacccttgtacctttcccgtccgtaacccg

SEQ ID NO: 284808 - DNA, 765 bp, Homo sapiens
  misc_feature: GYAE6OF02GRNM9.14.57.F02.1.454.CMB.1.raw
  modified_base (304)..(304): a, c, t, g, unknown or other
  misc_feature (304)..(304): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtgctattttaaaagatgtccagtgtgaggtgcagctgttggaggtccgggggagcgttggtacacgggccgggggggtccctgacactctcctgtgcagcctcgaggtacttctatttttacgacgtaatatcgccatgancgtcgggtccgcgaggctaccggaggggaagggctgggagtgggtctcgagcaatcagtggtttcgagtagaagtacgtattccgacgcccgttcgtacgtacggaacgggtccggttacctcctacgtacctaccgaaggtaagtaaacctaattacccgaaaagtaaacccgtcttacctttaacgttttacccttaactaaaacggttcggtaaacctaccggtaacccgtaaggaaaaaccggtaaaccgggaaaacggtacccgggtaaacggggttccggtttacggttttaagtttttacgggtacggtttaaaggaaacggttaaccgttaacgtaaacggtttaccttaaggttaccggtaaaacccgtttaacccggttaaaggttttacggggggaacggggtttacccttttacggtaggtttacccggttagggtaaccccggggggg

SEQ ID NO: 284809 - DNA, 850 bp, Homo sapiens
  misc_feature: GYAE6OF02J035X.14.57.F02.1.454.CMB.1.raw
  modified_base (404)..(404): a, c, t, g, unknown or other
  misc_feature (404)..(404): n is a, c, g, or t
  modified_base (814)..(814): a, c, t, g, unknown or other
  misc_feature (814)..(814): n is a, c, g, or t
tcagcgtctagtaccacgaccggtgctcgatttagctcgatatagttgggtttggggggaactgctcagttaggacccagagggaaccatggaagccccagctcagcttctcttcctcctgcctactctggctcccagactaccaccggataaattgtgttgactacgagttcctaccacttaccgacccttgttccttttcggtcctacccggaaagggggaaaactcggtacccctaccccgttccttccgtacggacgacggggtacccagtacgaacgggtacgttcgtaacccaaaccgtaaccctaaaaccggttaccgtcccgttagggtttaccgacggacgtaacggaaccgtcccgacggacccgtacgggccctaccggacgttcccgtcctntagttacgttaggtcaacgtcgtaccacgtccccgaacggaccgggaccgaccccggtaccaccgcccggtaacgccggttacggttacggacgcgggtacgtacggtccggggtacgtacggaccttaacggtaccttaccgtacctaccgtaacgtaccctaagtacccggagtacccgtacggtaccgtaacgggtcgttacgttaacggtacgtttacgtttaccgttaagtttacggtttaaccttaccgttacggtacgtacggtcggaaccggtcggtacgtacgggttaccgtccgttacgtaccggtttaccgggtaccgggggtacgggtaccggtacggtacggttacgtaaccgtaactaccgggttagtaacgtcggtactaccggtacaccgtttntccgttaacttccgtaccttccgtacgtccttacgg

SEQ ID NO: 284810 - DNA, 844 bp, Homo sapiens
  misc_feature: GYAE6OF02IP0RX.14.57.F02.1.454.CMB.1.raw
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagtaattgtgttgacacagtctccactcaccctgttcctttgtctccgaggggaaancgccaccctctccgtgcgacgggccagtcagagtntacaaccacctaacttacgccttggtttacagacaaggaacgtccgtaggcctacggtccctaccccgagggtccttccgtaccgtagttagtactgactcggacctacgtccccgaacggaccggggaccccaccgggacctacgtcccccgacggtccctagggtttaccacgggttccggcgtacgggtccggggtcgtacggggaccgtagttaacccgtttcgaccttacctacccgaaacccgtactacggaacccggtacgtaccggtacccgttagggtaacgttttaccgaaggttaaacggttttagtttttacggacttttaaacggtttttaaccgtttacgttacggttaccgtaacggacccgggtaaagggggtcccggggtaactaaccggggttttccggccccgtttacgttaaaccggtttccggggttaccgggggggacccggggtaaaccgttaagggggttacggaaaaccgttaccgtaaacggcggtttacggtaccggttcaaccgggttacctaactccggtttaccgttacggttccttaacccgttcctttaccccggtttacccgagttacccg

SEQ ID NO: 284811 - DNA, 630 bp, Homo sapiens
  misc_feature: GYAE6OF02JK4T3.14.57.F02.1.454.CMB.1.raw
  modified_base (201)..(201): a, c, t, g, unknown or other
  misc_feature (201)..(201): n is a, c, g, or t
  modified_base (443)..(443): a, c, t, g, unknown or other
  misc_feature (443)..(443): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaanagccacctctctgcagggccagtcagagtgtacaacaccaacttagccttggtttcagcagaacgcctggccaggcctcccgaggcctcctcatgtatgatgcactcccagcggccaccggcactcccgagccgtaaggttccgaggtcgacgaggcgggtcgtagggactaggtaccttcgactcctacgacctagaccacggaccgacgtacccgtaggtacgtccgtaaggtaacgttnttttacgacttaggttttaactacgttgtcgagtacggaacggtcgggtactagtcggccgtacctcgtaccggttcggggaccgggtactagggtcgtaacgtacgaacggtacgttcgacggtactacggactaaccgtagttacgttcgttaccttaccaccgtttccctaccggtaccctagg

SEQ ID NO: 284812 - DNA, 769 bp, Homo sapiens
  misc_feature: GYAE6OF02HZTC7.14.57.F02.1.454.CMB.1.raw
  modified_base (180)..(180): a, c, t, g, unknown or other
  misc_feature (180)..(180): n is a, c, g, or t
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (484)..(484): a, c, t, g, unknown or other
  misc_feature (484)..(484): n is a, c, g, or t
  modified_base (744)..(744): a, c, t, g, unknown or other
  misc_feature (744)..(744): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggtctaattttaaaagntgtccagtgtgaggtgcagtctgttggaggtccgggggagtcgttggtacgagggcccggggggttcctgacacgtcctccgtgtcgcncgcctcgtaggtacttcttagtttttagacgtaaattntcgctagtgacgtcgtgggtcccgcccgaggccgtcggaaggggtacgggtcgtacgggtaggttcgggtactacgacgtctaacgtcttaggtaccggtttcgtaagggtaggtaacgtacgtacgtccggaccgttcccgttcgtaccggtagggtacccgggtcccttttaccncccttgtaccctcgaacgacgtaaccttaaacgtccgaaaacgtaccctacgtttccttaactttccgtttaaccgaaagttccggaacacggtaaccgaaaggtaaccgaaaccggtacggtaaaccccgggtggtttcgtttaagtttttacggtttttcgaaggttaacggaagtaaacggtttagtaacgggttctaaaccgttagtaaacccgttaaccgtttacgggtttaggggtccgggttaacttttcggnggtttacccggtagggtacccgggg

SEQ ID NO: 284813 - DNA, 754 bp, Homo sapiens
  misc_feature: GYAE6OF02JAKL4.14.57.F02.1.454.CMB.1.raw
  modified_base (308)..(308): a, c, t, g, unknown or other
  misc_feature (308)..(308): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctcactcaccctgtctttgtcctcgaggggaaagagccaccctctcctgcgagggccagtcagagtgtcaacaccaacttagcctggttcagcagagcctggccaggtcctcccaggcctcctcattgtatgatcgctacncctacgacgggtcccaccggccaccgtcccaagcccgtaaggttcgaacgtcggacgacgggtcgggtcgtacgggacacggtacttacaccgttacctcgaccgtacctaccggtacgcgtacgtaccgtaggtacggtacttacggtaagtttacgttttcgacgtttaaggttttaccttacgttacgtacgtacggacggacggggtccgggtactaacgggttccgggtacccgtccgttacgttacccggggtttccgggggaccgggggtaaccgtaagggggtcgggttaaaccggtaaccgttaaacggtaccggttacgggttacgggtaccttaccggggtacccttaacccggtcgtttaaccccggtttaggtttacccgtttccttaaccccggtttccccgtttaacccccgggtacttttaaaccccggg

SEQ ID NO: 284814 - DNA, 807 bp, Homo sapiens
  misc_feature: GYAE6OF02IFKJM.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggcttaattttaaaagatgtccagtgtgaggtgcagctgttggaggtccgggggagtcgttggtacgacgggccgggggggtccctgacacctcctccgtgtcgcacgcctcgtaggtactttcttagtttttacggacgtaaattacgttacgccgtaatggtacgccggttcggggtaccccgcccggtaacggtccgtacccggaaggggggaacgggggtccgtggggtacgggttcggggtaccttcgaacgacctaaagtcgaggttggttacgttaggtagtaaagtactacgtttaccggaccgtacccgttcctccggtgggtaaaccggggtcccgttttccgtaccgtacgttcccgtaccgaaggaaccgtaacttaaacgttacccgaaaacgtaacctaccgtttcgttaaactttttccttaaacgtaaagtccggaactacggtaccctaaagggaaaccgaacggtaaaccgacggtaacgggttcgttaacgttttacttttaggtagtaaggtaacgtattaaaccgggtagttaacttaagtaccgtaaccgtaaccggtttaaggttacggggggtaaccggtttccctttaacggactttcggggtaccggtaacccggggg

SEQ ID NO: 284815 - DNA, 600 bp, Homo sapiens
  misc_feature: GYAE6OF02H6OML.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcacctgtctttgtctccaggggaanagccaccctctcctgcagggccagtcagagtgtcaacaccaacttagcctggttcagcagagcctggccaggctcccgaggctcctcatgtatgatgcactccccacgcgggccaccggcactccccagccgtaggttcagtggcaggcgggtctgggacagtacttcactctacaccatcagcacgccgtagagtctagaagttagtttgtcttaagttttattacttgtacagcgtaggacggggtactaagttcggccgtctacgtaccggtttacggggaccgggggtaaccggaagggttacgggtagtaacgtaaacggtacgtaggtcggtacgtgaccgtacctacgttacgttacgtttccttttacgttcccgttacccggtacctacg

SEQ ID NO: 284816 - DNA, 706 bp, Homo sapiens
  misc_feature: GYAE6OF02H4APL.14.57.F02.1.454.CMB.1.raw
  modified_base (202)..(202): a, c, t, g, unknown or other
  misc_feature (202)..(202): n is a, c, g, or t
  modified_base (633)..(633): a, c, t, g, unknown or other
  misc_feature (633)..(633): n is a, c, g, or t
  modified_base (638)..(638): a, c, t, g, unknown or other
  misc_feature (638)..(638): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (655)..(655): a, c, t, g, unknown or other
  misc_feature (655)..(655): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (666)..(666): a, c, t, g, unknown or other
  misc_feature (666)..(666): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (681)..(681): a, c, t, g, unknown or other
  misc_feature (681)..(681): n is a, c, g, or t
  modified_base (686)..(686): a, c, t, g, unknown or other
  misc_feature (686)..(686): n is a, c, g, or t
  modified_base (689)..(689): a, c, t, g, unknown or other
  misc_feature (689)..(689): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacacgcagtatctgcaaatgaacagcctagagagctgaggacacgctgtgtattactggtggganagagtggaggtcgatattgtagtggtggtacgctgcttaataacgtggtactccgaccccgtgggggaccaacggggtaaccctggtaccgtaccgtctccctacgacgtcccttaccgaaccccgaaacgggtcccctaacggtccgtacccgtttccccccgtaggaccccgtaaccccttccctaccgaaacgacgaccgaacccgttcggtacgggggaccaaccggaacggtacccgggtcccgttaggggtcccgttacgggtacccgttacggggtaaccgtaaaacgggtaacccgtttaacccggtttaaccccggtttaaccggtaaacggaaccgggtaacctcgggaaacggggccggggtaaaccgttaggggaacccgttaaacggggaccggtacgttaaacgacggacagacganacganagagnanacgacagacnacananacganacacgacgnanacgngtagnacngtctacgacgtagtaga

SEQ ID NO: 284817 - DNA, 803 bp, Homo sapiens
  misc_feature: GYAE6OF02FRA7R.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgaggggaaagcgccaccctctcctgccgacgggccagtcagtagtcgtacaaccaccaactttagccttggtttaccagtcaagaacgcctggcccaggtcctccccgaggtcctcctcgtaagttcgttaagtggactggacctacgtacccccgaaacggtaccggggacccaacccgggtcctaacgtcccccggaacgtaccgtacgggttcaacggtcgggacacggggtcgggggtcgttacggggaactacggtaccttttacgacccttacgtacccaacccagtttaccgaccgcgtaaccggtacctaaggtcgtaacgttaggtaagtttacgttttacgggacctttaagttttttaccgtacgtttaggtaacctacggtccggtaagggtcccggggtacttaacgggtttcgggacccttcggttttacccgttacgggttacccggggggtaacgggggtaaccgttaagggggtacgttaaccggtaaccgttaacggtaccgtttagggtaccggtggtaacccggtccgtaaccgttaacgttcgttaccggtttccgttaacggaccctttttcccgacccgttacccg

SEQ ID NO: 284818 - DNA, 715 bp, Homo sapiens
  misc_feature: GYAE6OF02IBXUK.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaacgccgtggccaggcctcccgaggcctcctcatgtatgatgcactcccgacgacgggccaccggcactcccgagcctaggttcaggtcggacgacggtccggggtcgtacgggactacgtaccttccgacgttcctaccaaccctactccgacggtccaacgtccgttaacggtacgtttccgtaagggtaaacgtttactttttacggacctttaaggtttttacttacgttcggttaccgtaaggtacgacgggtacggggactaacgggtttcgggacccgttcgttaccgttaccggggtttccgggggacgggggttaaaccgtaggggttacgggtaacgtttaaccgaaacggtacggttagggtacggtccgttacgaccgtaccgttaacgttcgtttacggttaccgtttccgttaccgtttccccgttacccgccttaacg

SEQ ID NO: 284819 - DNA, 638 bp, Homo sapiens
  misc_feature: GYAE6OF02H5J29.14.57.F02.1.454.CMB.1.raw
  modified_base (354)..(354): a, c, t, g, unknown or other
  misc_feature (354)..(354): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctccagataccaccggagaaattgtgttgacacagtctccactcaccctgtctttgtctccgaggggaagagccacctctcctgcagggccagtcagagtgtacaacaccaacttagccttggtttcagcagaagcctggccaggcctcccgagctcctcatgtatgatgcactccacgcggccacggcactccacgctaggtcaggtgcgaggtcgggtcgngggacagtacttcactctccacatacagcacgcctagactgtaagtagttagttttgactttaagttttacttagttgtacgtaggacgtacgggcgggtaactaacgttcgggcccgtcgtttaccggtaccgggtttcgggggaccgggggtaaccgtaaggggtacggttaaacggtacggtaaaacgtcggttacggtcggtcgtaccggtaccgtaaccgtccgttccgttacgtttaccttcccgttaccgtttaccccgtttccccgacttaacccg

SEQ ID NO: 284820 - DNA, 618 bp, Homo sapiens
  misc_feature: GYAE6OF02GF37E.14.57.F02.1.454.CMB.1.raw
  modified_base (341)..(341): a, c, t, g, unknown or other
  misc_feature (341)..(341): n is a, c, g, or t
  modified_base (614)..(614): a, c, t, g, unknown or other
  misc_feature (614)..(614): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtacaacaccaacttagccttggtttcagcagaacgcctggccaggcctcccgaggcctccgtcagtgtatgatggctactccccacgacgggacccgaccggctaccncccgacggcctaggttcaggtcggccaggtcgggtcgagggaccaggtaccttcacgtcctccaccactcacgccacgcctagacgttacgtggtaagttagttttcgacgtttaagttttacttacgtcgttacagtacgagggtcgggacgtaacgttcgggacccgtcgttacgttaccggttccggggacggggtaccgtagggtaggtacgttacgaacgtagtcggtggctcgcgaactgtcgttcgtctctacgtccgttacccgntacg

SEQ ID NO: 284821 - DNA, 480 bp, Homo sapiens
  misc_feature: GYAE6OF02IOEET.14.57.F02.1.454.CMB.1.raw
  modified_base (196)..(196): a, c, t, g, unknown or other
  misc_feature (196)..(196): n is a, c, g, or t
  modified_base (311)..(311): a, c, t, g, unknown or other
  misc_feature (311)..(311): n is a, c, g, or t
  modified_base (431)..(431): a, c, t, g, unknown or other
  misc_feature (431)..(431): n is a, c, g, or t
  modified_base (437)..(438): a, c, t, g, unknown or other
  misc_feature (437)..(438): n is a, c, g, or t
  modified_base (441)..(441): a, c, t, g, unknown or other
  misc_feature (441)..(441): n is a, c, g, or t
  modified_base (444)..(445): a, c, t, g, unknown or other
  misc_feature (444)..(445): n is a, c, g, or t
  modified_base (447)..(480): a, c, t, g, unknown or other
  misc_feature (447)..(480): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgngtgaaagatacgaagtctatgatacccaatttgggaggggtcctttcatgtctggggaccaagggacgctggtcaccgtctcttcagcctcaccaaggccatcgtctcccctgcncctcctcagagcacctcgtggggcacagcggcccgtgggctcgcctggacaaggtactaccgttccgtactagtacgctagaggcgggcgtaggcgtaacgggcgactaagtaaggctangagacnngangannannnnnnnnnnnnnnnnnnnnnnnnnnnnnnnnnn

SEQ ID NO: 284822 - DNA, 949 bp, Homo sapiens
  misc_feature: GYAE6OF02IX2ZB.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggaggcttaggtacagggtccggggggtccctgacactcctcctgtcgcacgcctacgaggtatttcttaatttttacggacgtaaatagtcggaccagttggacgtcgttcggggtacccgccgaagggtccgtaccggaaggggggaacggggtccgtaggggacgggtttcggggtaccttacgaacggtaccgtaaagttccggtaaggtttcggttttaccgtaaggggttaacgggtaaacggtttacgttaacggtttacccggtaaccggttcccccggttacccggtttacccggggttaggggtaaacccgggggttccccgggtttttaccctacccggttaaccgttacccgttaaccccggaaagggtaacccgtaaacccgttaaacgtttaaccccgaaaaacgtaaacccgttacccggttaccgttttaactttttaaaccgttaaccttaaaacggtggtaaacccgtaccggttacccgttaaaggaaaaaccggaaacccgggtaaacggtaaacccgggtacggggttaacgtttaacgggtttttaacgttttttaccgggagggttaaagttaaaacgggtaccgttaaaccgggttaagtttaacgttaacggttaacgttaaacccgtttaaccggtttaaagggttttacgggggtaaccggttacccttttaggaacggttttccgggtaaccgggttaacccggggg

SEQ ID NO: 284823 - DNA, 686 bp, Homo sapiens
  misc_feature: GYAE6OF02H9XPT.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcgagggccagtcagagtgtacaacacaacttagacctggtttcagcagaacgccgtgccaggctcccgaggcctccgtcatgtatgatcgacactcccacgcggaccaccggcgactcccgagcccgacggttcgagtcgcgaggcgggtacgtgggacaacgtacttcactctaccactacgtcaacgcacgtctaagtagtcgtagaaggttattttacgattaacggttttaacttacgttgtacgtaggtcggtaaggcggggtactaacgggttcggcccgtacgttccgtaacgggtttcccgggggacggggggtaacccgtaacgggggtggaaaccggtttaacgtaagttaccggtaacgtttacgggtacggtaaccgtaccggtaacctaacccggttaacgttcccgtttaggtttacccgtttaccttaaccgtttcccccgttaacccggtccc

SEQ ID NO: 284824 - DNA, 488 bp, Homo sapiens
  misc_feature: GYAE6OF02IZ29F.14.57.F02.1.454.CMB.1.raw
  modified_base (445)..(446): a, c, t, g, unknown or other
  misc_feature (445)..(446): n is a, c, g, or t
  modified_base (449)..(450): a, c, t, g, unknown or other
  misc_feature (449)..(450): n is a, c, g, or t
  modified_base (453)..(454): a, c, t, g, unknown or other
  misc_feature (453)..(454): n is a, c, g, or t
  modified_base (458)..(488): a, c, t, g, unknown or other
  misc_feature (458)..(488): n is a, c, g, or t
tcagcgtctagtaccacgaccggtgctcgatttagctcgatatagttgggtctcagcaatcagtggttctagtggaagtacattcgacgccgtctccgtgaagggccggttctccatctccagagacaattccaagaacactctatttctcaatggacagcctagaagacgaagacacgggcgtgttatttttgtgtagaagatacgaagtctatgataccctaagtttgggaggggtcctttcatgtcgtggggccaagggacgcgtcggtcacctctcttcacgcctccaccgaacggccccatcggtcccttccccctcggccacccctcctccaagcgccacccgtcgcggggcacgacgcggccgtggctcgccgtcgacgaacgtacctacgttccgtactcgacgctgacggcggcgaggcgaagggcgacgataggnncgnngcnnacgnnnnnnnnnnnnnnnnnnnnnnnnnnnnnnn

SEQ ID NO: 284825 - DNA, 617 bp, Homo sapiens
  misc_feature: GYAE6OF02HADXI.14.57.F02.1.454.CMB.1.raw
  modified_base (200)..(200): a, c, t, g, unknown or other
  misc_feature (200)..(200): n is a, c, g, or t
  modified_base (396)..(396): a, c, t, g, unknown or other
  misc_feature (396)..(396): n is a, c, g, or t
  modified_base (406)..(406): a, c, t, g, unknown or other
  misc_feature (406)..(406): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaangccaccctctcctgcagggccagtcagagtgtcaacaccaacttagccttggttcagcagaacgcctggccaggcctccccgaggcctcctcatgtatgatgcactcccacgagggcccacggcactccccgagcccgtaggttccaggtcggcgaggtccggggtcgtaggggaccaggtaccgtttcaccttcncctaaccctntaccgacgccgacgtacctagacgttcgtagtaagttatttgacttagtttattacgttgtacagtcgaggcgggactagttcggccgtcgtaccgtcggttccggggaccggggtaccgtagggtaggacgttacgaacgtacgttggtcggcgttcgaccgtaccgtacttcgtcgttccttaccgtaccttcccgttcccgaccttcg

SEQ ID NO: 284826 - DNA, 615 bp, Homo sapiens
  misc_feature: GYAE6OF02F37X4.14.57.F02.1.454.CMB.1.raw
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (392)..(392): a, c, t, g, unknown or other
  misc_feature (392)..(392): n is a, c, g, or t
  modified_base (468)..(468): a, c, t, g, unknown or other
  misc_feature (468)..(468): n is a, c, g, or t
  modified_base (574)..(574): a, c, t, g, unknown or other
  misc_feature (574)..(574): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccacctctcctgcagggccagtcagagtgtcaaaccacctaacttagccttggttcagcagaacgcctggccaggcctcccgaggcctccncattggtatgntcgactactccccgacgacggggcccaccgggccactccccacgtcccgtaggttcgaggtcggacgcggcgggtcgtgggaacncgtacttcaactcgtaccacactcacgcagacctagactcgtagtagttatttgacttaagtttacttagtcgtanagacgagggcggtaacagttcggcctacgtcgtacggtttcggggacggggtaccaagggtcggtaacgttaacgaacgtacgtcggacgtcgacgtacgtaaccngttccgttcgtcttaccgactttccccgtccgaccgttacg

SEQ ID NO: 284827 - DNA, 656 bp, Homo sapiens
  misc_feature: GYAE6OF02F2DJC.14.57.F02.1.454.CMB.1.raw
  modified_base (462)..(462): a, c, t, g, unknown or other
  misc_feature (462)..(462): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctccagataccaccggagaaattgtgttgacacagtctccactcaccctgtctttgtctccaggggaaagagcccaccctctcctgcacgggccagtcagagtgtacaacaccaacttagcctgttcagcagaacgcctggccagggcctcccgaggtctcctcatgtatgatcgacactcccgacgcgggccaccggcactcccagccgaggttcaggtcggcgaggccgggtctagggacagtactcactcacaccatcgacgcacgaccgtagtacggtctaacggtaagttactttacggcttaaggtttacttacgttacgttacncgtacgtacgggtacggggtactaaggttccggccgtaccgttaccgttaccgggtttccgggggacgggggttacccgtaagggtacgggtaacgttaccggaaacgtacggttacggtcgggtacgtccgaaccgtaaccgtatttccgttacggtttccttacgtacccgttccgttaccccggacttacg

SEQ ID NO: 284828 - DNA, 879 bp, Homo sapiens
  misc_feature: GYAE6OF02F173S.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctattttaaaagatgtccagtgtgaggtgcagctgttgggaggtccggggggagtcgttgggtacgacgggcccgggggggtccctggactacctctcctgtgcagcctcgaggtattactatttttaggcgtaattagtgaccctagttgagtcgttcggggtcccgcccgaggtccgtccgaagggggaaggggcgtgggaggtcgggttctcgaggactaagtccgaagggttcgtttacgtaaggtgggtaaacgttaaccgtacgttaccggaacccggtcccgtttacccgtcccggggttaacggtaacgggggtcccccggtttttaccgtacccgtaaccgttcccgttaacccggaagtaaccgggtaacttaaaaccgtttaacccaaaacgtaaacccttaaccctttactttaacccgtttttaccttaagttaaacggttaccggtaaacctaccgggttaacctaacggtaaaaccggaaaccggtaaaccgggaacccgtaacgggggttccgtttttaaggtttaaccggtttttttaggttaagggttaagggaaaaaccgttacggttaaacgggttaacggtttaccttaaagggttttaacgaaacccgtttaaacccggttaacggtttttaacggggggacgggttttaccctttacgtacgggtttacggtccgggtttaaccggggg

SEQ ID NO: 284829 - DNA, 603 bp, Homo sapiens
  misc_feature: GYAE6OF02FS94X.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaagagccaccctctcctgcagggccagtcagagtgtcaacaccaacttagcctggtttcagcagaagcctggccaggcctccaggctcctcatgtatgatgcactcccaacgacgggcccaccggcactcccagccaggttcaggtggcacggcggggtctggggacaggtacttcactactcaaccatcagccagcctaaggcgttacagtaagtatttgacttagtttactacgtgtcacgtcgagggcgggataaggttcggccctagtccgtacggtttcggggacccgggggtaactagggtcggtaacgtacgtaaacgtacgttaggtcggtactaccggacctaaccgttacgttcgttacgttacgttacctacgtttcccgtacccgtacctaacg

SEQ ID NO: 284830 - DNA, 741 bp, Homo sapiens
  misc_feature: GYAE6OF02JVVHC.14.57.F02.1.454.CMB.1.raw
  modified_base (178)..(178): a, c, t, g, unknown or other
  misc_feature (178)..(178): n is a, c, g, or t
  modified_base (214)..(214): a, c, t, g, unknown or other
  misc_feature (214)..(214): n is a, c, g, or t
  modified_base (268)..(268): a, c, t, g, unknown or other
  misc_feature (268)..(268): n is a, c, g, or t
  modified_base (559)..(559): a, c, t, g, unknown or other
  misc_feature (559)..(559): n is a, c, g, or t
  modified_base (625)..(625): a, c, t, g, unknown or other
  misc_feature (625)..(625): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggcttagttggctctttctgtggctattttaaaagntgtcagtgtgaggtgcagctgttggaggtccggggngtcttggtacgagggccgggggggtccctgacctacgtccgttaccgtggtacncgagccttccgaaggtattacgtagtttttaggaccgtaaattgtcgacctagttcggacgtcggtcgggtaccccgacgacggtccgtacccgagggggtaagggcgtaggggcggtgggtctacgagactacgtagagggttggtacttaggtaggtaacgtactaggttaccgacgtcccggtcttccggaggtaaccgggtcccgttactcgaccgttccaccgagtacgaactaacgttaccaaacgaactactacgtttattaccctaagtaacttaccgggaanaccgtacgtacgtaaaacgacggtaaaccgtcggaacccgggttgtaacggtttaagtttttcggngttaaacgaagtacgtacggttaacgtaaccgttagtaacggtacttaaacccgggttagttaccgggggttacgttacccgttattaaggtcgttccgggtaccggtaaccgggg

SEQ ID NO: 284831 - DNA, 711 bp, Homo sapiens
  misc_feature: GYAE6OF02FGZU0.14.57.F02.1.454.CMB.1.raw
  modified_base (244)..(244): a, c, t, g, unknown or other
  misc_feature (244)..(244): n is a, c, g, or t
  modified_base (308)..(308): a, c, t, g, unknown or other
  misc_feature (308)..(308): n is a, c, g, or t
tcagcgtctagtaccacgaccggtgctcgatttagctcgatatagttgggtttggggggaactgctcagttaggacccagagggaaccatggaagccccagctcagcttctctcctcctgctactctggcctcccagatacccaccggagaaattgtgttgacacagtctccactccaccctgtctttgctccaggggaaacagccaccctctcctggccagggccagtcagagtcgtcaaccnccaactgcctggttcagcaggaacgccctggccaggcctcccgaggcctccgtcaatcgtactnacgtcgacctactccgacgacggcccaaccggcactccccgagccctacgggttccgaaggtcggcctacgggtccggggtactacggggaccaacggtccttccaccgttcctacacccagtccgaacggtcaacgtaccgtacgacgttccgtaagtaacggttactttacgacgttaacgtttaacttacgtacgttaccaggaccgtacggcgggtacttacggttacgggtcctacgttaccgtaccgggtttccggggaaccgggggttaaccgaagggttacggtaacgttaaccgaaaccggttacgtacgggtcggtacggtaccgacccgtaaccgttacgttcgttccggttaccttaccgtaaccttccccgttaccccgcgttaacccgg

SEQ ID NO: 284832 - DNA, 663 bp, Homo sapiens
  misc_feature: GYAE6OF02GMUAP.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccgggagaaattgtgttgacacagtctccactcaccctgtctttgtctccgaggggaaagagccaccctctcctgcgaggccagtcagagtgtcaacaccaacttagcctggttcagcagaacgcctggccaggcctcccaggtcctcctcatgtatgatgaccacgtcccagacgggccaccggcactcccagcctaggttacaggtcggacacgggcgggtcgttaggggacaggtactttcgaactacctacacctatcgagccaagccctaaggacgttcgtaagtaagttacttttgaacttagtttaacttaacgtgtacagtacgaggtcgggtataacggttcgggaccgtccttacggtaccgggtttacgggggacgggggtaacccgaaaggggttcggtaacggttaaccgaaacgggtacgttagggcggtacctcgggtaacctaacccgtaagttcccgttacggttcctttaacccgtacgtttacccgtaccccggtaaccc

SEQ ID NO: 284833 - DNA, 636 bp, Homo sapiens
  misc_feature: GYAE6OF02ILLX5.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcacgggccagtcagagtgttagcacctccttagcctggtaccaacagaacctggccacggctccccgagccctcctacatctctgatcgccttaccaacgcgggccacgtggacctactccccagccgtaggttcgaggtcggcgaggtcggttacgtagggaccaggtactttcgacttccgtacaacctatacacgtccttacccgtagacgtcgtaggtacgttagtttttcgtagttttaattacttggtacagtcgtaagttacgtaagctagtccgtacgtcccttacccgtacgtttccggggacgtaacgggacctaagggcggaacgtaccgtaaccgaacgtagttcggtacggctacgtccaaccgtctcgttactcctttaccacgtttcccttcccgacttaccg

SEQ ID NO: 284834 - DNA, 615 bp, Homo sapiens
  misc_feature: GYAE6OF02GXZFW.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggcctcctcatgtatgatgcatccccacgacgggccaccggcactccccgagccctaggttcaggtcggcaggcgggtcgtgggacagtacttcactctacaccagtcagcacgtctagacgtcgtagaagtattttcgacttagtttacttacgttgtacgagtcgaggacgggactaacgttcgggtaccgtccgtaccgtacggtttccggggaccgggggtaccgtaagggtacggtacggttaccgtaacgtaacggtgggtcggtaccgtggtaccgtaccgtaacgttcgttacggttccttaccgctttcccgttcccgtaccg

SEQ ID NO: 284835 - DNA, 683 bp, Homo sapiens
  misc_feature: GYAE6OF02JL9UL.14.57.F02.1.454.CMB.1.raw
  modified_base (247)..(247): a, c, t, g, unknown or other
  misc_feature (247)..(247): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccagggaagagccacctctcctgcagggccagtcagacgtgtcaacaccaacttacncctggtttcagacagaacgtctacggccaggcctacccgaggtcctcctcgtatcggtataggatgacgtatcccacgacgggaccaccggcaccgtcccacggccacggttacgagtcgggcctacgggccggggtaccgtgggtaccgacggtacctacgtcctactacccgtaaccgcgtaccagtaccgacgtaccgtacgtacgtaccgttaaggtaaacgttagttttacggacgttaacggttttacgttacgttgttaccgtaagtcgaacgggtacggacggttaaagtcgggaccgtacgttccgtacggttccgggacggggtaccgagggttacgtacggtacgaaacggtaccgtaggtcggtacgttacgtaccgtacctacgttaccgtcgtcgttacgtacttcccgttccgaccgtacg

SEQ ID NO: 284836 - DNA, 624 bp, Homo sapiens
  misc_feature: GYAE6OF02JG3YX.14.57.F02.1.454.CMB.1.raw
  modified_base (201)..(201): a, c, t, g, unknown or other
  misc_feature (201)..(201): n is a, c, g, or t
  modified_base (618)..(618): a, c, t, g, unknown or other
  misc_feature (618)..(618): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactctggctcccagataccaccggagaaattgtgttgacacagtctccactcaccctgtctttgtctccgagggaanagccaccctctcctgcacgggccagtcagagtgtcaacaccaacttacgccttggttcagtcagaagcctggccaggcctcccaggcctcctcatgtatgatgcactcccacgcggccaccggctactcccacgcctaggttccaggtcgcaggtacgggtctgggacaggtaccttccgacgttctaccgaccacttcgacgctaacggaccctagaacgttctaaggaacgttattttcgacttaagtttttacgacttggttacagtccgagggcgggtactaggttccggccgtaccgtcgtacggtttccggggacggggtacctaagggtcgtaacgttaacgaaccgtagttgggtacgtccgtagacctacccgatttccgtagttcctacgtaccttccgtaccccgnttaccg

SEQ ID NO: 284837 - DNA, 745 bp, Homo sapiens
  misc_feature: GYAE6OF02H6T50.14.57.F02.1.454.CMB.1.raw
  modified_base (494)..(494): a, c, t, g, unknown or other
  misc_feature (494)..(494): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtcttgtcctccgaggggaagagccaccctctcctgccgagggccagtcaggtagtcgtacaaccaacctaacttacgtccgttcggtttacaggactaacggaacgtcccgtcgggacctaacgggcccttccccggacggtccttacctaccattcggtactgatcgctactcccacggtaccggacccaccggactaccgtcccgacggtacccgtacggttcgaggtcggccgacggggtccggtcggtagggactagtaccttacgcctacctaccacctagtacgacgacaccgtcgtagtacgttntacggtaatttgttacgacgtttagttttaacgttcgttacgtacgaggtcgtacgggtacggtacgttaacggttccgggaccttccgttaccggtaccgggttttaccggggggaccgggggtaaccgtaagggggtacgttaaccggtaccgtaaacggtacggttcgggcggtaaccgtacgaccccgttaacgttcgttaccgttaccggtccgtttacgacccgtttcccccggtacctacccgg

SEQ ID NO: 284838 - DNA, 848 bp, Homo sapiens
  misc_feature: GYAE6OF02H8P0Q.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcacgggccagtcagagtcgtacaacacctaacttacgacctggttttccagtccaaggaacgcctagggccaagggccttccccgagggtccttacccgtcaacgttggttaactggtaacttcggacctaacttaccccgaacgaaccgggggccctaaacccgggccaaccgttacccccgaaacggtccccgtaaacggggtttaccgaacgggttacgggaccggtaacgggcccggggggtttacgtaccgggggggaacctaaaccgggttaaccgtttaccgaacccgtttcccgttaaccaaccccgttaacgttaacccgacggacccgtaaacggtacccgttaacgggtaacggtttaccgttacggtaaacgggttactttttacggacgtttaaacgtttttacttacgttcggttaccgaggtcgaacgggacggggtacctaaggttcgggtaccgtacctcggtaacccggtttccggggacggggtaacccgtagggtcgggtaaacggttaccaaacggtacgttacggtacggtcgtaacgtccgaacgttaccgttacgttcggttaaccttccggttaaccgttacccttttaccccggacttaaccgg

SEQ ID NO: 284839 - DNA, 939 bp, Homo sapiens
  misc_feature: GYAE6OF02HZ32Z.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggctattttaaagatgtccagtgtgaggtgcagctgttggagtccgggggagcttggtacaggccggggggtaccctgacactctcctgtgcagtcctcaggtattccgtaagtttttacgaccggttaatagtcggaccctaagtggtaacgtcgtcgggtcccgacctacgggtcctaccggaagggggaacgggtccgtaggggtacggttcggggtacctaccgaggtaccgtaacgttaccgtaggttacggtttaccgtaagggttacgggtaaacggttaaccgtaacgtttaccgggtaaccggtaccccggttacccgttacccgggtacgggtaaacggggttccccggttttacccgtacccgtaacgttcccggtaaccccgtaaagggtaaccgtaaaccgtaaacgtttaaccccgaaaagaacccgttaacccttaacgtttaacctttttaccgtaaaccgtaaaacgttaccgggtaaccgtaacggttaccccgttaaagggaaaacccggttaacggaaaaccggtaacccgggtaaaccggggttaccgttaacggttttttaaccggttttttaggtaacggtttaacggaaaaacggttacgtttaaacccgggtaaaggtttaacccgtttaacggttaacggttaaaccccgtttaaacccggttaaagggtttttaccggggggtaacccggggttttacccttttaaccggtacggttttacccgggttaccgggttaaaccccgggggg

SEQ ID NO: 284840 - DNA, 914 bp, Homo sapiens
  misc_feature: GYAE6OF02F3R86.14.57.F02.1.454.CMB.1.raw
tcagcgtctagtaccacgaccggtgctcgatttagctcgatatagttgggtttggggctgagagaggagcccagtcctgggatcttcaggtgtttcattggtgatcaggactgaacagagagaactcaccatggagtttgggctgagttggctctttcttgtggctattttaaaagatgtccagtgtgaggtgcagctgttggagtccgggggaggcttggtacaggccggggggtcctgacactctcctgtgcacgcctcgaggattctatttttagacgtaatatgcctatgagcgtcggtccgcgaggctccgagggagggcgtgggaggtcggtctcgacgacaatcgtaaggttcggttcgtaaggtggtaaacgttacgtacgttaccggaaccggtccggttaccgttacccggttacgggaaaccgggggttcccgggtttaccgtacccgtacgttacccgttacccgaaacggtaacgggtaaaccctaaaccgtttaacccgaaaaacgggtaaacccgtaaccctttaacccgttttaacttttttacccgttaaaccgttaaaaacgttaccggggtaaacccgttaaaccgggttacccgttaaaacggggtaaaaccgggtaaaaccgggtaaaaccgggtaacccgggtaaaccgggggttacccggggtttttaaacggtttttaccggtttttttaagggttaacgggtttaaacgggttaaaaaccgggttagttaaaacccgggttaaacggtttaaccgttaaaggttaaccggttaaaaccgtttaaaccccggtttaaaaggggtttttaccgggggggtaaccgggggttttaaaccccttttcgggttaaaccgggttttacgggttacccggggtttaaccggggggg

SEQ ID NO: 284841 - DNA, 691 bp, Homo sapiens
  misc_feature: GYAE6OF02HCHOA.14.57.F02.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctcactcacctgtcttgctccaggggaanagtccaccctntcctgcacgggccagtcagagtcgtacaacgaccaacttacgccttggttaccagcaagaacgtcctaggccaggcctacccgaggcctcctacatcgtatcgatcggctatccccagtacgggccacggctacgtcccagccgtaggtccaggtcgacgaggtcggtcgagggactgacttcactccgtacacctagcaagccacgccgtaagacgtatacgtaagttactttggacttaaggttttacttacctgtacgtaggacgtagggtaccgggtactaacggttccggaccgtcctttacggtaccgggttttaccgggggaccggggggtaaacgttacgggtacgggtaacgtttaacccggaaaccgggttaacggtttcgggaaccggtaccggttacgaaccgttaaccgtcggttttccttaccgggtttacctttaacccgtaccgttttaccccgttcccggtaacg

SEQ ID NO: 284842 - DNA, 724 bp, Homo sapiens
  misc_feature: GYAE6OF02F0A5Y.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtggtcaacaccaacttagccttggtttcagcagaagcctggccaggcctcccgaggtctcctcactgtatgatcgcactcccagacgggcccaccggcactcccgagcccgtaggttcaggtcggaccgaggccgggtacgtacggggacaacggtaccttacgacgttcctccgaacccgtactaccgacgacgaccgtaccgtagtacgttacgtaaggtaacgttagtttcgaacgtttaacgttttactttaccgtagttacgtacggtacgtacgggaccgggtactaacggttccgggtcccgtacgttacccgttaccggggttttaccgggggaaccggggggttaaaccgtaaggggtacggttaacgttaaccgtaaaccggttacgttacgggtacgggtccggtacggtacccgaacccgttaacgttccgttacggtttacgttacccttacgtttccccgttacccgtccgttaaccg

SEQ ID NO: 284843 - DNA, 648 bp, Homo sapiens
  misc_feature: GYAE6OF02IVZI5.14.57.F02.1.454.CMB.1.raw
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcacgggccagtcagagtgtcaacaccaacttagcctggttcagcagaacgcctggccaggcctcccgaggcctccctcatgtatgatgcactcccacgacgggccaccggcactcccgagccgtaggtcaggtcggcgacgggtcgggtcgtacgggactacggtacttcacttccacacctagtccaacgctacgacccgtaggtacgtacgtagtaagttacgtttgacgtttaacgtttacttacgttggtactaggtcgacgggccgggtaactacggttccggtccgtacgttaccgtaccgggtttcggggaccgggggttaaccgtagggtacggtacggttaaccgaacggtacggttcggtcggtaccgtcggacctaccgtattcgttacgtacttaccgtacttcccgttaccctaccg

SEQ ID NO: 284844 - DNA, 645 bp, Homo sapiens
  misc_feature: GYAE6OF02I490S.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctcctgcagggccagtcaggagtgtcaacaccaacttagccttggtttacagcagaagcctggccaggcctcccaggctcctcatgtatgatgcactcccgacgacgggcccaccggcactcccagccaggttcaggtcggcacggtcgggtcgtaggggactacggtaccttaccgactccgtacaaccctatccgaagccaagaccctaggtacgtcgtaaggtaagttattttcgacgttaagttttactacgttgtacgagcgtacggacggggtacaacggtttcggaccgtccgttacgtaccggtttaccggggaccgggggtaaccgtaagggtaggtacgttaccgaaacgtacgtggtcggtactacgacctacgtacgttcgttacgttccttaccgtacttcccgttaccccgtactaacg

SEQ ID NO: 284845 - DNA, 826 bp, Homo sapiens
  misc_feature: GYAE6OF02JIX5P.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggctatttaaagatgtccagtgtgaggtgcagctgttggaggtccgggggagcgttggtacgaggccggggggtccctggacaccgtcctccgtgtcgacacggtccctcgaacgggtactttaccgttaattttttacggacgtaaacttattccggaccctaagttcggaacggtccggttacgggggttccccgacccgaacgggttccctaccccgggaaggggggaaaccgggggtccgtaggggtacgggttcggggtcccttaacggacggtactaacgttacgtacggttcggttacgtaggtaggtaagtactagttccggaccgtccgttacgtccggtacggtaacggggtccccgtttacaccgtactcccgtacgaacgacgtaactaacttaaccgaaagtacctaaccgtttacttaaccgttttcctaacgtaaacggtcgtaaccggtaatacccgtaagaaacggtaaccgaaacgggtaaccgacgggttacttaggtttacgtttttaggtcgttaaacgtaagtacggttaacgtaacgttattaactaacggttaaccgttaacccggtttaagggttaaccgggggttaccgggtaacccttttacggtaaccggtttcggtaaccgggttcccgggggg

SEQ ID NO: 284846 - DNA, 721 bp, Homo sapiens
  misc_feature: GYAE6OF02GNL90.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagcgccaccctctcctgcagggccagtcagagtgtacaacaccaacttgccttggtttacagcagaacgcctggccaggcctacccgaggcctccctcattcgtatcgatcgacctactaccccgaacgaccgggacccaccggcaccgtcccagtcccgtaggttaccgaggtcggcgacgggtccgggtacgtcggggaactacggtaccttaccgaccttccgtaccaacccgtatccgaacgtcctaacgacccttaaggacggttactagggtaaacgttagttttacggaacttttagttttaactttacgtgttaccgtaagccggtaaggggaccggttaactaagggtttccggacccgttcgttaccgttaccgggtttaccggggggaaccgggggttaactaaggggtacgtaaccggttaacgtaaccgggtacgtaggtacggacttaccggaacctacgtacgttcgttacgttaccgtacgttaccgttcccttaccccgtacg

SEQ ID NO: 284847 - DNA, 873 bp, Homo sapiens
  misc_feature: GYAE6OF02G436W.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaaggtgtgcagtgtgaggtgcagctgttgagtcgtgggggagcgttggtacaggtccgtgggggtccctgacgaccttctccgtgtgcacgcctcggtgtagttccgtccgtttagacgtaacgtccttaaagttcgaccgtaagttacggaacgtcgggttcggggcccttacccggacccggtaacgggtcccgttaacccgggaaaaggggggaaacggggggttccgtaagggggtaagggttccgggggtttcccttacgggtcgttaaccgtttaaccgttccgggtacgggtacggtaaggttacgggtagtaaacgttaaagtaaccggtaaaacttaaccggtaccggtaccgtaaacggtacccggttaacccgggttagggtaaacccgggggtcccggttttaacaaccgtttaccggtttaaccgaaacggtaacggtaaaccttaaacgtaacccgtaaaaacggaaacctaaccggtaacgtttcgttaaacttaccgttagaacccgttaaggaactcccgtaaaccgacgtacccggttaggaaaccgggacgaccgggaacggtacccggtaccgggtaacccttaattacggtttaacggtacgtaccggtaaaaccgtaacccggtaacgtttaacggtttaggttttacggtaacgggtttaagttttaaacccgg

SEQ ID NO: 284848 - DNA, 745 bp, Homo sapiens
  misc_feature: GYAE6OF02GWY4A.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtcctgacactctcctgtgcagcctcaggattctattttagacgtaatagtgccagtgagcgttcgggtcccgccgaggcctaccgagggggaacggggcgtagggaggtcggggtcctcgacgactaactcgtaggttcggttactaggtacggtaagtactagttcgacgtcccgtctccggtaggaacggggtccgtttctacctactcctccgaagtacgtaactaaacttaccgaaaacgtaacctaccttacgtttaacttttaccgttaaccgaaattacggaaactaccgtaccgtaaggaaaaggtaaccggaaacggaaccgtaaccggggtcgtttaacggtttacgttttttagggtacgttaaggtaaacggtagttaaacggtaacggttacgttaaaccgttaggtaaaccctttaacccggttaaggttttaccgggggggaacgggttaccctttttacgaacggttttccgggtacggttacccggggggg

SEQ ID NO: 284849 - DNA, 668 bp, Homo sapiens
  misc_feature: GYAE6OF02G3PLN.14.57.F02.1.454.CMB.1.raw
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (388)..(388): a, c, t, g, unknown or other
  misc_feature (388)..(388): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaaggggaaagcgccaccctctcctgcgagggccagtcagagtgtcaacaccaacttagtcctggttcagcagagcctggccaggcctaccgaggcctcctcagttgtatgatcgcactcccgacgacggccaccggcacncccgagccgtaggttcgaggtcgcgtacgcggggtncggggaacngtaccgttnacctcgtaccacgtctacgacgcacgtaccgtagtacgttacgtaggtaagttacgttttagcgtttagtttaacttacggtgttacgacggtggaaccgggtcgggtacttaacggtcggtacccgtcgttaaccgtcgggttacgggggaccggggtaaaccgttagggtacggtaacggttaccggtaacgtacgggttagggtcggtcctacggtaccgtacgtaccgttccgttcggttccctttaccggtaacctttccccggtacccgtcccg

SEQ ID NO: 284850 - DNA, 635 bp, Homo sapiens
  misc_feature: GYAE6OF02I2JJH.14.57.F02.1.454.CMB.1.raw
  modified_base (365)..(365): a, c, t, g, unknown or other
  misc_feature (365)..(365): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcacgggccagtcagagtgtacaacaccaacttacgccttggtttcagcagaagcctggccaggctcccgaggcctctcatgtatgatgctactcccgacgacgggccaccggcactcccagcctaggttcagtggacaggcgggtcngggacacgtactcactctcgacctatcagcacgtcctagacgtctaggtaattagtttgacgttagttttacgttacttgtaccgaggacgacggtcggggtaactaaggttccggaccgtccgttccgtaccggttttacgggggaccgggggttaccgaagggtacgggtaacgttaaccggaaccggtacggttagggacggtccgttaggaccctaaccgtgttaccgttacgttcccttacgtaccgtttcccgttacccgtacc

SEQ ID NO: 284851 - DNA, 772 bp, Homo sapiens
  misc_feature: GYAE6OF02IU9V9.14.57.F02.1.454.CMB.1.raw
  modified_base (201)..(201): a, c, t, g, unknown or other
  misc_feature (201)..(201): n is a, c, g, or t
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (366)..(366): a, c, t, g, unknown or other
  misc_feature (366)..(366): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcaggccagtcagagtgtcaacaccaacttagcctggttnagcagaancctggccaggctccaggctcctcattagatggatgactactcccacacggggcccaccggcactaccccgagccgtagggttcaggtcggcacggcgggtacncggggacacgtacttacgactctacaccctatccgaagtccgacgtaccgtaacgacggttcgtaaggtaaacggttacttttagaaccgtttaagttttaactttacggttacggttaaccgaacgggtaccgtaaaggggtacccgggggtaacttaaaccgggttcgggtaccccggtaccgttacccggttaccgttttacccgggggggcccgggggggtaaaccgttaaaccggggggtttaggtaaaaccggggttttaaccgaaaaaccgggttaccgggttacggttaccggggtaccgttacggtaaccccggtaaccaaccggttttacggttaccggtttaccgtttaaccgttaacccgtttaccccttttacccccgggacccttaaccggg

SEQ ID NO: 284852 - DNA, 712 bp, Homo sapiens
  misc_feature: GYAE6OF02J041K.14.57.F02.1.454.CMB.1.raw
  modified_base (200)..(200): a, c, t, g, unknown or other
  misc_feature (200)..(200): n is a, c, g, or t
  modified_base (317)..(317): a, c, t, g, unknown or other
  misc_feature (317)..(317): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaattgtgttgacacagtctccactcaccctgtctttgtctccgagggaagngccacctctcctgcgagggccagtcagagtgtacaactaccaacttacgccgttggtttacaggactaagaacgcctcggaccgaggtcctacccgacgggtcttcccctgacgttntaacgtgaacgtgacctacctacccgacggaaccgggccctaaccgggcctaacctcccgacgtacccgtaacggttcgacggtcgggaccacgggtacgggccgttaggggacctacggtaccctaactccgtcaccgtactacgtccgacggtcacggtacctagtacgttacgtaaaggtacgttattttacgacgttaacgttttacttccgtataaccgtagacggaacgggtcggaacttaccggtcggcccgttcgtaccgtacgggttccgggggaacggttaacgagggtacggtacttaacgaacggtcgtgggtaccgtcggtactaccggtaccttaggtccgttacgtacgtttccacccgttcccgtacccgtcgttaacg

SEQ ID NO: 284853 - DNA, 733 bp, Homo sapiens
  misc_feature: GYAE6OF02IPMS5.14.57.F02.1.454.CMB.1.raw
  modified_base (178)..(178): a, c, t, g, unknown or other
  misc_feature (178)..(178): n is a, c, g, or t
  modified_base (619)..(619): a, c, t, g, unknown or other
  misc_feature (619)..(619): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctcttcttgtggctattttaaaagntgtccagtgtgaggtgcagctgttggagtccgggggagcttggtacgaggccggggggtccctgacactctcctgtcgcacgcctcgaggtactttctaatttttacggacgtaaatatcgcctagtgaggtccgttcgggtccccgaccgtacggccgtaccggaagggggaacggggtcgtaggggaggttcgggtactcgagactaatcgtaaggttcggttactaggtagtaagttactacgttcgaccgtccgttcctacggtacggacgggtccgtttccgcctacgtcctacgacgaacgtaacctaacgttaccgaaagtaacctacttaccttacttttaccttaactaaagttacgtaacgacgtaccgtaaggaaaacggaaccggaacgtaaccggtacgggttacgttaaggttttacgtttttaggngttaaacggaaacgttacgttaaacggtacgtaacgttacgtaaccgtaacctaaacccgtttaagggtttcgggtaacgggttcctttacggtagttcggtccggtaacgggg

SEQ ID NO: 284854 - DNA, 714 bp, Homo sapiens
  misc_feature: GYAE6OF02IMLFM.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttgggggggaactgctcagttaggacccagagggaaccatggaagccccagctcagcttctcttcctctgctactctggctcccagataccaccggagaaattgtgttgacacagtctccactcaccctgtctttgtctcgagggaagngccaccctctcctgcagggccagtcaggagttcgtacaacgaccaacgttacgccgttaggtttacagtcaagaacgtccgtggaccacggcctcccgaggtcctcctctagtcgtatgtagttcgacctactacccgacggacgggtacccaccggtcacctcccgacggtccgtaggttaccgaggtcggacgacgggtccgggtacgtacgggacctacggtaccgttcaaccgttcctacaaccgtactaccgacgtacgtacgtaccttacggacgttacgtaaggtaagtttacgttttacgactttaggtttaacttacgtcgttacgaacgccggtagggtaccgggtattaacggtccgggtcctaccgttacggtttaccgggttccgggggaacgggtaaccgttaagggtcgggtaaacgtacgaaacggtcggtcggtacggtcgtaccgacctaaccgtcttacgttcgttacttacgaccctttccgtaccctacgtcg

SEQ ID NO: 284855 - DNA, 595 bp, Homo sapiens
  misc_feature: GYAE6OF02H4JHH.14.57.F02.1.454.CMB.1.raw
  modified_base (201)..(202): a, c, t, g, unknown or other
  misc_feature (201)..(202): n is a, c, g, or t
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
tcagcgtctagtaccacgaccggtgctcgatttagctcgatatagttgggtttgggggaacgtgctcagttaggacccagagggaaccatggaagcccagctcagcttctcttcctcctgctactctggctcccagataccaccggataaattgtgttgacacagtctccactcgaccctgtctttgctccgaggggaaannccacctctctgcagggcctagtcagagtgtcaacacaaattgccttggttcagcaganctgcaggctccgngctcnatgtatgatgcactcccagaggcctacgcactccagccagtcagtcgnaggcggtcngggancgtacttgacttcganaccagtcagcctacgactagacggtctaggaaacgtagtttacgcgttaacgtttagttaacgtgttaccgagacgtacggtcgggactaaggttcggacccgtactacgtaccgttcggggtaaccgggggtacaaccggggtaggtaacgtaaccgtaacgaccggttagtcgggtcgtacgaccgtaccgtaagtccgttacgttcttacgtccttaccgtccccgtacgtaaccg

SEQ ID NO: 284856 - DNA, 681 bp, Homo sapiens
  misc_feature: GYAE6OF02GY85O.14.57.F02.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
  modified_base (651)..(651): a, c, t, g, unknown or other
  misc_feature (651)..(651): n is a, c, g, or t
tcagcgtctagtaccacgaccggtgctcgatttagctcgatatagttgggtttgggggggaactgctcagttaggacccagagggaaccatggaacgccccagctcagcttctcttcctcctgctactcgtggctccagactaccaccgggagaaattgtgttgacacagtctccactcacctgtctttgctcgagggaancgcctaccctntcctgcgacgggccagtcagacgtgtaccaacacctaacttgaccttggtttccagtcaggaagtccgtacggccgacggtccttacccggaggtcccttacccgtctagtccggtatcgtaacgtcggtaccactacccgaaccggtacggggcccaccgggtctacctccccggacgtaccgtacgggttccaaggggttcgcctagggccgggttacgtacgggaactacggtacctttccgaacttccgaccgtacactcggacncgtactcccgtaagtcgtccgttaaagacgtttnttaggaccgtttaagttaccgttaacgtcgttcgaaggtccggacgggtcggggtaacctagggttccgacgttccgtacgttacggtacggggcggtaaccgtaggtgacgttacgacgtgcggtgcgcactacncttgtcgtcttacgtactctccggattacg

SEQ ID NO: 284857 - DNA, 825 bp, Homo sapiens
  misc_feature: GYAE6OF02FENF6.14.57.F02.1.454.CMB.1.raw
tcagcgtctagtaccacgaccggtgctcgatttagctcgatatagttgggtttggggctgagagaggagcccagtcctgggatcttcagtgttttcattggtgatcaggactggacagagagaactcaccatggagtttggctgagttggctcttcttgtggctatttaaagatgtccagtgtgaggtgcagtctgttgggagtccgggggagcttggtaccgaggccggggggtcctgacacctctcctgtgcacgcctcgaggtattacgtatttttacgacgaacttacgtcgcctaagtcggacgtccgttcgggggttccccaccggtaacggtccgttaccgggaagggggtaaacgggggtcttaggggtacggttcggggtactaccgacgtacctaaacgtccgtaacggtttggttacgttaacgggtagggtaaacgttaacgtacgttaccggaccgtcccggttccgttccggtaacgggtaccggggttccccggttctacccgacttcccgacgtaacgaacgtaacctaaccgtttaacccgaaacgttaaaccctaccttacttttaacctttaccgttaactaaacgttccgggaacctcgtaccgtaaggtaaaaccgacggtaaacgtaccgggtacgggtacgttttacggttttaattttcggtaaggttaacgtaaagtacggtaacggtaacgttaacgttaagttaccggtaaactttaacccggttaagggtttccggggggtaaccgggtttaccccttttaggtaaccggtttcggttaccgggggtaaccccgggg

SEQ ID NO: 284858 - DNA, 695 bp, Homo sapiens
  misc_feature: GYAE6OF02GSAQ3.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaanagcccaccctctcctgcacgggccagtcagagtcgtcaaacacctaacttagccctggtttcagcagaagccgtggccaggctccccgaggcctccgtcatgtatgatcgactactcccacgacgggcccaccggcacgtaccccacgccgtaggttcaggtcggactgggccggggttcgaggggacaggtacttccgacgtcctcaccctatccgaacgcacgtcccgttaagcgttaccgtaaggtaacgtagttttcgacttaagttttacttacgttcgtacgtaggtccgaacggtcgggtacctaggttccggacccgttcgttccggtaccggtttcggggggaccgggggttaaaccgtaaggggttacgggtaccgttaacgaaccgggtaacgttgggtaaccggtcgttaccggacccgttaaccgtgttaccggtttagttacccttcccgttacgttttccccgttaccccggttaccc

SEQ ID NO: 284859 - DNA, 834 bp, Homo sapiens
  misc_feature: GYAE6OF02HV9K2.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccgaggggaaagagccaccctctccgtgcagggccagtcagagtgtcaacaccaacttagcctggtttcagcagagcctggaccaggctcccgaggctcctcatgtatgatcgctacgtccccacgacgggcccgaccggccaccgtccccaggccgtaggttccgacggtcggacgacgggtccggggttcgtaggggactaagtaccgtttaccgacttccctacctaacccgtactacgaacgtccgtaacgtaccccgttaaggtacggtttaccgtaagggttaaacggtttacgttttttacggccgtttaaacgttttttaaccgttttaaccgttacgggtttccgaaacggttcggaaccggggggtaccgggtaacggttaaagggttttcccgggaccccggttacccgtttaacccgggtttacccgggggttttaaccggggggggaccccgggggggttaaaaccggttaagggggtttaaccggggttaacggtttacccgggaaaaaccgtttaccggtacggggttaaccgggtccgttaaacccgtccgttaaacgtttcccgtttacggttaacccgttttccgaaacccgttttccccggtttacccccgacgtttaacccgg

SEQ ID NO: 284860 - DNA, 667 bp, Homo sapiens
  misc_feature: GYAE6OF02I8WNN.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttattttaaaagatgtccagtgtgaggtgcagctgtggagtccgggggagcttggtacaggccggggggtccctgaccactctcctgtgcagcctcaggattctattttagcgaatatgccatgagcgtcgggtccgccgaggctccggaaggggaagggctgggaggtgggtctacgagacaagtcaggtcggttctaaggtaggaacgtactacgttcggaccgtccgtccgtacccggttggaaaccggggtccctaagtttcccaaccctaacgtcccttacccgaaggtacgaacctaaaactttacccgaaaagaacccaaccgactaaaggttacttacttaaggaacctaaaactggaaaccctacggcccttagaaacggagtaccgtagggaacggtaaccgaccgggcttaggtatttaacgttccggtggttacgggaagtaacgagtagggtacgttcgaagtttcgtaggttacggtggttacggg

SEQ ID NO: 284861 - DNA, 652 bp, Homo sapiens
  misc_feature: GYAE6OF02HMO2V.14.57.F02.1.454.CMB.1.raw
  modified_base (204)..(204): a, c, t, g, unknown or other
  misc_feature (204)..(204): n is a, c, g, or t
  modified_base (354)..(354): a, c, t, g, unknown or other
  misc_feature (354)..(354): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagngcctaccctctcctgcacgggccagtcagagtgtcaacaccaacttacgccttggtttcagcagaagcctggccaggctcccaggctcctcatgtatgatgaccactcccacggcgggccccaccggcacctccccgagtcctaggttcnggtcggacacgggtccgggtcgtaggggacctaaggccgtttacaccgttccacctacctagtcaacgcaacgtccgtaagtaggttctaaggaatttagttttcgacgtttagtttaattcgtcgtacacgtcgacggggcggtaaccttaggttcgggccctacgttaccgtcgggtttaccggggaccggggtaccgagggttcgtaacgttaacggaacgtaacgtggtaacggcctacggacccaaccgtcgtttcgtacgtttcccttacgtaccgttttcccgtaccctcc

SEQ ID NO: 284862 - DNA, 911 bp, Homo sapiens
  misc_feature: GYAE6OF02F90N2.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctcttcttgtggctattttaaagatgtccagtgtgaggtgcagctgttggagtccgggggaggcgttggtacgaggcccggggggtccctggacacctctcctgtgcacgcctcgaggtattctaagttttttaggacgtaaattatcgtaccctagttcggtaacggtcggttaccgggggttccccccggacccgtaacggggtcccgttaccccgggaaacgggggggtaaacgggggggtcccgttaggggggtaacgggttacggggggtttccctaccggtaacgtaacgtaaacgttcggtaacgggtttacgggttttacgttaaacggggtttaacgggtaaacggttaaccggtttaacgtttacccggggtaacccggttcccccgttaacccggttaccccggggttagggaaacccggggggtttccccgggtttacccgttacccctaacgtttaccccgtacccgtaaacggtaaccggttaaacccgtaaaccgtttacccgaaaaaccggtaaccttaaccccgttaccgttttaacttttaccgttaaacgttaaaacgtcgggtaaacctaccggtaccgtaaacggtaaaacggaacgtaacggaaccggtacgggtccgtttaagtttacgtttttagacggtaagtaagtagtacgtaagttactacgtagtaacctaacccggttaaggtttgggaccgggtttccttagtacggttaccggtacgtaccggggg

SEQ ID NO: 284863 - DNA, 769 bp, Homo sapiens
  misc_feature: GYAE6OF02IZJ52.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagcctggtttcagcagaagcctggccaggctcccaggcctcctcatgtatggatgacactcccacgacgggacccaccgggcatccccagccgtagggttcaaggttcggcacggtccggggtcgttacgggggaactacggtacctttacgaccttaccgtaccaacccaacttccgaacgtccgtaacggacccgttaagggtacgtaccgttaaggtaaacggttattttttacggaccgtttaaaggtttttaaacgttaaccgttacggttaacgtacggtaccggtaaaggggtaccggggggtacctaaagggttttaccgggacccggtccgtttacccgtaacggggttttaccccggggggacggggggggtaaccccgtaaagggggttcggtaacgggtttaacccgaaaacgggtaccgttacgggtttcgggaccgttacggacctaaccgttaagttacccgttaggttcccttacgaacctttcccggttaccccggtacttaaccg

SEQ ID NO: 284864 - DNA, 717 bp, Homo sapiens
  misc_feature: GYAE6OF02G7DZF.14.57.F02.1.454.CMB.1.raw
  modified_base (367)..(367): a, c, t, g, unknown or other
  misc_feature (367)..(367): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttcttttcttgtggcttaatttttaaaagattgtccagtgtgaggtgcagcttggttggagggtccgggggaggtcgttggtacgacgggcccgggggggtcctggaccacgtctctgtgcgagcctcgaggtcttatattttagactaatatcgccatggacgtcggtacggggtcccgaccgtacggccgtaccggaaggggggaacgggnggtgggagggttcgggtcctcgagtactaagtcgtaggttcggtttacggtaagttagggaaacttacgtacgttcggaccgtccgtccgtacggtacggaccggggtcccgttcgtcctactccgtacgaacgtacgaactacgttaccaaagaacctcttaccttagtttacctacgtaaagtcgtaacacgtaccgtaagaaacggaacgtagaccgtaacgggtcgttatttacggtttgacgttaagaagttacgaacgttaacgtactaggtaactaaccgttaaccgttaaaggggttacgggtaacggtttacttacggtaagtccggtcgggtaaccgggg

SEQ ID NO: 284865 - DNA, 633 bp, Homo sapiens
  misc_feature: GYAE6OF02IWYKA.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctgctccagataccaccggagaaattgtgttgacacagtctccactcacctgtcttgtctccagggaagacgccaccctctcctgcgacgggccagtcagagtgtcaacaccaacttacgcctcggttcacgcaacgacgcctggccaggcctcccgaggcctccgtcagtgtactgactagacactcccgacgacgggtccaccggacactcccgaagtacccgtaggtttccgaggtacgccgtaacggcggggtagtacggggactaccggtacttcctaacgtcctacaccaatcaacgccacgtacgtagtactacgtagtaagtactttagtacgttaacgttatttacgttgtcgtaacgtcggtaggtaccgggtagacgtcggacccgtcgtcgtacgggtttcgggaccgggttaacggaggttacggacgtaacgacgtagtacggtaggtcgcgactacgtgtccgttcgtactcgtacgttcctaccgtaccg

SEQ ID NO: 284866 - DNA, 712 bp, Homo sapiens
  misc_feature: GYAE6OF02HR5T3.14.57.F02.1.454.CMB.1.raw
  modified_base (346)..(346): a, c, t, g, unknown or other
  misc_feature (346)..(346): n is a, c, g, or t
  modified_base (382)..(382): a, c, t, g, unknown or other
  misc_feature (382)..(382): n is a, c, g, or t
  modified_base (432)..(432): a, c, t, g, unknown or other
  misc_feature (432)..(432): n is a, c, g, or t
  modified_base (562)..(562): a, c, t, g, unknown or other
  misc_feature (562)..(562): n is a, c, g, or t
  modified_base (580)..(580): a, c, t, g, unknown or other
  misc_feature (580)..(580): n is a, c, g, or t
  modified_base (660)..(660): a, c, t, g, unknown or other
  misc_feature (660)..(660): n is a, c, g, or t
tcagcgtctagtaccacgaccggtgctcgatttagctcgatatagtttgggtttggggctgagagaggagcccagtcctgggatcttcaggtgttttctattttggtgatcaggactgaacagagagaactcaccatggagtttggctgaggttggcttcttttctttggtggtacttaatttttaaaaagacttgtaccagtgtgtaggtgcagtcttggttgggaggtccggggggaggtcgttagggtacgacggggtcccgggggggtccctacggactacttccgtacttggtcgcacggtcctcgaaggttacgtttacttagtttttacgacgttaaancttacggcctagttgacgtcggttacgggtcccacncgggcctaccggaaggggaacggtcggtaggtggttcgggtctcgaacgntaatacgtggttacggttacgtagggttacgaagttacgtaatccggtaccgtccctacgttcccggaaggtaccggggttcctttcgtaccagtcctacgacgtacgaactacgtacaacgaactcttntattactatagtcgaacncgtacgacgtaagaacgtacgacggtacgtcgttagttttacgttgtacgtaagtaagtacgtacgtagtaacgtacgtntaacgttaccgtaaggttacgggtacggtcttaccgtagtcgtaggtacggg

SEQ ID NO: 284867 - DNA, 719 bp, Homo sapiens
  misc_feature: GYAE6OF02IY87N.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggttcagcagaacgcctggccaggcctcccgaggcctcctcatgtatgatcgcactcccacgacgggccaccggccaactccccgagcccgtaggttcacggtcggcgacggcggggtactacggggacctacgtacttcgacttcctacgaccctatccgacgacgtacgtacccgtaaggacgtccgtaaggtaacgttacgttttcggacgtttaagttttaacgttaccgttggttacgtacgccgtacggggtaccggggtactaaaccggtttccgggacccgtcccgttaccggttaccggggttttaccgggggacccgggggggttaaccgtaaacgggggttacgggtaaccggttaaccgtaaaacggtaccggtacgggtcggtacgtccggtaactaacccgacgtttcgtccggttcttaccgtaccgttcccgttaccccgtccgttaaccg

SEQ ID NO: 284868 - DNA, 780 bp, Homo sapiens
  misc_feature: GYAE6OF02JAXBP.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttctgtggctatttaaagatgtcagtgtgaggtgcagctgttggagtccgggggagcttggtacaggccgggggtcctgacaccgtctcctgtgctacgcctgagtattcgtattttagacgtaatagtcgaccgagtgacggtcgtcgggtcccgacgacggtccgtaccggaggggacgggccgtaggacgggtggtcctcgacgtacgaagtcgtacggttcggttacgtaggtacggtaacgtacgttacgtaccggtaccgtccggttacgtccgggtaacgggtaccgggttcccggttacgttacccgtacgttaccgtaccggaagtaaccggtaaacctaacgttaacccgaaacgtaaccgtaaccttacgtttaacctttaacgtttacctaaaaggttccggtaacaccggtaccggttaaacgaaaacggtaaccggtaaacgtaaaccggtaccggggttacgttaaggttttacgttttcggtagggttaaaccgaaggtacgttaaacggtacgttaacgttaactaacggtaaccttaacccggttaagggttacggggtacggtttaacccttcggtaacgttacgggttacggttaacccgggg

SEQ ID NO: 284869 - DNA, 766 bp, Homo sapiens
  misc_feature: GYAE6OF02IT9WS.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaattgtgttgacacagtctccactccaccctgtctttgtctcgagggaagacgccaccctctcctgcgagggccagtcacgagtgtacaacacctaacttacgccgttcggtttacacgacaggtaacgccgtacgggaccgacggtccgttaccccgacgggccttccctacgacttaggtacgtgtatcgacctacgtaccccgaaccggaccggggacccgaacccgggaccacccgttaccccgaacggacccgttacgggttacccgacgggtacgggtaccgtacgggtccggggtacggtaccgggaacgtaccgttaccgttaccgctaccgtaccaccgtactacgaaccggcacggtacgtaacggttacgtacgtagtaaagttcggttttaaccgacgtttaacttttaacgttcgttaggacctacgaccggtagggaccgggttactaggttcccgggccgttccttacggtacccgggttacggggggacgggtaaaccgtagggtcggtaaacgttaccgaagtacgtgggtacgtcgtccgacgtaacgaccgtttcgttaccttaccggttacctaccgtaccccttccggataccgg

SEQ ID NO: 284870 - DNA, 667 bp, Homo sapiens
  misc_feature: GYAE6OF02ISS4Y.14.57.F02.1.454.CMB.1.raw
  modified_base (375)..(375): a, c, t, g, unknown or other
  misc_feature (375)..(375): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcactcccagacgggcccaccggcactccccagcccaggttcaggtggcgaggcgggtctgggacagacttcactcncacatcagcagaccctagacgtcgtagtaagtagttttcgacttagttttacttacgttgttacgagtcgtagggccggggtactaacggttcgggcccgtacgttaccgttaaccggttttccgggggaccggggggtaaaccggttaaggggtacgggtaacgttaaccgaaaaccggtacggttacgggtacgggtccggttaccgtacccgtaaccgtaacgtttccggttacgtttacccgtttaccgttaccggtttaccccgtttacccccggtaccttaaccgg

SEQ ID NO: 284871 - DNA, 778 bp, Homo sapiens
  misc_feature: GYAE6OF02GMYBM.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggcttaattttaaaagatgtccagtgtgaggtgcagcttggttgggacggtccggggggaggtcgtttgggtacgacgggcccgggggggttccctgacctacctcctccgtgtgcacgcctgaggtattctaatttttagacgaattatgacctatgacgtcgtcgggtcccgaccggaggccgtaccggaagggggaacgggccgtgggtacgggtgggtactcgaacgcgtaacgtacgtaggttaccggtttagtaggtaacgggtaaacttacgtaagttccggaaccggtcccgttccgttaccgggtacggaacggggttcccggtttcctccgtactccgtacgagaacgtaactaaccttacgaaacgtaactaccttacttacgtttacctacgtaaacgtcgaactacgtaccgtaaggaaaccgaacgaacggtaccggaacgggttacgttaagttttacgttttaggaacgtaaggtaaacgtacttaacggtacgtttaacgtaagttaaaccgtaacccgtttaacggttaagggtttaccgggggtaccgggtttaccctttacggtaacgggtttcggttaccgggtaaccggggg

SEQ ID NO: 284872 - DNA, 678 bp, Homo sapiens
  misc_feature: GYAE6OF02I9H1Q.14.57.F02.1.454.CMB.1.raw
  modified_base (203)..(203): a, c, t, g, unknown or other
  misc_feature (203)..(203): n is a, c, g, or t
  modified_base (393)..(393): a, c, t, g, unknown or other
  misc_feature (393)..(393): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagatacccaccggagaaattgtgttgacacagtctccactcaccctgtctttgtctccgaggggaaancgcccaccctctcctggccagggccagtcagagtgtaccaaactaccaacttcgccttggttcagtcaagaacgcctggccaggcctcccaggcctcctcatgtatgatgactactcccgacgacgggccaccggcactcccgagccgaggtcgaggtcggctaggcgggtctagggactagtacttacncttcacacacgtcacgcaacgtcctaggatctaaggaacttgttttacgcgtttaagtttacttacgtcgttaacgcgtacgagggtccggggtataacgggtttcggtccgtaccgtttacggtccgtttaccggggggaaccgggggtaaccttaaaggggtccgttaacgggttaacgtaaacggttacggtttggtacgggtaccttacggacccttaacggacgtttccggttaaccgtttcttaaccggacctttttccccggtaccccgtacgttacg

SEQ ID NO: 284873 - DNA, 733 bp, Homo sapiens
  misc_feature: GYAE6OF02J2V2N.14.57.F02.1.454.CMB.1.raw
  modified_base (267)..(267): a, c, t, g, unknown or other
  misc_feature (267)..(267): n is a, c, g, or t
  modified_base (523)..(523): a, c, t, g, unknown or other
  misc_feature (523)..(523): n is a, c, g, or t
  modified_base (578)..(578): a, c, t, g, unknown or other
  misc_feature (578)..(578): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggcttctttcttgtggtcttaattttaaaagatgtcagtgtgagtgcagctgttggagtccgggggagtcgttggtacgacgggccggggggtccctgacacctctccgtgcgccgngtccctagaggtactttcgttaagttttagacgtaatacgtggaccctagttaggacggtccgttacggggtcccgccgaacggttcccgaccgggaagggggtaacgggtcgtagggacggtttcgggtacgtccgacgtaacgtaacgtccgtaggttcggttcctaaggggttagaaacgttacgtcgttcccggtacgtcccgttcgtacggtaccggtacgggtcccttttcgacctactccgacgtaagngtaacctaacgttaccgaaactactcctacttacgtttaccaagaagtccggaanacccgtagtaaacgaaacggtacgaagtacccgtaagggttcttagttttacgttagtacgtaacgaagttaccgtaatacggtactaagtaacgtattaacccggtttaggttacggttaccggtccttttagacggttccggttaggaccggg

SEQ ID NO: 284874 - DNA, 312 bp, Homo sapiens
  misc_feature: GYAE6OF02I6O3Y.14.57.F02.1.454.CMB.1.raw
  modified_base (128)..(128): a, c, t, g, unknown or other
  misc_feature (128)..(128): n is a, c, g, or t
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
  modified_base (217)..(217): a, c, t, g, unknown or other
  misc_feature (217)..(217): n is a, c, g, or t
  modified_base (251)..(312): a, c, t, g, unknown or other
  misc_feature (251)..(312): n is a, c, g, or t
tcagcgtctagtaccacgaccggtgctcgatttagctcgatatagttgggtttggggagaactgctcagttaggacccagagggaaccatggaagccccagctcagcttctcttcctcctgctactcngctcccagataccaccggganaaattgtgttgacacagtcctccactcaccctgtctttgctccgaggggaaangcccacccttctccngcgaggcagtcagtgtcacaacacctaacttcgnnnnnnnnnnnnnnnnnnnnnnnnnnnnnnnnnnnnnnnnnnnnnnnnnnnnnnnnnnnnnn

SEQ ID NO: 284875 - DNA, 673 bp, Homo sapiens
  misc_feature: GYAE6OF02IROLM.14.57.F02.1.454.CMB.1.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (450)..(450): a, c, t, g, unknown or other
  misc_feature (450)..(450): n is a, c, g, or t
  modified_base (624)..(624): a, c, t, g, unknown or other
  misc_feature (624)..(624): n is a, c, g, or t
tcagcgtctagtaccacgaccggtgctcgatttagctcgatatagttgggtttggggggaactgctcagttaggacccagagggaaccatggaagccccagctcagctttctcttcctcctgctacctctggctcccagatacccaccgggaagaaattgtgttgacacagtcctccactccaccctgttctttgtcctccgtaggggaaagcgcccaccctcctcctgcgacggccagtccaggagtgtacaacaccaacttacgtccgttggttccagactacgaacgccgtggaccacggcctcccgagtccgttccnctatgtacngtactcgctaccaccgacggaccggggacccgaccggtacacctccccgacggtcccgtaggtaccgtacgggtcggtacacgggtacgggtcgtagggaccagtccctacgtcttaccnccactacgtcgacgtcgaaccgcttaacggaactcgtaagtacgttagtttgacgtttatttactacgttgtacgtacgcgtaggaggtctaaggtcggtacctaccggttacgtcgggttacgggggcgggtaaccggtaggtacggtactaacgaaccgtagtgtaccgggnttaaccgcaacttcgtacgtctttactacctcctccgtcccgtactcgg

SEQ ID NO: 284876 - DNA, 702 bp, Homo sapiens
  misc_feature: GYAE6OF02GP5BO.14.57.F02.1.454.CMB.1.raw
  modified_base (274)..(274): a, c, t, g, unknown or other
  misc_feature (274)..(274): n is a, c, g, or t
tcagcgtctagtaccacgaccggtgctcgatttagctcgatatagttgggtttggggtcgtgagagaggagcccagtcctgggatcttcaggtgtttctatttggtgatcaggactgaacagagagaactcaccatggagtttgggctgagttggcgtcttcttgtggtctattttaaagatgtccagtgtgaggtgcagctgtggagtcgggggagcgttggtacaggccggggggtccctaggacgactcgtcctgtagcctagcctgaggntctattttagcgtaagttactgcctaagtggactcgtcgggttccgccgaggtccttacccgaaggggaacgggggccttggggaagttcggggttctaccgtagggtccaaagtccgtaaggtggtttacgtaaggtggaaacgtacgtaatttccggaacgtcccgtcgttaccggtcgggaacgggtcccggtttactcccgtagtcctaccgaagtcgtaaacctaagtttaccccgaaagtaaacccgacttacttaacgtttcttaaccaaagttcggaacacggtccctaaggaaacgtacgtaacgaactacggggacttgttaacttttggagttagaaacgttataacggaagttaccgatcggtaactaaccgtaacgtttaggggacgttccttagtagttccggtagtaccgggg

SEQ ID NO: 284877 - DNA, 812 bp, Homo sapiens
  misc_feature: GYAE6OF02I5O7R.14.57.F02.1.454.CMB.1.raw
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagcgtctagtaccacgaccggtgctcgatttagctcgatatagttgggtttggggctgagagaggagcccagtcctggggatcgttcaggtgttttcatttggtgatcaggactggacagagagaacctcaccatggagtttgggctgagttggctctttctgtggctatttaaagatgtccagtgtgaggtgcagctggttaggaggtccgggggaggcgttgggtacgagggcccggggggtaccctgaccgactcctcctagtgacagtcctcgaggtattctattttagngtaatncgaccatgacgcgtcgggtcccgccgagggcctaccggaggggaacggggtcgtaggggtacggtggggttcctcgacgacgtaacgtcgaggtttacggttacgtaacgggttaggtaacgtaacgtaacgttacggacccggtacccggttccgttacccgggttacggggtaaccggggttccccgggtttacctccaccgtttacccgtaccgtaacggaacgtaccgttaaaccttacccgtaaaagaacccttaaccttacctttacgtttaccgttaactaacggttacggaacctacggtaccgaaacggaaaacgaccgtaaacggaccggtaccgggtagtttacgttttacgttttaggtaacggtaagtaaacggttacgtaaggtaacgttacgttaaggtaacgttaaaccgtttaaccccgttaagggttttaccgggggtacccggggttacgtttttacccgaaggtttacggttacccggtaacccgggggg

SEQ ID NO: 284878 - DNA, 716 bp, Homo sapiens
  misc_feature: GYAE6OF02HHAF0.14.57.F02.1.454.CMB.1.raw
  modified_base (275)..(275): a, c, t, g, unknown or other
  misc_feature (275)..(275): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggctaattttaaaagatgtcagtgtgaggtgcagctggttggaggtccgggggagtcgttggtacgagggcccggggggtcctgacactctccgtgtgcagcctcgagtnttctattttacgcgtaatatcgctagtgagcgtcggtccgccgacggccgtacggaaggggacggggtctaggggtacggttcggggtctccgagccgaaagtccgtaaggttggttacggtaggtacggaagtacgtacgttccgaccggtcccgtccgtaccggtagggaccgggttcccgtctccatcccgtacgaacggtaacgactaacttaaccgaaactaacctacttaacttatttacctaacgtaaactcgggaactacgtaaccgtaacgaaaagggaaccgaaacggaccggtaacgggtacgttgtttaagttcggttaggtaacgtaaagtactaaggtaacttacggtaacgttactaacggttaaccgttaaagggtttcggggttaacggtaccttttaggaaccgttgggttaccggtacgggg

SEQ ID NO: 284879 - DNA, 811 bp, Homo sapiens
  misc_feature: GYAE6OF02HJB0W.14.57.F02.1.454.CMB.1.raw
  modified_base (200)..(200): a, c, t, g, unknown or other
  misc_feature (200)..(200): n is a, c, g, or t
tcagcgtctagtaccacgaccggtgctcgatttagctcgatatagttgggtttggggctgagagaggagcccagtcctgggatcttcaggcgttttcatttggtgatcaggactgaacagagagaactcaccatggagtttgggctgagttggcttcttttcttgtggcttattttaaaagatgtccagtgtgagtgcanctgttggaggtccgggggagcgttggtacgacgggtccgggggggtccctgacactctccgtgtgcagcctcaggtacttctagtttttagcgtaatatgcccagttgacgtccgtacggggtcccgccgacggtccgtaccggaagggggacggggtcgttaggggtacgggttacgggtccgttaccgagggtaacctaaaggttccgtaaggggtttcggttaacgttaaggtacgggtaaacgttaacctaagtttaccggacccggttacccgttcccggttacccggtacggtaaaccgggggtttcccggtttcctacccgtacttccgtaccgaacgtacggtaaacctaaccttaacgaaacgtaacctaactttacttactttaccgttaaccttaaggtccgtaaacgtccgtaacccgttaaaggaaacgtaacggtaacggaaccgttacggggtaacgtttgttttaacgttttaggtaggttaaacgtaaggtacgtaacgggtaatttacgtaagtttacggtaaccttaaaccgtttacgggttacggggttaaccggttacctttacggtattccgggttccggtaacggggg

SEQ ID NO: 284880 - DNA, 711 bp, Homo sapiens
  misc_feature: GYAE6OF02F140Z.14.57.F02.1.454.CMB.1.raw
  modified_base (202)..(202): a, c, t, g, unknown or other
  misc_feature (202)..(202): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtcttgtctccgaggggaaanagccaccctctcctgcagggccagtcagagtgtacaacaccaacttagccttggttcagcagaagcctggccaggcctcccgaggcctcctcatgtatgatgcactccccagacgggccaccggcactcccgagcccgtaggttccaggtcggctacgggcgggtctacggggactacggtaccttcgacttccgtaccacccgtatccgaacggccaaccggtacccgttaacggtacgttacgtaggtaaacgttagttttacggtacgtttaagttttactttacgttacgtacgtacggtacgacgggtcggggtacgttaacggtttccggacccggtcgttaccgttaccgggttttccgggggaccggggggtaacccgtaaggggttacgggtaacggttaaccgtaaacggtacggttcgggtacggtaccgttacggtaccctaccgtacggttccgttcggttacccttacgtacccgtttcccgttacccgtacccg

SEQ ID NO: 284881 - DNA, 578 bp, Homo sapiens
  misc_feature: GYAE6OF02FJSGL.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaanagccaccctctcctgcagggccagtcagagtgtcaacaccaacttagccttggtttcagcagaagcctggccaggcctcccaggcctcctcatgtatgatgcatccccagcgggccaccggcactcccgagcctaggttcaggtcggcaggcgggtctgggactaggtacttcacttcctacacctatccagccagcctagacgtctagaagttatttcgacttagtttattacttgtcagtcgtagggcgggtactaagttcggaccgtcgtacgtacggtttccggggacggggtaccgaagggtggtacgtacgaacggtagtggtggtctgaccactcgttcgtcgtcttacctcgttccctccgtacctacg

SEQ ID NO: 284882 - DNA, 847 bp, Homo sapiens
  misc_feature: GYAE6OF02GZD28.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctgtggaggtccgggggaggcgttggtacgacgggtcccggggggtccctgaccactcctcctgtgcagcctcgaggattctatttttagcgtaatatgccctatgagcgtcgggtcccgccgaggcctaccgaggggaacggggcgtgggaggtgggtctcgagcaatcgaggttcggttctaggttaggaagtactagttccggaccggtccgttccgttcccggtagggtaaccggggtcccggtttacccgtcccgtacgttccctccgtaaacggtacgtaacctaaaccgttaaccgaaacgtaacctaacccgttcctttaaacttttacctttaaccgtaaaacgttacgggtaaccctacgtaacccggttacggaaaaaccgggtaaccggaaaacggtaccccgggtaacggggttaccggtttaaggtttttaccgtttttttaggtaacggggtttaacggtaaaacggttaacgttaaaccgggttaaacggtttaacctttaacggttaacggttaaaccctttaaaccccgggtttaaaacgggttttttacgggggggtaacccggggtttttaccccttttaaccgggtttaacggttccgggttttacccggggttaaccccggggggg

SEQ ID NO: 284883 - DNA, 297 bp, Homo sapiens
  misc_feature: GYAE6OF02IPF61.14.57.F02.1.454.CMB.1.raw
  modified_base (289)..(297): a, c, t, g, unknown or other
  misc_feature (289)..(297): n is a, c, g, or t
tcagcgtctagtaccacgaccggtgctcgatttagctcgatatagttgggtttggggggccaccggcatcccagccaggttcagtggcagcgggtctgggacagacttcactctcaccatcagcagcctagagtctgaagattttgcagtttattactgtcagcagcgggcaattggccgctcacttcggcgggggaccaaggtggagtcaaacgaactgtgctgcaccatctgtctcatcctccgcatctgagtactaacgctgagcgggctggcaaggcgacatagnnnnnnnnn

SEQ ID NO: 284884 - DNA, 740 bp, Homo sapiens
  misc_feature: GYAE6OF02GGI3Y.14.57.F02.1.454.CMB.1.raw
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcacgggccagtcagagtgtacaacaccaacttagcctggtttcagcagaacgcctggccacggcctcccgaggcctcctcatgtaatgagtgacacctccacgacggcccaccggcactcccgacgtccgtaaggttcgagtcggacgacggcgggtccgtacgggaccacggtaccttcgaccgttcctaccgaacctattacccgaacggacccacggtaacccgttaggaacggtccgttaaggtaaacgtttagttttacggaacgtttaaacgtttttaacgtttacgttacggttacgaacggtccggtaacgggtaccggggggtaactaacgggtttaccgggacccggttaccgttacccgttaacggggtttcccggggggaacccgggggggttaacccgtaaagggttccggtaaacgttaaacccggtaaaccggttacgtcgggtacggtcggtacgacccgtaacgtacgttcgttccgttctaccgtaccttccgttacccgactac

SEQ ID NO: 284885 - DNA, 752 bp, Homo sapiens
  misc_feature: GYAE6OF02G6HAT.14.57.F02.1.454.CMB.1.raw
  modified_base (176)..(176): a, c, t, g, unknown or other
  misc_feature (176)..(176): n is a, c, g, or t
  modified_base (260)..(260): a, c, t, g, unknown or other
  misc_feature (260)..(260): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtgctatttaaagntgtccagtgtgaggtgcagctagttggagtccgggggagtcttggtacgaggtccggggggtccctagacacgtctctgtgacncgtcctcgaggtattcttattttagacgtaatatcgccatggacgtcggtcgggtcccgacgtacggccgtaccggaaggggaacgggtcgtgggtacggtgggtcgtacgacgactaaagtcgtaggtcgtttacgtaggtaggtaaacgtactacggttcgaaccggtccgttaccgtaccgtagggtaccggtccggttacctcctacgttccctacaacggtacaaccttaactaccgaaacgtacttaaccttactttaacgtttcttaaacgaagttacggactaacgtaccgtaagaaaacgaacggaacgtaaccggtacccgggttagttaggttttaacgtttaggttaggtaaacgtaaaggttaccgtaaacggttaacgtaacgttaacgtacgtaaacccgttaaccggtttaaagggtttacggggtaaccggggtttaacccttaggtaccgttacgggttaccggtaaccggggg

SEQ ID NO: 284886 - DNA, 894 bp, Homo sapiens
  misc_feature: GYAE6OF02GF9UT.14.57.F02.1.454.CMB.1.raw
tcagcgtctagtaccacgaccggtgctcgatttagctcgatatagttgggtttggggctgagagagggacgcccagtccgtgggatcttcaggttgttttcatttggtgatcaggactgaacagagagaactcaccatggagtttgggctgagttggcttcttttcttggtggtcttaattttaaaagatcgtccagtgtgaggtgcagctgttggaggtccgggggaggtcgttggtacgacgggcccggggggtcctgaccacgtctccgtgtgcacgcctcgaggtattcttatttttagacgtaatatcgacctagtgagtcgtcgggtcccgccgacggcctaccggaaggggaggggcgtagggtggttgggtctacgacgacaacgtcgaggtttcgttacgtaggtaggaaacgtacgtacgttccggaccgtcccggtttacccgtaccggtacggggtaaccggggttccccggttttcctacccgtaaccgtttcccgtaacccgaaacgggtaacgtaaacccgttaaacgtttaaccccgaaaaacgtaaaccccttaccgttttaaccgttttaacttttttaaacccgttaaactaaaaacggtttccgggtaaacctaaccggttaacccgttaaaagggaaaaaccggtaaaccgggaaaaccgtaacccgggttaaaccggggttaccggtttttaagttttaacggttttttttcgggtaacggttaaaggttaaaaacgggttaacgttaaccggttaaacgttaaccgtttaaggtaacgttaacccgttaaaacccgtttaagggttttacgggggaaccggggttttaccccttttaggaacggttttccgggtacggttaacccgggggg

SEQ ID NO: 284887 - DNA, 684 bp, Homo sapiens
  misc_feature: GYAE6OF02HD9MD.14.57.F02.1.454.CMB.1.raw
  modified_base (203)..(203): a, c, t, g, unknown or other
  misc_feature (203)..(203): n is a, c, g, or t
  modified_base (367)..(367): a, c, t, g, unknown or other
  misc_feature (367)..(367): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaattgtgttgacacagtctccactccaccctgtctttgtctcgaggggaaancgccacctctcctgcgacgggccagtcaggagtcgtacaacacctaacttacgcttggtttacacgacaggacgccgttggccaggtcctaccgaggtcctacctcgattcgtattacgacttcgactactacccgacggaccgggcccaaccggcactacccngtccgtaggttcgacgtcgacgacggtcggtacgcgggaactacgtacgtctaccgtctaccacgancgacncgacgtcacgtcgtataaggtagttagttcgtacgtttagtttacttacgtcgtacgtacggtacggcgggtacgggtacgtacggttcggacctaccgttcggggtccggttacgggggaacccggggtaaggttacgggaccgttaacggaccgttaaacgtcggtcgggtaccggtgtacccgtacgtaaccgttcgttaccgttcgttacccgtattcccggtacccgttcccagttaccg

SEQ ID NO: 284888 - DNA, 699 bp, Homo sapiens
  misc_feature: GYAE6OF02G10D1.14.57.F02.1.454.CMB.1.raw
  modified_base (201)..(201): a, c, t, g, unknown or other
  misc_feature (201)..(201): n is a, c, g, or t
  modified_base (269)..(269): a, c, t, g, unknown or other
  misc_feature (269)..(269): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctccagataccacggagaaattgtgttgacacagtctccactcaccctgtctttgtctccgaaggggaaanagcccaccctctcctgcagggccagtcagagtgtcaacaccaacttagccttggttccagcaggaacncctggccaggcctcccgaggcctcctcagtgtatgaatgactacgtccccacggaccggccgaaccggctacgtcccgagccgtaggttccaggtcggacgcggtccggtcgtaggggacctacggtaccttcgaaccgttctacccgtaaccgacgtaccgacgaccgtacgaccgttaaagtcgttacgtaaggtaacgtttacgttttagtaccgtttaaggtttttaaccttacgttacggtacgtaacggccggtaacgggaccggggttactaacggttccggaccgttaccgttaccggtaccgggtttcgggggaaccgggggtaccgtaaggggttacgtaaaccgttacgaaacgttacgtgtcggtacgtcgtactaacgacgtcgttacgtcttactccgttaccgtcccgacttcgg

SEQ ID NO: 284889 - DNA, 819 bp, Homo sapiens
  misc_feature: GYAE6OF02FOX39.14.57.F02.1.454.CMB.1.raw
  modified_base (206)..(206): a, c, t, g, unknown or other
  misc_feature (206)..(206): n is a, c, g, or t
  modified_base (443)..(443): a, c, t, g, unknown or other
  misc_feature (443)..(443): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggnggtccgggggagcgttggtacgaggccggggggtcctgacactctcctgtgcagcctcaggtattctatttttagcgaattatgcctatgagcgtcggggtcccgccgacggcctaccggaaggggaaggggccgtgggagggttgggtcctcgagactaatcgaggttggttacgtaggtaggaagtactagttacggacgtccgtcgtcccggtaggaacgggggtcccgtttcnccgtacgttccgtccgtaacgacggtaactaaacgtttaccgaaaacgtaaacctaccgttacctttaactttttacctaacgttaaaagtaccggggtaacctacggtaccgttaacgggaaaaacgtaacccgggaaagtaaccgggaaccgggggttacgtttacgggttttaagtttttttccgggtaaaaaggttacgggtaaaaacgttacggttaaaaccggtaaacggtttaccgttaaacggttacggttaaaacccgtttaaccccgggttaaaaggttttttccgggggggggaaaccgggggtttttcccccttttaaccgggtaaccggttttaccgggttccggggtttaacccgggggggg

SEQ ID NO: 284890 - DNA, 753 bp, Homo sapiens
  misc_feature: GYAE6OF02GMTJ8.14.57.F02.1.454.CMB.1.raw
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (408)..(408): a, c, t, g, unknown or other
  misc_feature (408)..(408): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggcctccagataccacggagaattgtgttgacacagtctccactcacctgtctttgctcgagggaaancnccacctctcctgcgagggccagtacagtagtgtaccaaactccaattagcccttggtttccagcaaggacgtccgtggcccgaaggccctcccgaacgggtccttacccgtcacgtagttactgacgttgacctaccaccccgacggacgggaccccgaccggacctacgtacccacgacgtaacggttcgaaggtcggacgtaacgggngggtacgtcgggactacggtacttccactcgacctaccacgttacgacgtacgaacgccgttaaggtacgtcgtaagtaagtttaacgtttagtacgtttaagtttacgttacgttaacggttgtaacgtacgggtaccggtacgggtaccgtaaccgggttccggtaccgttccgttaacgggttccgggtttacccggggtaaccggggtaccgggtaacgggtacggttaaccggttaaccggaaacgttacggtacggttcggtaccgtacgtaccgtaaccggtaccgttacgttacgtttaccgttacctaccgttcccgttacccgttcgttaaccgg

SEQ ID NO: 284891 - DNA, 827 bp, Homo sapiens
  misc_feature: GYAE6OF02HS04B.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttggggtttggggggaactgctcagttaggacccagagggaaccatggaagccccagctcagcttctcttcctccttgctactctggcctccagataccaccgggagaaattgtcgttgacacagtctccactcaccctgtcttgtctccaggggaanagccacctcgccgtgcgagggcctagtcaacgagttacgtaccaaactacctaactttaacgccgttggttttaccaggtaccaagggtaaactccgtacgggtacccgaaagggtccccgttaccgaaaccggggtccttacccggttaactaacgtacgttagtaaccgagttcgaaccaccgttcccgaaacgaccggggtcccgtaaccggccgtacgttaccccaaggtcccgtagggtcccaagggtcggtccgaacggtcgggggtacggttaacggggactacgggtaaccctttacgaacccttctaccccgaaaccgttaccggtaccaaaaggcccgtaacgttaccgaaagtacggttacgttaacgtaacggttaagtttttcggaaacgttagggttttaacttacggttacgttaaccgtaccgacgggtacgggtacggtaacgacggttcgacccggtacgttacgttacggttcggggacccgggtaacggtaagggacggtaaggttaaccgtaaacggtacggtaggttaacgtacgtccgtacgtaaccgtaacgtttcgtaacggtctttaccgtacctttacccgtacccgtacgtaaccg

SEQ ID NO: 284892 - DNA, 550 bp, Homo sapiens
  misc_feature: GYAE6OF02FIM6V.14.57.F02.1.454.CMB.1.raw
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
  modified_base (433)..(433): a, c, t, g, unknown or other
  misc_feature (433)..(433): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttacgcctggtttcagcagaagcctggccaggctcccgaggctcctnatgtatgatgcatcccanagggccaccggcactcccagccaggttcagtgcagcgggtcnggacngtactnactcncaccntcgagcagcctagacgtctagaagtntttgactagttattactgtacagcaggcgggtanaagttcggcctctcgtacgttcgggacgggggtaacaagggtcgtagtaccgaagacgtggtcggtacgtcgaccgaccgagttcgttcgttccttactacttacccgttcccgtac

SEQ ID NO: 284893 - DNA, 801 bp, Homo sapiens
  misc_feature: GYAE6OF02IP44V.14.57.F02.1.454.CMB.1.raw
  modified_base (208)..(208): a, c, t, g, unknown or other
  misc_feature (208)..(208): n is a, c, g, or t
tcagcgtctagtaccacgaccggtgctcgatttagctcgatatagttgggtttggggctgagagaggagcccagtcctgggatcttcaggttgttttcatttggtgatcaggactgaacagagagaactcaccatggtagtttgggctgagttggcttctttcttggtggtctaattttaaaagtatgtcctagtgtgaggtgcagtntggtgggagggtccgggggagtcgttgggtacgacgggcccggggggtcctcggaccacgttccgtccgtggtcgcgtacgtccgtacgacggtacttttacgttagttttacggactaaagtacgtcgcctagtggacgtcggttccgggtcccgtaccgtacggtccgtccgggaaaggggacggggtcgtacgggtagggtcgggttacctacggacgtactaacgtcggtaaggtttcggttacgtaaggggtacggtaacttacgtacgttccggaccgtacccggttccgtaccgggtacgggtaccgggtcccgttcctaccgtctccgtaccgaagtaaccgtaacctaactaccgaaactaaccttaaccgttacttactttacctataaaccgtcgactacggacctaacggtaaacgaacgtaacggaccgtacgggtacttaggttttcgtttagtacgttaaagtaaccgttaagtaacggttaacggtcttaaggtaacttaaccggttaccggtttaacggggttacgggttaccggttacccgtttaggtaacggtttcgggtacggtaaccggggg

SEQ ID NO: 284894 - DNA, 822 bp, Homo sapiens
  misc_feature: GYAE6OF02I5ECM.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttgggggggaactgctcagttaggacccagagggaaccatggaagccccagctcagcttctcttctcctgctactctggctcccagatacccacgggagaaattgtgttgacacagtctccactcacctgtctttgtctccgaggggtaaancgccaccctctcctgcacgggccagtcagtacgtgtacaaccacctaacttacggccgttagtttccagtcagaacgtcctgggaccctagggtcccttacccgacgggtcccttcccgtacgtacttcggttaagtacgtaacgtacggtaccctaaccggtcccccgtaacggaaccggggtaccccgtaaccccgggtaccaacccgttaccccgaacgggggtacccctttaacgggggtttacccctaacggggttccgggtaaccgtaacggggttccccgggggttacggttaacgggggaaccttaacggtacccccgttttaccgacccgtttaccgtaacccgtaaacccgtacgtttaacccggaccggttaccgaaccgtacccggtaagtaccggttaccgttaacgggtaacgttactttacggtacgtttacgtttaaacttacggtcgtacgtacgacggtacgggacggtacctaacggttcggccgtctaccggtcggtttcgggacgggtacgtaggtacgtagtacgaacgtcgtggcgtccgtacacgtaccttacgtacgtttcgtacctacgtaccgtttccctccggtacctcgg

SEQ ID NO: 284895 - DNA, 784 bp, Homo sapiens
  misc_feature: GYAE6OF02JTFG6.14.57.F02.1.454.CMB.1.raw
  modified_base (179)..(179): a, c, t, g, unknown or other
  misc_feature (179)..(179): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagntgtccagtgtgaggtgcagctgttggaggtccgggggagtcgttggtacgacgggtccggggggtccctgaccactctcctgtcgtacacgcctcgaggtacttcgttagtttttacggagtaacttactcgacctagtcgagtccgttcgggtcccgccgtaggtcctaccggagggggtaacgggtcgtcgggtaggttcgggtcctacgacggactaacgtgtaacggttcggttacgtaaggtaacgggtaacgttaactacggttaccggaaccggtccggttaccgttaccgggtacgggtaacccggggtcccggttttactacccgtacgtttacccgtacccggtaaaggtaaccgtaaaccttaaacgttaccgaaaacgtaacccgttaactttacctttaacggtttcttaaaccgtaaggtccggtaactaaccgggtaccttaaacggaaaacggtaaccggaacgtaccgggccggttaacgttagtttaacgtttcggaagtaagtaagtacgtaacgtacttggtaagttactaacgtaacctagggttcgggtacgttccgttaatacgttcgggtacgtaccgggg

SEQ ID NO: 284896 - DNA, 692 bp, Homo sapiens
  misc_feature: GYAE6OF02I1H3Z.14.57.F02.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggctaattttaaaagatgtccagtgtgaggtgcagctgttggacggtccgggggagcgttggtacnggtccggggggcccngacactctcctgtncncgcctcgagattctacttttagactaatagcgcagtagtacgcgtcgggtcccgaccgacggtcctaccgggaagggaaggggccgttagggaggttcgggtactacgaagactaagtcgtaaggtgtttaccgtaaggtacggaagttaactacgttaacggaccgtaccgtactcccggtaagggtacgggtcccgtttcctacctacttccgtaccaacgtacgtaactaacttaaccgaaactaacctaacttacttcgttttaaccttaagtaaagtccgaaacgacacgttaagaaaacgtagaaacgacgtacggagtttcgttagtttacgtagtaagaagtagtaacgtaagtacttacgtaagtaacgttaaccttaaggtttcgggtaacggttaccttatacggtacgttagggaccggg

SEQ ID NO: 284897 - DNA, 681 bp, Homo sapiens
  misc_feature: GYAE6OF02GPVY4.14.57.F02.1.454.CMB.1.raw
  modified_base (286)..(286): a, c, t, g, unknown or other
  misc_feature (286)..(286): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagagccaccctctcctgcacgggccagtcagagtgtcaacacaacttacgcctgttcagcagacgctgccaggcctccaggcctctnatgtatgatgcactccacgacggccacgcactccgacgtccgtaggttcaggttcggaccacgggtcggtcgtacggggaccaaggtaccgttcaacttccgtactaaccctatacgacgacgacgtaccgaagtacgtacgtagaacgtttagtttacgacgtttagtttaactagttacgtacgtaacgtcggtaggtcgggtacgtaacgttccgggccgtaccgttccggtaaccgggtttccgggggaaccgggggtaacgtaacggggtacggtaacgttaaccgtaaacggtacgttacgggtacggtaccggtaccggacgtaaccggtacgttcggttaccgttacctttacggtaacccgtttcccgttacccgaccttaaccgg

SEQ ID NO: 284898 - DNA, 863 bp, Homo sapiens
  misc_feature: GYAE6OF02GQB6X.14.57.F02.1.454.CMB.1.raw
  modified_base (199)..(199): a, c, t, g, unknown or other
  misc_feature (199)..(199): n is a, c, g, or t
tcagcgtctagtaccacgaccggtgctcgatttagctcgatatagttgggtttggggggaactgctcagttaggacccagagggaaccatggaagcccagctcagcttctcttcctcctgctactctggctccagataccaccggagaaattgtgttgacacagtctccactcaccctgtctttgtctccgagggaaancgccaccctctcctgcgaggccagtcagagtcgtacaacacctaacttacgccttggtttcagcagaacgcctggccgaggtcctccgaggtcctcctcagtgtatcgatcgactactccgacgtaccgggcccgacggacctacctcccgacgtaccgtcggttcgacggttcggaccggtacgggtccggggtcgtaacggggtacctaacggtttacgttaccgtacttccgtaccacctaacgtaccgactaccgaacgttacccgttaaaggtacgggttaaccgttaacgggttaaacgtttagtttttacgtaacgttttaaacgttttttaaccgttacgttacggtttaaacgacggttaccgggtaaaccgggtacggggtaacgttaccggttaccgggtacccttccggtttaccgggtaacccgggggtttttcccgggggggaaccgggggtaaaccgggttaaccgggggttaggtttaaccggggtttaaaacccgtaaacccgggttagggttacgggttaaccgggtccggtttaacccggacccgtaaaccccggtttaagtttcccccggttttaaccggtttaaccgtttttacccggttcccttttaaacccccggggtttacccttacccgttaacccggg

SEQ ID NO: 284899 - DNA, 1064 bp, Homo sapiens
  misc_feature: GYAE6OF02H8VSO.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaaccatggagtttgggctgagttggctctttcttgtggtcttaattttaaaagatgtccagtgtgaggtgcagcgttggttgggacgggtccggggggaggtcgttagggtacgacgggcccggggggtccctgacacctctcctgtcgcacgcctacgtaggtactttacgtttagttttaaggacgtaaattactacgacctagtacggacggtccggttacggggtaccccggccgtaacgggtcccgtaccggggaaggggggtaacggggtccggttagggggtacgggtttcggggttaccgtaccggtacggaacgtaacggtaccggttacgggttacgggttttaaccggttaagggttaacggggtaaacggttaaaccggtttaacggtttacccgggaacccgggttacccccgggtttccggttaaccccgggggtttacgggggtaaaccccggggggttcccccggtttttacccggttaaccccgttacgttacccccgggttaaccggaaacggttaaccggtaaaccctttaaaccggttaaccgaaaaaccgtaaacccttttacctttaacgttttaaccgtttttacccgttaaaacgtaaaccgggtttaccggaaaaccccgtacgggtaaacccgtaaaggggtaaaaacccggtaaaccggggtaaaccggacccggggtttaaacccggggtttgggttttttaaacgggtttttaagggtttttttacggaaacggggtttaaaaggttaaaaccgggtttaaccgttaaggggtttaaacccgttggtttaaaaccggttacccgttaaaccccggtttaaacccgggttaaggggtttttcccgggggggtaaaccgttttcccttttaagggtacccgtttccggggtaggggttaccccggggg

SEQ ID NO: 284900 - DNA, 746 bp, Homo sapiens
  misc_feature: GYAE6OF02IHO4W.14.57.F02.1.454.CMB.1.raw
  modified_base (203)..(203): a, c, t, g, unknown or other
  misc_feature (203)..(203): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaaagngccaccctctcctgcgagggccagtcagagtgtacaacaccaacttacgcctggttcagacagaacgccgtggccaggcctccccgaggcctcctcatgtatgatcgcactcccgacgacgggacccaccggccacgtcccgaccgccgtacggttcgaggtcggcgaggtccgggtcgtacgggactacgtacttccgtacgtcctacgaccctactaccgagacctacgtaccgtacggtacgttaccgtaggtaaacgttacgttttacgacgtttaaggttttacttacgttcgtacgtacgtacggtacggggtaccgggtacgttaacgttccgggtacccgtaccgttaccggttaccgggtttaccggggggaccggggggtaaacccgttaacgggggttaccgggttaaccggttaaaccggtaaccgggtacggttcgggttaaccgggtccgtacggtacccgtaaccgtacgtttacccgttcggtttaccgttaccttaccggtttcccttaaccccggcccttaacgg

SEQ ID NO: 284901 - DNA, 804 bp, Homo sapiens
  misc_feature: GYAE6OF02HT2VB.14.57.F02.1.454.CMB.1.raw
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
  modified_base (277)..(277): a, c, t, g, unknown or other
  misc_feature (277)..(277): n is a, c, g, or t
tcagcgtctagtaccacgaccggtgctcgatttagctcgatatagttgggtttgggctgagagaggagcccagtcctgggatcttcaggtgttttcatttggtgatcaggactgaacagagagaactcaccatggagtttgggctgagttggctctttcttgtggctaattttaaaagatgtccagtgtgaggtgcagctggttggaggtccggggggggcttgggtacgaggccgggggggttcccngacctactctccgtgtgcngcctcgaggntttactagtttttacgacgtaatactgacctagtaggacgtcggtcgggttacccgccgtacggtacctccggaagggggtaacggggtcgttacggggtagggttccggggtacctacgtacgaacctaaagttcgtaacgggttcggtttaccgtaaggttaggggtaaaccttacgtacgtttacccggtaacccgtacccggttccgttacccgggtacgggtaaccggggtcccgtttccgtacctacgttcctaccgacggtaaacgtaaccctaattacccgaaaacgtaacctaccgttacgtttaacttttaccgttaaacgtaaacgttacggacctaacgtaccgtaaacggaaacgaaacgtaacggaccggtaacgggtcgttagttttaagtttttcggagttaaggtaaacgtacgttaacgacgttagtaaggtaccgttaacgtaaccgtttaagggttcgggtacgggttcctttacggtagtttaccgggtcggttacgggaaccggg

SEQ ID NO: 284902 - DNA, 890 bp, Homo sapiens
  misc_feature: GYAE6OF02IYF7X.14.57.F02.1.454.CMB.1.raw
  modified_base (143)..(143): a, c, t, g, unknown or other
  misc_feature (143)..(143): n is a, c, g, or t
  modified_base (177)..(177): a, c, t, g, unknown or other
  misc_feature (177)..(177): n is a, c, g, or t
tcagcgtctagtaccacgaccggtgctcgatttagctcgatatagttgggtttgggctgagagaggagcccagtcctgggatcttcaggtgttttcatttggtgatcagggactggacagagagaactcaccatggagttggntgagtggcttcttcttgtggacttaatttaaagntgtccagtgtgaggtgcgagcgtggttagggagggtccgggggtaggtcgttacggtacggtacgggtcccgggggggtccctacggtaccgtaccgtccttaccgttcggtacgtccgtaacgccgtaccgaacgggttactttacgttaattttaccggtaacgtaaattagtcgaccgttagtacggacggtccggtacggggtccccggccggaccgggtaccggtacccgggtaacggggggaacggggtcggtacggggtaggggttcgggtaccgtacgtacggaaccgttaacgtacggtaacggtttacggtttacgtaacgggttaacgggtaacgttaacgtaacgttaccgggtacccgtaccggttcccgggtaccggtacgggtaacgggttcccccgttactaccgttacgtccccgtaacgtaacgggaacttaacccgtaaactacccgaaaacggaacccttaccttcgtttaaacctttaactaccggtaaaagttccgaacgtaccgtaaccgaaggtaaaacggaccggtaacgggtaacgtaccggggtaacgttttctttacggttttaggtaacggtaagtaaagtaccgtttaaggaacttacgttacgaacggttaaaccgttaacccgttaagggtttacgggtacccgggtttaccttcgtacggttaggttcccggaaacgggg

SEQ ID NO: 284903 - DNA, 802 bp, Homo sapiens
  misc_feature: GYAE6OF02IQJ7W.14.57.F02.1.454.CMB.1.raw
  modified_base (179)..(179): a, c, t, g, unknown or other
  misc_feature (179)..(179): n is a, c, g, or t
tcagcgtctagtaccacgaccggtgctcgatttagctcgatatagttgggtttggggctggagagaggagcccagtcctgggatcttcaggtgttttcatttggtgatcaggactgaacagagagaactcaccatggagtttgggctgagttggctctttctgtggctattttaaaagntgtccagtgtgaggtgcagtctggttggacggtccgggggaggtcgttggtacgacgggccggggggtccctgacactctcctgtgcacgcctgaggtattactattttacgacgtaatatcgcctaagtcggacgtcgtacggggtcccgtccgtaacgggtccgtaccggaaggggggtaacggggtccggttagggacgggttcgggtacctaccgtacgacgtaacgttcggtacggttcggtttaccgtagggtacgggtaaacgttacctacggtttacggaacccgttcccggttaccgtacccggttagggaaacccggggttcccgtttacctacccgtacgttccctaccgaacggaacgtaacctaaacgttaccgaaacgtaacctaccttacttaacgttttacctaactaaacgttcggaactaccgtacgtaaaggaacgaacggaacgtaccggtacggggttacgtttaagttttacggttttcggtaaggtacgtaaacgtacgtaacggttaacgtcgttaacgtaacggtaaccttaaccggtttaaggtttacgggggccggtttacccgtttaggacgtttaccgggtccgtaaccggggg

SEQ ID NO: 284904 - DNA, 727 bp, Homo sapiens
  misc_feature: GYAE6OF02GYMKX.14.57.F02.1.454.CMB.1.raw
  modified_base (203)..(203): a, c, t, g, unknown or other
  misc_feature (203)..(203): n is a, c, g, or t
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
  modified_base (721)..(721): a, c, t, g, unknown or other
  misc_feature (721)..(721): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgttctttgtctccgaggggaaanacgccaccctctcctgcgacggcagtcagagtgtcaacacaactanccgttgttcagcagagccgtgccaggcctccaggtcctccacgtatggtactgtacngctaacgtacccgacgtacgggacccaccggccaccgtacccgacgggtacctacgggttcagggttcggacgtagggtcccggtagtaacggggaccacgttaccgtactaccgtaccgttcccaaccggtactacccgaacggcccgtaacgtacccgttaacgtacggttaaccgtaacggttaaacgggtttagtttaacgttacggttaaacgtttttacgtttaccttacggttaccaacgggttaaccggacgggtacgggggtacccgttaaaggtacccgggtaccggtccgttacgtaccgggtttaccgggggaccggggttaacgaacgggtcggtaaccgttacgaaacgttacggtgcggacgtcgactacgcgtacgtcgtctacgtacgtcgtaccccngtaccg

SEQ ID NO: 284905 - DNA, 857 bp, Homo sapiens
  misc_feature: GYAE6OF02I1VWT.14.57.F02.1.454.CMB.1.raw
  modified_base (207)..(207): a, c, t, g, unknown or other
  misc_feature (207)..(207): n is a, c, g, or t
  modified_base (238)..(238): a, c, t, g, unknown or other
  misc_feature (238)..(238): n is a, c, g, or t
tcagcgtctagtaccacgaccggtgctcgatttagctcgatatagttgggtttgggggaggaactgctcagttaggacccagacgggaaccaatggaagcccctagactcagcttctcttcctcctgctactctggctcccagataccgaccggagaaattgtgttgacacagtctccactcacctgtctttagctccgagggaaancgcccacctctcctgcgacggccagtcaggngttcgtaccaacaccgtaacttacggtacccgttggttaccacgtcgaacgaaccgtccgtacggtaccgaaccgggtcctaccccgtacggtacccttcccgttagtaacttcggtagtaccgtaagtccgtactaacccgtaccccggaacgggtaccgggaccccgtaccgggtacctaccggtaccccgtacggacccggttacgggttacacgggttacggccgtacgggggtaccgggtcgttacggggactacggttaccttacgtacccgtacctacccaaccgtcgtaccggtaacaccgtacggttaacccgtaggttacgtttacggtaccggtttaaattcgttaccgttaagtttaaacttttccggtacttcgttaccgaggtcggaaccggtaccggttaacttccggtaccggtaacctttcgggtaaccgggtttaccgggtacccgggggaacgggttaacgtacggggttaaccgttaaccgtaaaccgggggtactttaccgggggcgtttcccgtacggtaaccctccgttaaccgttaccgttaccgggtttactttcccgtaacccgtttcccggttacccggttacccctaacgg

SEQ ID NO: 284906 - DNA, 852 bp, Homo sapiens
  misc_feature: GYAE6OF02JTRUO.14.57.F02.1.454.CMB.1.raw
  modified_base (272)..(272): a, c, t, g, unknown or other
  misc_feature (272)..(272): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggaagacgccaccctcctccgtgcgacggccagtccagagtcgtacaacaccaacttagcctggtttcagcagacnccgtggccaggcctccgacggcctccgtacagtcgtagtgtacgtcgaccgactacccgacggtaccgggcccgaccggtaccacccgaccccgtacgacccggttacggttccgaacgggtacggtaccggacggtcccggggttacggtacggggaaccgtaaccggtacctttaccgtaccgttaccgtaacccgaacccgtacgtaccgtaaccgggtaccgtaaccggtacccggttaaaggtaacccggttacgggttaaacggtaaacgttttcgttttaaacggtacccgttttaaaggtttttaccgtttaacgttccggttaaccggtaaccggtcggtaaacggggccggttacgtaaaccggtttccgggacccttacggttacccgggtttaccggggtttaccgggggccgggggtaaacgttacggggtacggttaaaccgggttaactaaacccgggtacggtttaggccggttaacccggtacggtacccggtaacgttaccggttccgtttacggttacccgttaacttcccggttacccccggttcctaaccggtttacgg

SEQ ID NO: 284907 - DNA, 739 bp, Homo sapiens
  misc_feature: GYAE6OF02HX24V.14.57.F02.1.454.CMB.1.raw
  modified_base (205)..(205): a, c, t, g, unknown or other
  misc_feature (205)..(205): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
tcagcgtctagtaccacgaccggtgctcgattttagctcgatatagttgggtttgggggaggaactgctcagttaggacccagagggaaccatggaagcccccagctcagcttctcttcctcctgctactctggctcccagataccaccggagaaattgtgttgacacagtctccactcaccctgtctttgtctccaggggaaangccaccctctcctgcgagggccagtcagagtgtacaacacctaacttagccttggttcagcagaacgccgtggccaggcctacccgaggtcctaccctnagttcgttangattcgactactccccgaacgacgggcccaaccggcactcccgagcctagggttcacggtcggacgtacgggccggggtactggggaacacgggtacctttaccgaacttcccgtaccaaccctagtaccgacgacccgaacgtcccgtaaggtacgttacgtaaaggtaacgtttagttttacgacgttttaacggtttttaacttaaccgttgtaccgtagtacggtaacgggtccgggtaactaagggttccggtacccgtacgttaccgtaaccgggtttcgggggaccgggggttaaccgtagggtacggtaccgtttaaccgaacggttaaccggttacgggtcggtaccgtacggtaccctaaccgtacgttacggttccgtttaccttccgtaaccgttttcccgtaccccgtaacg

SEQ ID NO: 284908 - DNA, 744 bp, Homo sapiens
  misc_feature: GYAE6OF02J2C18.14.57.F02.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
tcagcgtctagtaccacgaccggtgctcgatttagctcgatatagttgggtttgggggaactgctcagttaggacccagagggaaccatggaagcccagctcagcttctcttcctcctgctactctggctcccagataccaccggagaattgtgttgacacagtcctccactcaccctgtctttgctccagggaangccaccgtctcctgcgagggcacgtnagagtcgtacaccgaacaaccttagccgttggtttacagccaagtacgcgtcggtaccgacggtcctcccgtacggtccttcctacctaggtaccgttaagtaccggtataccgtacgtaccgtaaccccgtaacggacccgggggaccctacccggggaccctaaccgtaccccgacgggtaccccgttaggtttaccggaacgggtttccggacggtaacgggtccggggtaccggttacggggaccgttaaccgtcgtaaccgttcctaccggtacctactacgtaccggaccttaggtacccgtacgtacggttacgtaacgttaagttacgtttacgtaacggttacgtttattaccgttgttaccggacggtcgtaacgggtacgtcgtaacggtccgtcgtaccgtcgttaccggttcgggtacgggaccggttaggttacgacggtatacgccgtagtcgtcgtgacgtacttcgtcttacggttctcccaagttcccgtcgtaccgtacgtcg

SEQ ID NO: 284909 - DNA, 772 bp, Homo sapiens
  misc_feature: GYAE6OF02IZ8JT.14.57.F02.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (260)..(260): a, c, t, g, unknown or other
  misc_feature (260)..(260): n is a, c, g, or t
  modified_base (352)..(352): a, c, t, g, unknown or other
  misc_feature (352)..(352): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactccacctgtctttgctccgagggaaangccacctctcctgacgaggccagtccagngtgtaccacaacctactagccttggttacngactagaagtcctggccgagcctcgaaggcctcctcagtgtactgtaactcggacacgttacccagacccggaccgtacccggtataacccncccggtaacgcccgtaagggtttaccgcggttacggaccgtaaccggggtcgggggggttctaccgggggaaactaccgggtaccctttacggacctcgttaaccacctacgttaacgcgacgaactcggtacgtacgtccgtaaggttacttcgttagtacgttacgtttactacgttagttaccgagtaccgtacggggtacgtaaaccggttggttcccggaaggtttccggtacctttaaccgggggttccggggtaccggggtaaccggttaacggggtaccgtaacgggtttaaccgaacggttaaccggggttgggtaacccggtttccggaccggtaaaccgttcccgggtaaacctttccggttccgggtttaaccctcgtttacccgttacccccggttcgtaaccccgg

SEQ ID NO: 284910 - DNA, 839 bp, Homo sapiens
  misc_feature: GYAE6OF02HADRC.14.57.F02.1.454.CMB.1.raw
  modified_base (632)..(632): a, c, t, g, unknown or other
  misc_feature (632)..(632): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttctgtgtcttaatttaaagatgtccagtgtggaggtgcagtcgttggttagggacgggtccgggggaggtcgttggtacgacggggtcccgggggggtccctagacctaccttcctccgtgtcgcacgtcctacgaggtacttacttaagttttagacgtaatacgtcgacctagtggacgtcggttccggggtcccgaccgtacggtccgtaccgggaaggggggtaacgggtcgtaggggtacgggttcgggtcctaacgagtacctaacgttacgtagggtttcggttacgtaagggttaacggtaaacgttaccgttacgttaccggacccggttcccgttaccggttacccgggtaagggtaaccgggggtttcccgtttaccctaccgttaaccgttccctaccggaaacgaacgtaaaccttaacctaaccgaaacgtaacctacttactttaactttacgtaaanaacgtcgaacgtaccgtaccgtaaggtaaaccggtaacgaaacggtaccggtaacgggttcgtttaaggttttacgttttggaacgggttaaggtaacgtaagttaacggtaagttactaaggttaacggtaaccgttaacccggtttaaggggttaccggggtaccggtttaccttacggtacggttccgggtagggtacccgggg

SEQ ID NO: 284911 - DNA, 733 bp, Homo sapiens
  misc_feature: GYAE6OF02HSLQY.14.57.F02.1.454.CMB.1.raw
  modified_base (366)..(366): a, c, t, g, unknown or other
  misc_feature (366)..(366): n is a, c, g, or t
  modified_base (462)..(462): a, c, t, g, unknown or other
  misc_feature (462)..(462): n is a, c, g, or t
tcagcgtctagtaccacgaccggtgctcgatttagctcgatatagttgggtttggggggaacgtgctcagttaggacccagagggaaccatggaagccccagctcagcttctccttcctcctgctactctggctccagataccaccggagaaattgtgttgacacagtctccactcaccctgtcctttgctccaagggaaagacgccacctctcctgcacgggccagtcagagtcgtacacaccaaacttacgccttcgggtttcaggtaccagaacgccgtcggaccgaaggccttcccgaggccttcccctgaactggttaactggtacgtcgtacacttccccgaagcgggtccgaacccggntaccaccccgtcgaccggaaccggtttcaaggtcggacacggtcccggggttacggggacaagtcgttacactaccgtaccaccgaattcccgganaaccgacgtaccgtaacgaagttccgtaggtaagtacgtttacgtacgttacggtttaatttaccgttacgtacgtaacgtcgaaaccgggtcggtaccgtaacgttacggtcccgtacgtttccggacgggtttaccgggtaccgggggtacccgaaggggtacggtaacggtttaccgaaaccgttaggtaccgtcggggtaactaccggtacgaccgttaagtccggttacgttcggtccttacctccggttaccccgtcgttaaccg

SEQ ID NO: 284912 - DNA, 766 bp, Homo sapiens
  misc_feature: GYAE6OF02JNIFR.14.57.F02.1.454.CMB.1.raw
  modified_base (184)..(184): a, c, t, g, unknown or other
  misc_feature (184)..(184): n is a, c, g, or t
  modified_base (200)..(200): a, c, t, g, unknown or other
  misc_feature (200)..(200): n is a, c, g, or t
  modified_base (731)..(731): a, c, t, g, unknown or other
  misc_feature (731)..(731): n is a, c, g, or t
tcagcgtctagtaccacgaccggtgctcgatttagctcgatatagttgggtttggggctgagagaggagcccagtcctgggatcttcaggtgttttcatttggtgatcaggactgaaacagagagaactcaccatggagtttgggctgagttggcttctttcttgtggtcttaattttaaaagntgtccagtgtgaggtncagtcttggttggagggtccgggggagcgttggtacgacgggtcccggggggtcctgactctctcctgtgcacgcctgaggttattttattttagcgtaaattagtcgacctagtacgcgcggttacgggtccgaccgtacggtccgtaccggaaggggtagggccggtagggtaggttcggggtacctaccgagtaacctaagtccgtaggttcggttacgtaaggtacgggtaacgtacgtaacgtccggtaccgtcccgttacgtccggtaacggaccggggtcccgttacgtaccatcccgtacgaagtacgtaactaaccgttacaaacgtaccttaacttacgtttacttacgtaagaaacttaccggactaacgttccgaaaggaaacgtaacggtaacgaccgggtaacggttcgttaacggtttagttttacggaaggttaaagaaagtccgttaacgtaacggtttccaaacggtttacgaaacgttaccccggtaagggttttagggaacccgggttttnttaccggtcgtaagggttccggtaagggtacccgg

SEQ ID NO: 284913 - DNA, 714 bp, Homo sapiens
  misc_feature: GYAE6OF02HLIA9.14.57.F02.1.454.CMB.1.raw
  modified_base (271)..(271): a, c, t, g, unknown or other
  misc_feature (271)..(271): n is a, c, g, or t
tcagcgtctagtaccacgaccggtgctcgatttagctcgatatagttgggtttggggctgagagaggagcccagtcctgggatcttcaggtgttttcatttggtgatcaggactggacagagagaactcaccatggagtttgggctgagttggctctttcttgtggctattttaaaagatgtccagtgtgaggtgcagctgttgggaggtccggggggaggcgttggtacgacggcccgggggggtccctgacactctcctgtgcagcctnaggtattctattttagcgaatatcgccatgagtcgtcgggtcccgccgaggccgtaccggaagggggaacggggcgtgggaggttgggtctacgagacaatcgtagtggttactaggtaggtaagtactacgttcggaccgtccgtcgtccggtaggaacggggtcccgtttctccgtactccgtaccaaggaactaaccgtaaacttaccgaaaacgtaacctaccttactttaactttaccgtttaacaaacgttacggaacacggtaccctaaaggaaaacggaaccgaaacggaccggtacggggtacgtttagtttaacgtttttcggtaaggttaagtaaaggtacgttaaggtaaggttactacgtagtaaccgttaaccgttaagggtttcggggtaacggggttcctttacgtagttcggtcggtaaccggggg

SEQ ID NO: 284914 - DNA, 769 bp, Homo sapiens
  misc_feature: GYAE6OF02JSKBZ.14.57.F02.1.454.CMB.1.raw
  modified_base (198)..(198): a, c, t, g, unknown or other
  misc_feature (198)..(198): n is a, c, g, or t
tcagcgtctagtaccacgaccggtgctcgatttagctcgatatagttgggtttggggcgtgagagaggagcccagtcctgggatcttcaggtgttttcatttggtgatcaggactgaacagagagaactcaccaatggagtttgggctgagttggctctttcttgtggtctattttaaaagatgtccagtgtgaggtncagctgttggagtccgggggagcttggtacgaggccggggggtccctagacgactctcctgtcgcagcctcgaggtattcctattttacgacgtaataacgtcgacctagtacgtagtcctcgggtcccgctacggccgtacccgaagggggtaacgggtccgttagggacgggtttacgggtcctacgacggtactaacgtacgtacggttcggtttaccgtaaggttacggtaaaacggtctaacggtttaccggaaccggtcccggtttccgtacccggtacgggaaaccggggtttccgtttcccgttaccgaacggttccctaccgaaacggttacgacccttaaacgttccgaaaacgtaaccctaaccttcgtaacgttttacaacctaaagttaccggacttaacgcccggtaaagaaaacgtacggaaactaccggtagggtaccgttaaagtttcgttttaaggctttaagggaatacggtaacgtaacgtaacgttataacgtaaccgtaaccgttagtttacggggtacggtcccttggtaagttccgtaggtaccggg

SEQ ID NO: 284915 - DNA, 775 bp, Homo sapiens
  misc_feature: GYAE6OF02JSYO5.14.57.F02.1.454.CMB.1.raw
  modified_base (696)..(696): a, c, t, g, unknown or other
  misc_feature (696)..(696): n is a, c, g, or t
tcagcgtctagtaccacgaccggtgctcgatttagctcgatatagttgggtttggggggggaactgctcagttagggacccagaggggaaccgatggaaggccccagctcagcttctcttcctcctgctactctggctcccagataccaccggagaaattgtgttgacacagtctccactctaccctgttctttgtccgtcgaaggggaaatacgccctaccccttctcctcggacgacgggcctaacggtccaggacgttcgtaaccaacgtaacccaactttacgtacgttcgggtttcaacggtctaaggaacggtcctcgggaccgtacggccgtcccgaacggtccctacctacgtagttacggtatacggtcgttacgcctacccgtccgtaaccggaccgggtcccgaccggtccaacgttaccccgaacggtccccggtaaggttcccgtagggtacggtccggaacggttccggggttacgtaccgggaacgtaacggtaccctttcgctacccgtactaaccgtcgaccggaacgtacgacgtcgtaacggtacgtaccgtaaggtagttacgtttactacgtttacgttaacgttctacgtcgtacggaccggttacggggacgtacgtaccgttcggacccgttacgtccggttaccgttcgggggaaccggggtagtaccggnggttaacgtaacgtaccgacggtggtaccgtcgacgtcgtaacgtcttcggtcttacgtctaccgtccgttccgctacg

SEQ ID NO: 284916 - DNA, 837 bp, Homo sapiens
  misc_feature: GYAE6OF02IAD0R.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttcttgtggctatttaaagatgtcagtgtgagtgcagctgttggaggtccgggggagtcgttggtacgacgggccggggggtccctgacactctccgtgtcgcacgctacgaggtacttcgttattttacgacgtaatatcgactagtgacgtacgtcgggtacccgccgtacgggtcccgttacccgggaagggggtaacgggggtccgttaagggggtacggggttacgggggttaccctacggttaaacggacgttaaacgtaccggttaagggtttacggttaaccggttaaggtacggggtaaacttacgttacgttaccgggacccgtcccggttaccggtacccggttaggggaaacccgggggttcccgtttaccgttaccctacttacccgtaccgaaggtacgtaaacctaacgttaaccgaaactaaacctacttcttaactttactaacgtaacgtacggaactaccgtactaaagggaaaccgaacggtaaaccgacggtcccgggtagtttaacgggtttttacgttttaggaacggtttaaacgaattaaccgggtaacggttaacgtttcgtaaggttacttaaacccggttaacgtttaaggggttacggggttacccggggttttacctttaaccgtggttaccggttaccgggtaccggggg

SEQ ID NO: 284917 - DNA, 687 bp, Homo sapiens
  misc_feature: GYAE6OF02GQKIA.14.57.F02.1.454.CMB.1.raw
  modified_base (270)..(270): a, c, t, g, unknown or other
  misc_feature (270)..(270): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggaggtccgggggagcgttggtacgaggccggggggtcctgacactctcctgtcgcagcctcgaggnttctatttttagcgaatatgccatgagctcgggtcccgcgaggcctccggaggggaacggggctgggaggtcgggtctcgagacaacgtcgaggttcggttcgtaggtaggtaacgtactagttaccgacggtccgttccgttccggtaggtaaccgggggtcccgtttactcccgtacgttcccgtcccgaagtaacgaacctaaacgttacccaaacggtaaacctaccttcttaacttttaccttaacaaacgttcggaacgacgtacctaggaaacgacggaaacgtacgtaacggggtcgtttagtttacgtttttaggtacgtaagtaagtagtaacgtagttacgtagttacgtacttaaccgttaggtttcgggtacggtccgtttacgagttcggtacggtaccgggg

SEQ ID NO: 284918 - DNA, 936 bp, Homo sapiens
  misc_feature: GYAE6OF02G1T36.14.57.F02.1.454.CMB.1.raw
  modified_base (123)..(123): a, c, t, g, unknown or other
  misc_feature (123)..(123): n is a, c, g, or t
  modified_base (204)..(204): a, c, t, g, unknown or other
  misc_feature (204)..(204): n is a, c, g, or t
  modified_base (922)..(922): a, c, t, g, unknown or other
  misc_feature (922)..(922): n is a, c, g, or t
tcagcgtctagtaccacgaccggtgctcgatttagctcgatatagttgggtttgggggaggaactgctcagttaggacccagagggaaccatggaagccccagctcagcttctcttcctcctnctactctggcctcccagataccaccggagaaattgtgttgacacagtctccactcacctgtctttgtctccgaagggaaanagccaccctctcctgcacgggaccagtcacggaggttgaccaaaccaacctaaaccgtttacgcccgttacgggttttaccaggacctaaggaacgccccgttcggacccgaacgggtccctaccccgaagggccccttaaccctccgtacttaggttactacggtaactacggtacctaccgttacccccgaccgggaaccggggccccctaaaccccgggcctacccgtaaccccgcggaaccccgttaaggggttacccgtaacgggttccggccgtaacgggggtccggggttacggttacggggaacgtacccggtaaccgtttcccaaccgttccttaacccacctaacttcgacccgacgtttaccggaacccgttagggtaccgtttaccgaacgggttttaaagttaccgttttaacggttacgtttaaacggtttttaaacggtttcgttacgtacgtaaacggtccggtaaggggaacccggttcgtaaagggtttcccggtcccgttacgttacccggggttacccgggtttaaccgggggggaccccggggtaaacgggtttacggggttaacccgggtaacgttaaaccggttaacccgggtacggttttaacgggccgggtttacgtaaccccgggtaccctaacccggttaacctttaccgttccgtttaaacccggttcctttacccgggttttacccccnccccggtttaaacc

SEQ ID NO: 284919 - DNA, 947 bp, Homo sapiens
  misc_feature: GYAE6OF02FSTBW.14.57.F02.1.454.CMB.1.raw
  modified_base (215)..(215): a, c, t, g, unknown or other
  misc_feature (215)..(215): n is a, c, g, or t
tcagcgtctagtaccacgaccggtgctcgatttagctcgatatagttgggtttgggggggaactgctcagttaggacccagagggaaccatggaagccccagctcagcttctcttcctcctgctactctggctcccagataccaccggagaaatgtgttgacacagtctccactcacctgtctttgtctccaggggaaagagccaccctctcctncagggccagtcacgagtcgtcaacaccaacttagacctggtttacaggtcaggaacgccgtggccagggtcctcccgagggtcctccgtccagttgtactcgtagttcggacctaaccgtccccgaaccggtaccgggacccgacccggtcaccgtaccccgacggtacccggtaacggtttaccgacggtcgggtaccgacgggtcggggttaccgtaggggtaacctaccggtaacccgttctaaaccgttccgtaccgtacccgtaactaccggaacgtaccgtaaccgtaccgtaaacgggtaccgttacgttacgggtaaacgtttaccggtttacgtacccggttttaaaggttttaacccgtttccggttttaacgggttaacccggtacgggtaacccgttacggggggtaccggggggttaaaccccgttaagggtttcccgggggaacccccgtttacccgtttacccggggttaaaccccggggtttttcccgggggggggggaaccgggggggttttaaaccccggggtaaaaccgggggtttaggggggtaaacccctttaaccgggggttaaaaaaccccgggtaccgggggttttaacgttcccgggggttaaccgttaacccggtaacccggaaccccgtttaaggtcccggttttaccgtaccccgggttttaactcccgttttacccggttcccccgggtaaccctttaccggg

SEQ ID NO: 284920 - DNA, 731 bp, Homo sapiens
  misc_feature: GYAE6OF02HFHD0.14.57.F02.1.454.CMB.1.raw
  modified_base (201)..(201): a, c, t, g, unknown or other
  misc_feature (201)..(201): n is a, c, g, or t
  modified_base (467)..(467): a, c, t, g, unknown or other
  misc_feature (467)..(467): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattggtgttgacacagtctccactcacctgtctttgctccgagggaanagccaccctctctgcgagggtccagtcaggagtcgtacaacacctaacttacgcgttcggttacagctaaggacgcctggacctacggcctcccgacgtccgtacctcgatcggttaatgtactcggacctacctaccccgacggaccgggcccaccgggtacacctaccccgaggtaccccgtaggtttaccggaggtcggaaccgtcggggtacggggttcgtaacgggactacgggtactttacacctaccgttcaaacccgntaccgtacgaccaacggtacctacggtacgtacgttacggaacgtttagttttcgaacgttttacgttaacgttacgttacgtaactaacgggtcacgggggttaccggagttaacggttccggaacccgtcggttaccgtacgggtttaccggggacggggaaacgttacgggagggttacgtaaccgtaacggttcgtaggtcggacctaggcccctagacgtttccgtacgttacgttcccgtacttccccgtacgttacc

SEQ ID NO: 284921 - DNA, 743 bp, Homo sapiens
  misc_feature: GYAE6OF02G5DOU.14.57.F02.1.454.CMB.1.raw
  modified_base (507)..(507): a, c, t, g, unknown or other
  misc_feature (507)..(507): n is a, c, g, or t
tcagcgtctagtaccacgaccggtgctcgatttagctcgatatagttgggtttgggggaggaactgctcagttaggacccagagggaaccatgggaagccccagctcagcttctcttcctcctgctactctggctcccagactaccaccggagaaattgtgttgacacagtctccactcacctgtctttgtctccgagggaagacgcccaccctctcctagcgacggccagtcgaagtagttcgtaccaaaccgtacccaacttagtacccgtggttttaccaaggaccaagaacggtcccgtacgggaccgtacggacccttccccgaagggccttaccccgtcaacgttagtaacgttgtactccggtactaaccgtaccccgaacggacgggtaccccctaaccggcctaccgtaacccccgagtaccccggtaggtttccgaaggttcggacgtacgggtaccggggtcgtagggacctacgtacttcgaactctacactacncaagccacgtacgtacgtacgtctaggtaattgtttacgtcgtttaagtttaacttacttacggtacacgtacggtacggtacgggacttaacggtccggtaccgacttaccgttacgggtttaaccggggccgggggtaactagggggttacgtaggttaccgaacgtaacggtggttccggatacgtccgaacttacgtacgtttggtaccttaccgtcgtcccttaccctacg

SEQ ID NO: 284922 - DNA, 713 bp, Homo sapiens
  misc_feature: GYAE6OF02G432X.14.57.F02.1.454.CMB.1.raw
  modified_base (299)..(299): a, c, t, g, unknown or other
  misc_feature (299)..(299): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggagtttgggctgagttggctctttcttgtggctaattttaaaagatgtccagtgtgaggtgcagctggttgggacggtccgggggagtcttggtacgacgggcccgggggggtccctgacacctctcctgtgcacgcctcaggtattctattttagacgtaatancgcctagtgagcgtcgggtcccgccgacggcctaccggaggggacgggcgtagggagtgggtactcgagactaagtcgtaggttcggttcgtaggtaggtaaacgtactagttccggaaccgtccgtaccgtccggtagggaacccggggttcccggtttactacccgagttccctaccgtaagaccgtaactaacgttaaccaaacgtaacctaccttactttactttacgttaactaaagttcggaacctacgtacctaaggaaacgaacgaacgacggtacggtacgtttcgtttaagttttgaggtaacgtaagtacgtaacggtaagtcgtaagtacgtaaccgttacgtttaacggttcggggtaaccggttccttttacggacggtttaccggtacggtacccgggg

SEQ ID NO: 284923 - DNA, 702 bp, Homo sapiens
  misc_feature: GYAE6OF02FRUQG.14.57.F02.1.454.CMB.1.raw
  modified_base (376)..(376): a, c, t, g, unknown or other
  misc_feature (376)..(376): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcgacgggccagtcaggagtgtcaacaccaacttagccgttggtttcagcagaagcctggaccaggcctcccgaggcctccctcatgtatgatgccatccccgagacgggccaccgcacgtcccacgaccgtaggtcaggtcggcacgggccggggtcnggggacagtacttcacctctccaccataccacgactacgaccgtagacgttacgtagtaacgttagtttacggtactttaaggtttactttaccgttggtacgtagaccgtacgggtaccggggtaccttaaggttccgggtaccgtaccgttccggttaaccgggtttccgggggacccggggggtaaaccgttaaacggggttacgggttaaccgttaccggtaaaccgggtaacggttcggttacgggtaccgttacggaccgtaaccgtacgttacgtttccgttttacccgtaccgttaccttacccgtttccccgacccg

SEQ ID NO: 284924 - DNA, 755 bp, Homo sapiens
  misc_feature: GYAE6OF02IA15H.14.57.F02.1.454.CMB.1.raw
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (372)..(372): a, c, t, g, unknown or other
  misc_feature (372)..(372): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccacgganaatgtgttgacacagtctccactcaccctgtcctttgcctccgaggggaaanagcccaccctctcctgacgacgggcctagtcagtagttgaccaacacgtaacttaagccgttgttcagtcgaagtaacgccgtacggccaaggcctacccgaggtcctacctcattacgtatagtaatcgactacctacccgacgtacgggccctaccggacaccgtacccngaccgtaggtacacggtcggtcaacggtccgggtacggtacggggtaactacgtaccctttacgaccttccggtaaccacccgtacgtacgacggtaccaacggaccgtaaggtacgtacgtaaggtaaacttaaggtttacgacgttaacgttttaagtaccgttacgtacgtacgacggtaccgggtcgggtaactacgggtcgtacccggtacgttccgtaccggggtttaccgggggaaccgggggttaaccgttaacgggggtgtaaaccggtaacgtaaaacggtacgttacgggtacgtacggttaccgccgtaacccgttagttacgttaccgttaccgttaccgtaccgttacccggttaccctacgttaacgg

SEQ ID NO: 284925 - DNA, 382 bp, Homo sapiens
  misc_feature: GYAE6OF02HG852.14.57.F02.1.454.CMB.1.raw
  modified_base (168)..(168): a, c, t, g, unknown or other
  misc_feature (168)..(168): n is a, c, g, or t
  modified_base (216)..(216): a, c, t, g, unknown or other
  misc_feature (216)..(216): n is a, c, g, or t
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (324)..(382): a, c, t, g, unknown or other
  misc_feature (324)..(382): n is a, c, g, or t
tcagcgtctagtaccacgaccggtgctcgatttagctcgatatagttggggtttggggggccaccgacatcccagccaggttcagtggcagcgggtctgggacagacttcactctcaccatcagcagcctagagtctgaagattttgcagtttattactgtcagcagngggcaattggccgctcactttcgggcggggggaccaaggtggagttanaaacgaactggtggctgcaccatctntctcatcttcccgcatctgagtactagacngtgagcggntggcaaggcgcaagacgtngatcgangctgcagtcngntcagnnnnnnnnnnnnnnnnnnnnnnnnnnnnnnnnnnnnnnnnnnnnnnnnnnnnnnnnnnn

SEQ ID NO: 284926 - DNA, 730 bp, Homo sapiens
  misc_feature: GYAE6OF02H1UYX.14.57.F02.1.454.CMB.1.raw
  modified_base (202)..(202): a, c, t, g, unknown or other
  misc_feature (202)..(202): n is a, c, g, or t
  modified_base (688)..(688): a, c, t, g, unknown or other
  misc_feature (688)..(688): n is a, c, g, or t
tcagcgtctagtaccacgaccggtgctcgatttagctcgatatagttgggtttggggaggaactgctcagttaggacccagagggaacccatggaagccccagctcagcttctcttcctcctgctactctggctccagactaccaccggagaaattgtgttgaacacagtctccactcacctgttcttgtctccgagggaanacgccaccctctcctgacgacggccagtcagagtgtacaacaccaaacttacgcttggttcagcagaacgccgtggccacggcctccccgaggtccctccgtacgagttgtaactgtactcgaccgttacctaccccggaacgggtacccgggaccccgtaacccggtacccgtacgtaaccccccggtaacgcccggtttaaacgggtttccgaacgggttaccgggaccggacgggttcccggggttacgtacggggaacgttaaacgtaccttttacccgaacctttcccgtaactaaccccgttaaaccggtaccgacctaacggtacccgtagtaaccgttgtaagtaactttagtttacggactttaagtttacttactgtacagtacgtggacggtatacggtccggcgtacctcggttaccggtacggggaccgggtacggaggtagtaacgtaacgacgttagcggtacgcggtacnctaccgcttacgtcgttaccttacgcttacccgtcccgtacg

SEQ ID NO: 284927 - DNA, 680 bp, Homo sapiens
  misc_feature: GYAE6OF02HKCHX.14.57.F02.1.454.CMB.1.raw
  modified_base (169)..(169): a, c, t, g, unknown or other
  misc_feature (169)..(169): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (500)..(500): a, c, t, g, unknown or other
  misc_feature (500)..(500): n is a, c, g, or t
tcagcgtctagtaccacgaccggtgctcgatttagctcgatatagttgggtttggggggaacgtgctcagttaggacccagagggaaccatggaagccccagctcagcttctcttcctcctgctactcgtggcctcccagactaccacggagaaattggtgttgaccanagtctccactcacctgtctttgtctccgagggaangaccncctctctgacagggtccagtcaagtgtcgtacaacactaacgttcgccttggttacagccgaagtacgccgtggccacggtccnccgaggccttaccgntaacgtcgttatcggactcgacctacctcccgaagaccggcccaccggaccacgtcccacggtctaacggtcgtaggcgacggtcggcggggtaccgttagggacctaggtactttccgacctttcgacctacacgtcacgacgactacggtatcgctagtatagttcagttacgtttactagtagtaccgngtacgcgggtacggacgttacgtccggtaccggtccttaagggttccgggtacggggaaccggggtacggtaacggtaggtaccgtttaacgacggtaacggttggtaccggcgaccgtaccgtaacgttctttacggtacgtttctacttaacccggtttccacccggtacgttaccgg

SEQ ID NO: 284928 - DNA, 784 bp, Homo sapiens
  misc_feature: GYAE6OF02G4X77.14.57.F02.1.454.CMB.1.raw
  modified_base (184)..(184): a, c, t, g, unknown or other
  misc_feature (184)..(184): n is a, c, g, or t
  modified_base (202)..(203): a, c, t, g, unknown or other
  misc_feature (202)..(203): n is a, c, g, or t
  modified_base (257)..(257): a, c, t, g, unknown or other
  misc_feature (257)..(257): n is a, c, g, or t
tcagcgtctagtaccacgaccggtgctcgatttagctcgatatagttgggtttggggctgagagaggagcccagtcctgggatcttcaggtgttttcatttggtgatcaggactagaacagagagaactcaccatggagtttgggctgagttggtcttctttcttgtgacttaattttaaaagntgtccagtgtggaggtgnngtctggttgggacggtccgggggagtcgttggacgcggggtcccggggggtccncggtacactcctccgtgtcgcgacgcctagacgttattacttaattttcgacgtaaattctgacctagtgacggtcggtccgggtcccgcgacggtccgaccgggaagggggacgggtcgtgggacggttcgggtctgacgacgtaagtcgtaggttcggttacgtaggtaacggtagttacgtacgttcggaccgtccgtccgtacggacgggtaccgggttcccgttcctaccgtacgttcccgtacgaacgtaacgtaaccttaaactaaccgaaactacctacgttacctttactttaacgtacttaaacgtcgactaacgtagtaacgaaggtaaacgaacgggaccgttacgggttacggtttagttttaggttttacggtaaagttaagaaacggttaacgtaacggttaaacgttacgtaacggttaaccggttaaaccggttaaccggtttacgggttacgggggttaccggtttaccggtttaaccggttaggttcccgggtaagggtacccggggg

SEQ ID NO: 284929 - DNA, 803 bp, Homo sapiens
  misc_feature: GYAE6OF02JV717.14.57.F02.1.454.CMB.1.raw
  modified_base (157)..(157): a, c, t, g, unknown or other
  misc_feature (157)..(157): n is a, c, g, or t
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (358)..(358): a, c, t, g, unknown or other
  misc_feature (358)..(358): n is a, c, g, or t
tcagcgtctagtaccacgaccggtgctcgatttagctcgatatagttgggtttgggggggaactgctcagttaggacccagagggaaccagtggaacgccccagctcagcttctcttcctcctgctactctggcctacccgagactaccaccggganaatttgtgttagaccacagtcctccactacacccgttnttctttcgcctaccgaaggggaaancgccctaccgttctccgagcgtacggccagcgaagcgtagccaactaccttaacgtcgtccgtttacgggttacaggaccgaaggaccgtccgtagggacccagggaccccttaccggaaccggtccctaccgttacnggtttacgtattacggcgtttacggacccaccggttaccccacggtaccggggaccctaaccgggccttaccgtccgggaacccggttactaccgggttaccgagggttaccgggaacacggggtttccggggcgttaacggggtaaccggtaaccgtttcccgtaacccttcggttaaccctacccgacgtacccggtacgtcaacccggtccgtaccgtaggtcgtacgttaggtaactcgttcgtaagttactttagttacgcgtacgtaggtacgacggtcgaacctaggccgttcgttaaccgtcggtacccggggtacggggttacgggaccgttagggacgttaacggaacgtacggtacgttacgggcgtacggtactccggaacttcgggttaactccgttacgtccgttaccgtacccgttacgccgtttaacgg

SEQ ID NO: 284930 - DNA, 783 bp, Homo sapiens
  misc_feature: GYAE6OF02GZIGH.14.57.F02.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccgggagaaattgtgttgacacagtctccactcaccctgtctttgtctccgaggggaaangccaccctctcctgcagggccagtcagagtcgacaacaccaacttagccttggttcagcagaacgcctaggccaggcctcccgagcctcacattgtangatcgcactcccagtacgggcccacggccactcccgagccctggttacacggtggccgagggtccggggtacgtacggggacaacggtaccttaccgacctcgtaccctacctaacgtaccgtaacgaccgtacggtacccgttaaacgggtaccgttaccgttaaagggtaacgtttacgttttacggtaacgtttaaagttttttacctaccgtttacggtacgacgggtacggtaacgggggtcgggtaccgttaacgggttccggtaccccggtcggttaccgttttaccggggttccggggggtaacccggggggtaaccgtaaggggtttaaccgggtaacgttaaccgggtaaaccggtacggttcgggttccgggtacggttaacgtacccgggtaacctaaccggtttttcccgttacggttttaccttaccccgttaaccggttttccccggttaccccgtaccgttaaccg

SEQ ID NO: 284931 - DNA, 798 bp, Homo sapiens
  misc_feature: GYAE6OF02FP3SJ.14.57.F02.1.454.CMB.1.raw
  modified_base (180)..(180): a, c, t, g, unknown or other
  misc_feature (180)..(180): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggctaattttaaaagntgtccagtgtgaggtgcagctggttgggaggtccgggggaggcttggtacgaggccgggggggtccctgacactcgtcctggtcgacacgcctcaggattctatttttagacgtaatatgaccatggagcgtcgggtccgaccgaggtcctccggaggggaagggcgtggagggtggtactcgagcaatgtagttggttcgtagtaggaacgtacttatccggacggtcccgttctccgggtaggtaaccggggccgtttccgtactacgtaccgtaccgtagaaacgactaaacttaccgaaacgtaacctacttacgttaactttaccgtttaacgtaaacgtacgggtaaccacggttaacccggtaaacggtaaaacgggaaacccggtaaacggaaaccggttaacccggggggttaccggtttaacgggtttttaaaccgtttttttgggaccggtttaagggttaaaaggtaaccgggtttaccgtaaaggttaccgttaacgttaacggttaaacccttaaccccggttttaagggttttaaccgggggaacgggggttttcccctttaaccgggtagtttaccgggttacccggggtttaacccggggg

SEQ ID NO: 284932 - DNA, 780 bp, Homo sapiens
  misc_feature: GYAE6OF02H73O2.14.57.F02.1.454.CMB.1.raw
  modified_base (189)..(189): a, c, t, g, unknown or other
  misc_feature (189)..(189): n is a, c, g, or t
  modified_base (211)..(211): a, c, t, g, unknown or other
  misc_feature (211)..(211): n is a, c, g, or t
  modified_base (425)..(425): a, c, t, g, unknown or other
  misc_feature (425)..(425): n is a, c, g, or t
  modified_base (689)..(689): a, c, t, g, unknown or other
  misc_feature (689)..(689): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagaagaactcaacctagtggtagtttgggctggagttggcttctttcttggtggtcttaattttaaaagnttcgtaccagttgtgtacggtncagtcgtggttgggaggtccgggggagtcgttggaacgcgggtccggggggtcctacgactcctctccgtgtacgcacggcctacgagttacttacttaagttttaaacgaattacgtacgacctagtacggacgtaccggttcgggacccgtccgtagggtcccgtaacggggaacgggggagggtccgttaggtacggttcgggtctacggngtactacggtacgttaggttacggtacgtaagggtagtaaactacgttaccggtaccggtccggtaccggttccggttaccggtaggtaacccggggttcccgttaaccgtcgtcgtttaccacgtaacggaccgtaaacgtaaacccttacgaaacgtaccctacctttactaacgttttacctaacggtaaactaccgggacttacggactaaacgggtaacgaacggtaacgcgtaaccgggttgttcgtttaagtttcgngtaaacgagtaactagtactacgtgtaacgtccgtaactttagggtcggttaccggtctttaacgcgggtttccggacgtacgggtaacgg

SEQ ID NO: 284933 - DNA, 866 bp, Homo sapiens
  misc_feature: GYAE6OF02F8ZAW.14.57.F02.1.454.CMB.1.raw
  modified_base (149)..(149): a, c, t, g, unknown or other
  misc_feature (149)..(149): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccgganaaattgtgttgacacacgtctccactccacctgttctttgtcctacggaggggaaagacgccctacccgtcctctggcgacgggccagtacagtagtcgtaccaactaccgtaacttacgtcgttacggttacaggactaacggtaactcccgtacgggacccgtaggtacctacccggacgtcccgttacctcctagttcggttaatcggtaactcgacctaccgacccgacggaacccggggtcccaaccggacgaaccctcccgacgtacccggttaggttacgacggttcggaccggtaacggttccgggtcgtaacgggaacctacggttaccgttaccaccgttctaaccctaccgaacgttcgaaccggtccaacgtacccggtttaacgtacggtttaccgtaagggttaacgttttagtttaccgtacggtttaaaccgttttaacgttacgttaccggttaacaccggggttacgtaacgggggtccggttaacggttaaccggttccggtacccggttccgttaagggtttcccggggtttaaaccgggggaccggggggttaaccgttaaacggggtcggtttaaaaccgtaccggttaaacggttcggtacggttacggtcgtaccgtaaccgttaccttaggtttacccggttcgttttccccgttagttaccctttcccccggttaccgtatttacccccgg

SEQ ID NO: 284934 - DNA, 825 bp, Homo sapiens
  misc_feature: GYAE6OF02G0ON5.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagactaccacggagaattgtgttgacacagtctccactcaccctgttctttgtcctaccgaaggggaacncgccctaccctctcctgcgacgggccagtcagtagtcgtaccaaccacctaacgttacgcgttggttccagacgaaggacgccgtcgccgacggcctcccgaggcctcctacgatacggtactagctcgacctacctacccgaccggaaccggcccgaccggacctaccgtaccccgacggtccgtacgggttacgacggttacggccggtaacggtcgggttaccggacgggtaacgtacgggttaccttacccgtaccgttcccgtactaaacctaccgtcgaaccgtacgtaccggtaaccgttaagtccgtacgggtaaacgttaacggtttacgttttaacgggtacgtttaaccgttttaacgtttaccggttacgtacccgggtaaacggtccggttaaccgggggacccgggtttaacgtaacggggtttcccggtacccgggtaccgtttacccgggttacggggtttacccgggggggaccggggtaaccgtaagggggttccggtaaacgttaaccgggaaccgttacggtacggtcggtaccgtacgtaccggtaccttagtcccggttacttaccgttacctacccgttccttacccggacttacgg

SEQ ID NO: 284935 - DNA, 877 bp, Homo sapiens
  misc_feature: GYAE6OF02JYPMQ.14.57.F02.1.454.CMB.1.raw
tcagcgtctagtaccacgaccggtgctcgatttagctcgatatagttgggtttggggaggaactgctcagttaggacccagagggaaccatggaagccccagctcagcttctcttcctcctgctactctggctcccagactaccaccggagaaattgtgttgacacagtctccactccaccctgtctttgtctccgaaggggaagacgccaccctctcctgcgagggcccaggtccaggagtcgtaccaaccgacctaacttacgcccgttggtttccacgtacaaggtaacgccgttacggccgtacggccctaccccgaggccctccgtactagttggtacgtcggtatacgcaccgtacccgacggtaccggacccgaccggacgacctacccgacgtccgtacgggttacacgggtacggaccgtacgggtccgggtacggtaaccgggtacgtaccgttaccgttaccgtacccgttaccgtaacccgtaaccgtagtacccgtaacgtaccggtaccgtaacccgttaacggtaccggttaccgttaagggtaaacttttcgtttacggtaacgttttcggttttaaccgttaacggttacggttcccgtaacggtaccgggttacggtaccgggggttaaccttagggttcccgggaccgtttaccggtaccgggttttaaccggggtacccgggggttaacgggggttaacccggtacgggtttaaccggggttaaccgttaacccggtaaaccggggttaccgtttaacggggacccgggttccgtttaaccggaccccgttaacggtttcggttacctttaccggtaccttttaccggaaccggttttcccccgttaaccgtcccgg

SEQ ID NO: 284936 - DNA, 591 bp, Homo sapiens
  misc_feature: GYAE6OF02GJQRI.14.57.F02.1.454.CMB.1.raw
  modified_base (176)..(176): a, c, t, g, unknown or other
  misc_feature (176)..(176): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (332)..(332): a, c, t, g, unknown or other
  misc_feature (332)..(332): n is a, c, g, or t
  modified_base (509)..(509): a, c, t, g, unknown or other
  misc_feature (509)..(509): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttggctgagttggctctttctgtggctattttaaagntgtccagtgtgaggtgcagctgttggagtccgggggagctggtacaggccggggggtcctgacactctcctgtgcagcctnaggattcattttagcgaatatgccatgagctgggtcccncgaggctaccgagggaagggctgggagtgggtactnagacaatcgaagtgttactaggtagaagtacagttcgacgtccgtcgtccgtaggaacgggtccgttctcctagtctaccagacgaactattaccgaaagtaaccacgttcttaactttcgtactaaagtcgaacacgctaagaagaacgtaagacgaccggtgttgttattttcgngtagaacgtataccgaagtctatacgaacttacccgtaaggtttacgggacgggttccttacgtatcggttacgaaccgggg

SEQ ID NO: 284937 - DNA, 677 bp, Homo sapiens
  misc_feature: GYAE6OF02H0RT2.14.57.F02.1.454.CMB.1.raw
  modified_base (147)..(147): a, c, t, g, unknown or other
  misc_feature (147)..(147): n is a, c, g, or t
  modified_base (325)..(325): a, c, t, g, unknown or other
  misc_feature (325)..(325): n is a, c, g, or t
  modified_base (557)..(557): a, c, t, g, unknown or other
  misc_feature (557)..(557): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctgctccagataccacggaanaattgtagttgacacagtcctccacctcacctgttcttgtctaccgagggaagacgcccacctcctctgcgacggccagtcagagttcgactaacgacctaacgttagccgttacgtttcgagacaacgaacgcctacggaccacggcctaccgacggccttccactagtcgttaagngtagttcacgtcctaccgacggtccggccgaccggtcaacgttcccgactccggtacggttaccagggtaccggtcggacgggtacgggttacggtacgggtaaccgaacgttaccgtctacgttacccgaaacacgtacgtaccgtagacccgtacggtacgtacgttacggtacgtagtaacgttcgttacgacgtttagtttctagtagtacgtacgaggcgtacgtanacggttcggccgtacgttacgtccgggttacggggcggacgttaacggcgtaacggtaaccgagtacggtgtcggtactcggactactcgtcttacgtccgtattcgaccttcgataccg

SEQ ID NO: 284938 - DNA, 695 bp, Homo sapiens
  misc_feature: GYAE6OF02GJTBM.14.57.F02.1.454.CMB.1.raw
  modified_base (206)..(206): a, c, t, g, unknown or other
  misc_feature (206)..(206): n is a, c, g, or t
tcagcgtctagtaccacgaccggtgctcgatttagctcgatatagttgggtttgggggaggaactgctcagttaggacccagagggaaccatggaagccccagctcagcttctcttcctcctgctactctggctcccagataccacctgagaaattgtgttgacacagtctccactcaccctgtctttgtctaccgaaggggaaancgccctaccctctcctgcgacgggccagtcagagtgtacaacacctaacttacgccgttggtttaccaggcaaggaacgtcctgggccaggcctcccgaggccctcctcagtgtatggatcgctacgtacccacggacgggccacccggctaccgtcccaacggtccgtaggttaccaggtcggcgacgggtcgggtctggggaacctggtaccttcaccgttcctaccacgtactcgacgtaccacggtaccgtacggtacgtacgttaagtaagtttcgtttacggtacttaaggtttttactacgtcggtacaacggaccggtagggcggggttaacttacggtccgggcccgttaccgttacggttacccggggtttccgggggaccgggggtaaaccagggggttacgtaacgttaacgaacggttacggtcgggtacgccttagaccctagtcgttcgttcgttactccgttcctcccgtccc

SEQ ID NO: 284939 - DNA, 835 bp, Homo sapiens
  misc_feature: GYAE6OF02I5NNO.14.57.F02.1.454.CMB.1.raw
  modified_base (162)..(162): a, c, t, g, unknown or other
  misc_feature (162)..(162): n is a, c, g, or t
  modified_base (197)..(197): a, c, t, g, unknown or other
  misc_feature (197)..(197): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttganacagtctccactcacctgtctttgtctcagggaangccacctctctgcgaggccagtcagtgtgtacaacacctaacttacgtcttacggttacaaggtcaacggaacgtccttacgggacccacgggtaccttacccccgaggtaccttaccccgtaccaagtttaggacttgaacgttacggacctaacgttacccccgaacgggaacccggggtccccgaaaaccccgggcctaaccgttacccccgaaccgggtaccccgtaaccgggttttaacaaccgggtttcggggacccgaacggggtcccggggttacgttaaccggggacgttaaacggtactttacccggaaacttccgaacgttacccgaattaccggactaccgacgtaccgtacggtactacgtacgtaagtaagtttacgtacttaacgttacttaacgttacgtacgtacgaacggtacgggtacgggtacgtaacgttcggtaaccgttacgttacggtaaccggttttaccgggggaccggggggtaaacccggttaaggggtaccgggttaaacgttaacccgtaaacggttacggttacggtacgggttaacgttacgacgtaacccgtagttaccgttacgtttaccgttaccgtacgtaccgtttacccgtacccgtaac

SEQ ID NO: 284940 - DNA, 726 bp, Homo sapiens
  misc_feature: GYAE6OF02JHWJH.14.57.F02.1.454.CMB.1.raw
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (336)..(336): a, c, t, g, unknown or other
  misc_feature (336)..(336): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccgaggggtaaagcgccacccgtctccgtagcacgggccagtcagagtacgtcaacacctaacttacgcctaggtttcagtacagaagtccgtggcccaggccgtacccaggccttccngtatacggtatcgtaacngacctaacncccaacgcggaccacgtcacgtcccagccgaggttccgagtcggcctacggcgggttacgtcgggaacctagtacccttgaccgttcacctcgaaacgtcaaccgtcgacgtaccgtaagtacgtacgtacgtaacgttaacggtttcgagtttaacgtttcgttaaaccttcgggtacaacggttacgagggttaccgggtactaacggttcgaccggtactttacgtaacgggtttccgggggtaaccggggtaacgaacgggttaggtaaccgttaacgtaaacccgggtacgttacgggtacgggtccttaaccggtacgtaaccgttacgttacgtttccggttaaccttaccggtacgttttacccgttcccggactttaacgg

SEQ ID NO: 284941 - DNA, 861 bp, Homo sapiens
  misc_feature: GYAE6OF02GRLV0.14.57.F02.1.454.CMB.1.raw
  modified_base (204)..(204): a, c, t, g, unknown or other
  misc_feature (204)..(204): n is a, c, g, or t
  modified_base (836)..(836): a, c, t, g, unknown or other
  misc_feature (836)..(836): n is a, c, g, or t
tcagcgtctagtaccacgaccggtgctcgatttagctcgatatagttgggtttgggggaggaactgctcagtttaggacccagaggggaaccatgggaagccccagctcaggcttctcttcctcctgctactctggctcccagataccaccggagaaattgtgttgacacagtctccactcacctgtctttgctccagggaaancgccacctctcctagccgagggccagtcaggtacgtgtacaacctacctaacttacgtccttagggtttacagaccaggaacgtcctggccaggtcctacccgaggcctccctcgtaagtcgttacgtgtagtgtaccgtacctaccccggaacggtaaccgggaccctaccgggaccttaccgtaccccgacggtaccctaacggggtttccaacggttcggggaaccgtacgggggtaccggggttaccgggtacgggtaacgttaaccggttacccggttaccttaacccgtaccgttaccccgtaacccgtacgttaacccggaggttacccgtaaccggtaacccgttaaacgggtaacggttaacccggtaaacggtttaaacggttcgtttttaacggaaccggttttaacgtttttaaacgtttaccggttacggttaacggaccggtacggtacgggtaccgggtaccgtaaacgggttcggtaccggttccgtaccgttaccggggttaccggggacccgggggtaacgtaacggggttacgggtacccgtaacggtaacggtccggtaggttccgggtacgttcggaacccgtttacccgtattcgttacggttaccgttntaccggttacccgttccctaaccgg

SEQ ID NO: 284942 - DNA, 807 bp, Homo sapiens
  misc_feature: GYAE6OF02HYS66.14.57.F02.1.454.CMB.1.raw
  modified_base (385)..(385): a, c, t, g, unknown or other
  misc_feature (385)..(385): n is a, c, g, or t
tcagcgtctagtaccacgaccggtgctcgatttagctcgatatagttgggtttggggctgagagaggagcccagtcctgggatcttcaggtgtttcatttggtgatcaggactgaacagagagaactcaccatggaggtttgggctgagttggcttctttcttgtggctaattttaaagatgtccagtgtgagtgcagctgttggaggtccgggggagtcgttaggtacgagggtccggggggtcctggacactcctcctggtcgcacgtccgtacgaggtaattcgttaagtttttacggagtaaatactcgacctaagtggacggtccgtcggggtaccccgccgaacgggtccgtacccgggaagggggaacggggtaccgnggggtacggttggggtaccttcgacggaccgtaagttccgtaggtttacggttacgttaagggtacggtaaacgtacgtttaacggttaccggtaacccggtccgttcccggttaccgggtacgggttaaccggggttccccggtttaccgtacccgtaacgtttccccgtaccgtaaagggaaccgtaaaccgttaacgttaacccgaaaaaccggtaacctaccctttacgtttaccgttttaactttaacgaaaacgttcgggtaaccagttacccgaaagtaaacgaacggaacgtaaccgggacgggttacgtttgtttaacgtttgtaggtaacgtaaggtataacggtagtacgtaagttacgaacttaacgtaggttagggtacggtctttacggtattcgggtcgtaccgggg

SEQ ID NO: 284943 - DNA, 761 bp, Homo sapiens
  misc_feature: GYAE6OF02H2GKQ.14.57.F02.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaacttgtgttgacacagtctccactcaccctgtctttgtctccgaggggaancgccaccctctcctgcgagggtccagtcagngtcgtacaaccacaacttagccttggtttcagtcagaagcctacggccacggtcctacccgaggccctcctactacgttgttaacgtggacttcggactaaccgtaccccgaacggaccggggaccccacccggcctaaccgttccccgacggtacccgacggtttcacgggttcggaccgacggtcgggtacgtagggactagtactcgacttcaccactactacgacgactcgtaccaggtacgtctaggtaactttagtttacgacgttagtttacttattcggtacgtacgtcggacggtacggggtaactcggttccggaccgttcccgttacgggtaccggtttccggggggaaccgggggtttaactagggggttaaacgtacggtttaaacccgggaaacgtttacggttacggttccgggtcgttaacccgacccggtaacccgtttacgttacccggtttacgtttacccggtttacctacccggttttaccccggtccccgtaaccgtttaacccgg

SEQ ID NO: 284944 - DNA, 771 bp, Homo sapiens
  misc_feature: GYAE6OF02JSSDL.14.57.F02.1.454.CMB.1.raw
  modified_base (151)..(151): a, c, t, g, unknown or other
  misc_feature (151)..(151): n is a, c, g, or t
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (342)..(342): a, c, t, g, unknown or other
  misc_feature (342)..(342): n is a, c, g, or t
  modified_base (771)..(771): a, c, t, g, unknown or other
  misc_feature (771)..(771): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggganaaattgtgttgacacngtctccactccacctgtctttgtctccgaggggaancgccaccctctcctgaccgagggccagtcacgnggttctaccaacaaccgtaacgttacgccgtttaggtttccagacgagaacgcctcggaccgacggccgtaccgacggtcctacacgtatcgtaactcgtagtacnctaaccgtcccgacggaaccgggttcccgaacccggtcctaaccgtaccccgaaccggtcccggttaggtacggtcgggtaccgtaccggacggggttccgggtcggttaacgggaacctaaggttaccccgttctaacccgttcgtaccctaaccgtacaccggacgtcgaccgtacgttaacggcttacgtacgttaacgttagtttacgtacgtttaacggttattaccggttacgtaccgacggttacgacggggtacgtacgttaccggttcgtaccgttaccgtacggttaccgggtcgggtaaccggggtacggttacggcggtaacgtaaccggtacgtacggttggtaacccgttacgtacgtaccgaccgttcgtacggttccgttaccgtttaccgtcccgttaccgtaccccggttn

SEQ ID NO: 284945 - DNA, 675 bp, Homo sapiens
  misc_feature: GYAE6OF02I1RV2.14.57.F02.1.454.CMB.1.raw
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
  modified_base (613)..(613): a, c, t, g, unknown or other
  misc_feature (613)..(613): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccatcaccctgtctttgctcgaggggaangccacctntcctgccaggccagtcagagtntcaaacacaacttgccttggttcagcaagacgcctggcaggcctccgacggctcctcattgtatgatgacatccagacggccaaccggcactcccgacgcgaggttacaggtcggactaggtcgggtactacggggactacggacttcgacctactaccgaacctactacacggtaccaacgtacccgttaaggacgtacttacggtaaagttacgttttacgacgttaaacgttttacgttaaccgttacggttacaaggtacggtaacgggtccggggtaactaacgggttcggacccgttagtccgttaacggtttccgggggacggggttaaccaaggggttacggtaagttaaccgaaaccggtagtcggtaggtcctanaccgtaacccgattaccggttacgttaccgttacaacgtttccccgttaccgtaccgtaacg

SEQ ID NO: 284946 - DNA, 823 bp, Homo sapiens
  misc_feature: GYAE6OF02JDYGR.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggtcttaattttaaaagatgtccagtgtgaggtgcagtctgttggaggtccgggggaggtcgttggtacgacgggccggggggtccctgactactccgtcctgtgcacgcctcgaggtattctagtttttagacgtaagttatcgacctagttcgacggtccggttacggggtcccgaccggtacggtcccgtaccgggtaagggggaacggggtcggtaggggtaacgggttcgggtacctacgaagtacgtaagttacgtaggtttacggttaccgtaggttaaggtaaaccggttacgtacgttaccggaccgttcccggttaccgttacccgggtagggtaacccggggtcccggtttcctaccgtacgttacccgtacgaacgtaaccgtaaccttaaacgttaaccaaacgtaaccctactttaccgtttaactttaaccttacgtaaacgttcggtaaccgacgtaccgtaagaaaccgtaacggtaacggaccgtacgggttacgtttgttttaacgtttttaggaacggttaagtaaacgtagttaacggtagttacgtaacggttacttaaacccgttaacgtttaacggggttaggggttaaccggttaccctttagggtaaccgtttgggtacccgggttacgggg

SEQ ID NO: 284947 - DNA, 968 bp, Homo sapiens
  misc_feature: GYAE6OF02INNKA.14.57.F02.1.454.CMB.1.raw
  modified_base (182)..(182): a, c, t, g, unknown or other
  misc_feature (182)..(182): n is a, c, g, or t
tcagcgtctagtaccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccactcaccctnttctttgtctccgaggggaaagagcccaccctcttccctgcgacgggccagtcagagtgtccaaacgaacctaacttagtcccttaggtttcagaccgaagaacgtcccgttacggcccgtaacgggccctacccgacggtcctccctacgattcggttatacgtagtcgacctacgtacccccgaacggtaaccggggtcccccgaacccgggtccctaaccggttacccccgaagggtaccccggtaaccgggtttaccggtaaacgggttcggggacccggtaacggggtaccggggtttcccgtaaaccgggggtaaccgttaaggttaacccggttttaccctaacccgttacccgttaccctaaaccccgtaagtttacccgggaacgtacccgtaaccgggttaacccgttaacggggtaaccgtttaacgtttaaaccggtaaagggttttttaaccgtttttaggtaaacccgtttttaaggttttttaaccgtttaaccgtttccggttaaaccgtacgggtaccggtaacgggggtaccggggtaaccgttaaaggtttccggggccccggtttaccgttaacgggttttaccggggttaccggggggtaccggggggttaaccgtaaacgggggtttaccgggaacggtttaacccggttaaccgggaaccggttttaccgggtaccgggttaaccgttaaccgggtcccgtaaaccgtttagttccgttacggttccgtttaacgttacccttcccccgtttaacccgaccgg

SEQ ID NO: 284948 - DNA, 565 bp, Homo sapiens
  misc_feature: GYAE6OF02FYXL9.14.57.F02.1.454.CMB.1.raw
  modified_base (375)..(375): a, c, t, g, unknown or other
  misc_feature (375)..(375): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
  modified_base (528)..(531): a, c, t, g, unknown or other
  misc_feature (528)..(531): n is a, c, g, or t
  modified_base (533)..(565): a, c, t, g, unknown or other
  misc_feature (533)..(565): n is a, c, g, or t
tcagcgtctagtaccacgaccggtgctcgattttagctcgatatagttgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgagtctatgataccctaagtttggggacggggtcctttcattgtcgtacgggggccaaggggacgctgggtccacccgttctccttcagtccctacccaacccgaacggccccaagtccggttccttccccccttggcccaacccccttcctcccaacggacgcccnccgtaccggtcggggggaccacgtacggccgggtcccgtggggcctcggtcccgtacgggtacaaacggtacctaccgtttaccgtaacgtagaccgtctggacggcggggccgtgggacgaacggccggtacgaacgtcgntacncgctgcnnnncnnnnnnnnnnnnnnnnnnnnnnnnnnnnnnnnn

SEQ ID NO: 284949 - DNA, 822 bp, Homo sapiens
  misc_feature: GYAE6OF02JJB1F.14.57.F02.1.454.CMB.1.raw
  modified_base (795)..(795): a, c, t, g, unknown or other
  misc_feature (795)..(795): n is a, c, g, or t
tcagcgtctagtaccacgaccggtgctcgatttagctcgatatagttgggtttgggggaggaactgctcagttaggaccagagggaaccatggagccccagctcagcttctcttcctcctgctactctggcctcccagactaccaccggagaaatttcgtggttgaactacaggtctccactcacccttgttctttggcttaccgaaggggaaacgcgacccacccttgtaccctggaccgacggggcctacgtcgacgtaggtcgtaccaaaccgaccctaacgttacggcccgttagggtttaccaaggtacaaggtaaccgtccgttacggggacccaaggggtccctaccccgagggtccttcccgtagtatcggtataggcttacgactaccgtacccgacggacggaccccgtacggactaccttccgacgtacgttacggtacgacgggtcgacgacgggtccggggtacgtacgggacctaggttacccgtactaccgttcgaacctacccgataccgacggtaccacgttaccgtaacgggtacttccgtaaagggtaacgtttacggtttacgtaaccgtttactttaaccggtttaacgtcggttaaccgttccgggaacgggttaacgggggaccggtaaccgttacgggttacccggtcccgttaagttacccgggtaacgggttccggggaacggggttacggtacgggtacgttaacgggtactacgggtagtcgggttctacgttacggaaccttacgtaccgttccggtcgtttaccncggttaacccgtttcccgacgtttacc

SEQ ID NO: 284950 - DNA, 841 bp, Homo sapiens
  misc_feature: GYAE6OF02H0A8M.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactagaacagagagaactcaccatggagtttgggctgagttggctctttcttgtggctattttaaaagatgtccagtgtgaggtgcagcttggtgggacggttccgggggaggtcttcggtacgacgggtcccgggggggtccctgaccgacttccgtcccgtgtacgcgacgccttacgaggtacttcttagtttttacgacgtaaacttagtcacccgtagtcgtaacggtccgtcgggtaccccgacgtaacggtcccgtacggaaggggtacgggtcgtagggacggttcggtacctacggacgtagtaacgttccgtaggtttacggtttacgtaaggttaacggtaacgtacgtacgtttccggaccggttcccgtacgtacccgggtacggtaacccggggtccgtttaccgtacccgtatcccgtacgaacggtaacctaacgtaaccgtaccgaaacgtacccttactaccgtttactttaccgtaaacggtaacttcgaaaccgtcgtaaacccgttaaggaaaccgtaacggtaaaccggtaccggtaacgggttcgttaaccggttttttagttggtttaacggtaagtaaaccggttacgttaaccggtaacgttcggttaaaggttacaaccccggtttaaaccggttaggtttaccggggggttacgttaacccggtttaccggtaagttcccgggttaacgggttacccggggg

SEQ ID NO: 284951 - DNA, 785 bp, Homo sapiens
  misc_feature: GYAE6OF02JQ6TF.14.57.F02.1.454.CMB.1.raw
  modified_base (182)..(182): a, c, t, g, unknown or other
  misc_feature (182)..(182): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggcttctttcttgtggtctaattttaaaagntgtccagtgtgaggtgcagcttggttggacggtccgggggaggtcgttggtacgacgggtcccgggggggttccctggaccgtaccttccgtcccgtggtcgaccacgccgtccgaggtatttacgtatttttaacgacgtaatatcgacctagtgacgtcgtacggtcccgccgacggccgtccggaaggggacgggcgtgggtacggtcgggtacgtacgacgtacgtaatacggtaggttcggttacgtagggttacggtaacgtaactacgtttaccggaccggtcccgttcgtcccggtacggtaacgggtcccgtttacgtaccgtactaccgttaccgaacgtacggtaacctaacgttaaccgaaacggtaaacctaccttacgttactttaacgttaacctaacgtacgggacctaacgtaccgtaagaaacgtaccggaaacgaaccggtacgggtaccgtttaggtttaacttttggacgttaagtaaagttacgtaaccgtaagttcgttaacgttacggtaaacgtttaccgtaacggtttcggggtaaccggttaccgtttaccgaggtttaccggtcggtacccgggg

SEQ ID NO: 284952 - DNA, 816 bp, Homo sapiens
  misc_feature: GYAE6OF02HJ85Y.14.57.F02.1.454.CMB.1.raw
  modified_base (531)..(531): a, c, t, g, unknown or other
  misc_feature (531)..(531): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccacggagaaattgtgttgacacagtctccactcaccctgttctttgtctccgaggggaaagacgccaccctctcctgcagggccagtccagagtgtcaacaccaacttacgccttggttcagctaagaacgcctggccaggccctccccgaggacctcctactactggtaactggacttcggacctaacttcccccgaaacggtacccgggggaccctaccccggggacctaaccggttacccccgaacggtaccccgtaacgggggtttacctaacggggttccgggccgtaaaccggggttccggggggttacccgtaagggggggtaacctaccggttaccgtttcccgtaaaccttaccgtacccgaaacccctaagttcccgaancccgtaaccgttaccgtaaggtaccgttccggtaaggtaacgttcgttttacgaccgtttaaggttttaaccttacgttacggttaccgtaacgccgtaagggcggggtacctaggtacgggtcccgtccgttaccgtacgggtttccgggggaccggggtaaccggtaagggtcggttaaaccgtaacggtaaaccgtacgttacggaccggtacgtacgtaccctaaacgtcgtttacctcgtttaccgtacccttagtacccccggttcccgtcgttaaccg

SEQ ID NO: 284953 - DNA, 754 bp, Homo sapiens
  misc_feature: GYAE6OF02IPA4C.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgatttagctcgatatagttgggtttgggggaggaactgctcagttaggacccagagggaaccatggaagccccagctcagcttctcttcctctgctactctgctcccagataccaccggagaaattgtgttgacacagtcctccactcaccctgttctttgtctccgaaggggaaanagccctaccctctcctgccacgggtccagtacgagtagttcgtaccaaacctacctaaaccgtttacgaccttgggttttcaaggcaaacggaaacgtccgttaggcccgacggtacctacccccaagggtccttaccccgttacgtaagtacgtaagtttcgtaactacggtacctaacgtaccccgaaccggtacggggaccccgaaccgggactaccgtaccccgacgtaccgtaaggtttcccgaagtcggactaacgggtccgggtacgttacggggaactaacgtaccttacgtacttacccgaacactaacgtcaacgaccgtaacgtccgtaacgacgtactacggtaaagtttgtttagtacgttaacgttttagttaaccgttagttaaccacgtcggacgggtacggtattaacggttccggccgttacgtaccgtttacgggtccggggtaacgggacggtaaggtacgttagtaaccgaacgtagtgtagtcgtacacgtacctacgtcttcggtaccttgcccgttactaccgtc

SEQ ID NO: 284954 - DNA, 962 bp, Homo sapiens
  misc_feature: GYAE6OF02G3QBT.14.57.F02.1.454.CMB.1.raw
tcagcgtctagtaccacgaccggtgctcgatttagctcgatatagttgggtttggggctgagagaggagcccagtcctgggatcttcaggtgttttcatttggtgatcaggactgaacagagagaactcaccatggagtttgggctgagttggctctttcttgtggtctattttaaaagatgtccagtgtgaggtgcagcttggttggacgggtccgggggaggtcgtttgggtacgacgggtccgggggggtccctgaccgactctcctggtgcgacgcctcgaggtattctattttagacgtaatactgcctagtggacgtcggtcggggtacccgaccgtacgggtccttaccggggaagggggtaacggggggtaccgttggggaccggggtttacgggggttacccttcggaacggaacttaaccgtcggtaacgggtttcgggtttacgttaacgggggttaaggtaaacggttaacgtaacggtttcccggaacccggttcccgggtttcccgttacccgggtacggggtaaaccgggggtttccccggttttaccgtacccgtacgttcccgtaccctaaacgggaacgtaaacccgtaaacgtttaacccgaaaacggtaaaccctttaaccgttacccgtttaaagttttccctttaaaacgaaaacggtttaacgggtaaccgtacccggttaaccgtaaacggaaaaccgggtaaaccgggtaaaacgggtaacccgggtaccgggggtttaccgttttacgttttttaaacggttttttcgggtaacgggtttaaacgtaaacggttaacgggaaaccgtttaaacggtttcccggttaaagttaaccgttaacccgtttaaacccggttaaacggggtttttcggggggtacccgggttttaacccgttttccggtaaggttttccgggttaacggggtacccggggg

SEQ ID NO: 284955 - DNA, 869 bp, Homo sapiens
  misc_feature: GYAE6OF02GMLI7.14.57.F02.1.454.CMB.1.raw
tcagcgtctagtaccacgaccggtgctcgatttagctcgatatagttgggttttggggctgagagaggagcccagtcctgggatcttcaggtgttttcatttggtgatcaggactgaacagagagaactcaccatggagtttgggctgagttggctctttcttgtggcttaattttaaaagatgtccagtgtgaggtgcagctgttggagtccgggggagtcttggacgacgggccggggggtccctgacacgtctccgtgtgcacgcctgaggtattctagtttttagacgtaattagcgaccagttagacggtccgtgggggtaccccgacccgtaggggtacccttacccggggaaaggggggtaacgggggtccgttaggggtacgggtttcggggttaccttccggaacgggtcgtaacgtccgtaacgggtttcgggtttacgtaacggttagggaaactttaaccgtacggtttacccggacccggttacccggttccgttaaccccggggtagggttaaacccggggttccccggtttaccctaccgttacgtttcccgtaaccgtaacggtaacggaaaccccttaaacgtttaacccaaaagggttaaaccttaacgttaggtttaacgttaacttccgttaacggtaaacccgttaaaagttacgtaaacgttaccggaaccgttaccggggaaagtacccggggtaccggtaacgggaaccgtaaacccggtcggttaggttaacgtttactttaggttacgggtacggttaccgaagggttacggtacgggtttaagggggtacgggggttaggttaacggaccgttacgggaacggtttaagttgtttaaccggg

SEQ ID NO: 284956 - DNA, 883 bp, Homo sapiens
  misc_feature: GYAE6OF02GAO7W.14.57.F02.1.454.CMB.1.raw
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttcgtctccgaaggggaagacgccaccctctcctgcgaggccagtcagagtgtcaacacctaacttcgccttggttacagacgaagaacgccgtcggaccgaggcctacccgacggccttccctcgagttcgttatcgtacgttgacctacgtacccccgacggaccggggtccccgaacccggcgtaacccgtccccgaacggaccccggtagggtttacccgaagggtccgggtaccggtaacgggtccggggttaccggtacggggtaaaccgtaacggttaccccgttacttaacccgtacccgttaaccgtaaccccgtaagttacccggaacccgtacccgtaaccggtaacccgtaacgggttaaaccggttccgttaaacggtaaacggttttagtttaaccggtttaagtttaacggtttaactttacggtttacggtaccgtaacgggtaccgtacggggtaccggggtaaccgtaaaccgggttccggtcccggtaacgttcccgggttaaccggggttacccggggggtaaccgggggggtaaacccgttacgggggtacggttaaccggttaaacggtaaaaccgggtaccggttagggtccggtacggtaccggtaacccgtaaccgttacgttccgttacggtttccgtaacccgttcgtacccccgtttccgacccgttaccg

SEQ ID NO: 284957 - DNA, 807 bp, Homo sapiens
  misc_feature: GYAE6OF02FM2S6.14.57.F02.1.454.CMB.1.raw
  modified_base (262)..(262): a, c, t, g, unknown or other
  misc_feature (262)..(262): n is a, c, g, or t
tcagcgtctagtaccacgaccggtgctcgatttagctcgatatagttgggtttgggggctgagagaggagcccagtcctgggatcttcaggtgttttcatttggtgatcaggactgaaacagagagaactcaccatggagtttgggctgagttggcttctttcttgtggactattttaaaaagatgtccagtgtgaggtgcagctgtggaggtccgggggaggcttggtacagggccggggggtcctgacgactcgtcctgngcagcctcaggtattcattttagacgaatatcgcatggagtcgtcgggtaccgaccgacggcttacccggaagggaacgggggtcgtaggggtacggtcggggttctccggagtaccgaattcggtaagttcggtttactaagggtaggtaacgtaacgtacgttacccggtacgccccggttccttacccgggtagggtaaccggggttaccccgggtttaccacccgacgtttaccgacccgttaagggaaactaaccgttaaattaaacccggaaagtaaaccctaactacccgtttaagtttaccttaactaaaacgcggtaacaccggtcctaaacggaaagggaaccgtaacggaaacccgtaccgggggttacgttaccggtttaagttttcggttaaggttaaagaaaccggttaacgttaacggaaacgtttacgtaaacgtaaccgttaaccgtaaaaccccggttaggtttttaacggggggaaccggtttcccgttttaacgaccggttttacgggacggggttaacccgggg

SEQ ID NO: 284958 - DNA, 810 bp, Homo sapiens
  misc_feature: GYAE6OF02JRMGD.14.57.F02.1.454.CMB.1.raw
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaactcaccatggtagtttgggctgagttggcttctttcttgtggcttaattttaaaagatgtccagtgtaggaggtgcagtcttggttggacggtccgggggaggcgttggtacgacgggtccggggggtccctgactaccttctcctgtcncgagcctcgagtnttactagttttagacgtaattancgtccagtgtacgtcggtcgggtacccgcgtacggtccgtaccggaagggggtaacgggtcgtagggacggttcgggtcctacgacgtacgtaacgtacgttaggttacggttacggtaagggtacggtaacgtaacgttacggttaccgaccggttaccttaccggtacccggtaacggggtaaccgggtcccggtttactaaccctacgttcccgtaaccgtaagggtaaaccgtaaccgttaaacctaaccgtaaaacggtaacccttaaccgtttaccgtttaccttaaccgttaaaccgtaacgttcggaaacctacggtaaccgtaaaggaaaccgaaccgtaacgaaccgggtacgttacgttaagtttacgttttggaacgtttaacgaaaccgttagtaacggtaacgtcttaacggtactaaaccgttaacgttaacgggttacgggttacggttaccttagtacggtttacgtaccgggttaacggg

SEQ ID NO: 284959 - DNA, 867 bp, Homo sapiens
  misc_feature: GYAE6OF02IGMSP.14.57.F02.1.454.CMB.1.raw
  modified_base (205)..(205): a, c, t, g, unknown or other
  misc_feature (205)..(205): n is a, c, g, or t
tcagcgtctagtaccacgaccggtgctcgattttagctcgatatagttgggtttgggggaggaactgctcagttaggacccagagggaaccatggaagccccagctcagcttctcttcctcctgctactctggctcccagataccaccggagaaattgtgttgacacagtctccactcaccctgtctttgtctccgaggggaaanacgcccaccctcttcctgcgacgggaccagtcagagtcgtcaaaccaccaacgttacgaccgttggtttaccagaccagaacgtccgtaggacccgaaggccctacccgaggtccttccctctagttcgtacttcgacgtacggacctactaccccaacgggccgggaccccgacccggacaccgttaacccccgacggtaccgtaacggtttcgaacgggttcggccgtacggggtcggggttacgtacggggaacgtaacgtaccttccgtaaccttcctaacccaccgtacgtcgtaacgccgtaaccggtaccgttaacgggtacgttaacgttaaggttaaacggtttacttttacggtacttttacgtttttaaccgttacttacggttacgaacggtacggtaccgggtaccgggtaacgttacgttaccgggtaccccgttacgtaccggtttaaccggggtttacccggggggaccggggggttaacgaaaccgggggtttcggtaaccggggtttaaccgtaaaccggtaaccgggtttagggtacccgttaccgggtaaccggtaacccgttaccgttaacccggtttcgttttacccgggttttaccttacccggtttaccccggttttaccccggttccccttaaccgg

SEQ ID NO: 284960 - DNA, 745 bp, Homo sapiens
  misc_feature: GYAE6OF02JDH6L.14.57.F02.1.454.CMB.1.raw
  modified_base (204)..(204): a, c, t, g, unknown or other
  misc_feature (204)..(204): n is a, c, g, or t
  modified_base (359)..(359): a, c, t, g, unknown or other
  misc_feature (359)..(359): n is a, c, g, or t
tcagcgtctagtaccacgaccggtgctcgatttagctcgatatagttgggtttggggaggaactgctcagttaggacccagagggaaccatggaagcccccagctcagcttctcttcctcctgctactctggctcccagactaccaccggagaaattgtgttgacacagtctccactcaccctgtctttgtctccgagggaagngcccacctctctgcgagggccagtcagagtcgtacaaccaacctaacgttacgtccgttggtttcagcaagaacgcctgccgaggcctccgaggcctcctcagtgtaacgtgactgcacctacccgacgaccgggtcccaacccggtcctaaccnccccgaacggtacctacgggttacgaggtaccggcgtaaccggggtccggggtactaccggggaacctacgtacccttcgaccgttactacccgaactacgtcgaagcccgaagtccgtaaggtacgttccgtaaagtagttatttcgtagttaacgttttgttaacgtacgttcgaacgtacggtacggtaccggggtaacttacggttccggaacccgttcgtacgtttacccggggttacgggggacccggggtaaacgttcgggtaagggttaccgtaaccgttaaccgggtggtttaccgggcggttccgtaacgtccgtaaccccgtgtttcccggttaacggtttcccttaacgccgtttacccccgttacggtacccg

SEQ ID NO: 284961 - DNA, 657 bp, Homo sapiens
  misc_feature: GYAE6OF02F14KU.14.57.F02.1.454.CMB.1.raw
  modified_base (154)..(154): a, c, t, g, unknown or other
  misc_feature (154)..(154): n is a, c, g, or t
  modified_base (339)..(339): a, c, t, g, unknown or other
  misc_feature (339)..(339): n is a, c, g, or t
  modified_base (381)..(381): a, c, t, g, unknown or other
  misc_feature (381)..(381): n is a, c, g, or t
tcagcgtctagtaccacgaccggtgctcgatttagctcgatatagttgggttttgggggagggaactgctcagttaggacccagaggggaaccatggaagccccagctcagcttctcttcctcctgctactctggctcccagataccaccgganaaattgtgttgacacagtctccactccaccctgttctttgtctccgaaggggaaagagcccaccctctcctgcgacgggccagtcagagtcgtaccaacaacctaacttacgccttgtttacagcgacgaagccgtcggccgacggcctccccgaaggccttcccgcaagttgtatgtatcgacnctcccgagtcggcccgacggcacgtcccgcgaccgtaggtcncggtcggacaggggcggtcgaggacgtgaccttcgacttccacacctactaccgagtccacgtcgtacgcgttacgagtaagttactttggtacttagttttacgtacgttgtactcggacgtaccgggagttacgtaacgttcggacgttcctcggttaccgggtcggggtaccggggtaaccgtagggtcggtaacgttaacgacgttacgggtcggtcggaaccgttcgactaacttggttcttacgttcgaccgtttcctccgttcctaccg

SEQ ID NO: 284962 - DNA, 735 bp, Homo sapiens
  misc_feature: GYAE6OF02GL6L7.14.57.F02.1.454.CMB.1.raw
  modified_base (234)..(234): a, c, t, g, unknown or other
  misc_feature (234)..(234): n is a, c, g, or t
tcagcgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacgagtctccactcaccctgtctttgctccgaggggaaagagcctaccctctctgccgacgggccagtcagngtgacaacaccaacttgccgttgttcagcagacgctggccaggcctcccgacggcctcctcgattgtatgatgcactcccgagaccgggccacggcaccgtccgacgcgtagtccgaggtcggcctaggtccgggtcgtagggactacggtacttccaacctcgtaccaccgataccgaggtaccaccgtacgtaacggccgttagtaaggtagtttagtttcggtaacctttaattttaacgtttaccgtagtacgtacgacgtaccggggacggtacgtacggtttcccgggaccgtccgtttaaccggggttaccgggtttccgggggggaacccggggttaaccgggtaaaggggtttaccgggtaaacctttaacgggaaacccggtttaccgggtagggttaccggttccggaccttaacccgtacgtttacgtttacgttccccggttaatttaccccgtaccggtttccccgtttaccccggatttacccggg

SEQ ID NO: 284963 - DNA, 859 bp, Homo sapiens
  misc_feature: GYAE6OF02GK4OL.14.57.F02.1.454.CMB.1.raw
  modified_base (201)..(201): a, c, t, g, unknown or other
  misc_feature (201)..(201): n is a, c, g, or t
tcagcgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtagttgacacagtctccactcaccctgtctttgtctccaggggaaanagccacctctcctgcagggccagtcaggagtcgtacaacaccaacttagcccttaggtttacagtcaaggaacgccctgggccctaagggcccttaccccgaagggtccttcccgtactactggttaatcgtagtcggacctaacgtacccccaacggtacggggccccaaccgggtacaaccgttacccccgaagtccccgtaagggtttccgaacgggttcgggaccgacgggtcccggggttacgttacgggggaacctaacgggttacccttttaccgaaccgtttcccgtacccgaaaacccttacgtacccgaacggtacccgaaaccggttacccgtaaacgggtaacgttaccgttaacggtaaaacggtttacgttttacggtaaccgtttaacgtttttaacgtttaaccgttacggttaacgtaacgtaccggtaacgggaccggggttaccgtaacggttcgggtacccgtacgttacccgttaccggggttttaccgggggaccgggggtaaccgtaacggggttacggttaacggttaaccgtaaaccgggttacgtacgggttaccggtcgttacggtacctaaccgtacgttaccgttacgttacctttaccgtaccgttcccgttacccgtaccgttaccg

SEQ ID NO: 284964 - DNA, 796 bp, Homo sapiens
  misc_feature: GYAE6OF02JDTEZ.14.57.F02.1.454.CMB.1.raw
  modified_base (249)..(249): a, c, t, g, unknown or other
  misc_feature (249)..(249): n is a, c, g, or t
tcagcgtctagtaccacgaccggtgctcgatttagctcgatatagttgggtttgggggggaactgctcagttaggacccagaggaaccatggaagccccagctcagcttctcttcctcctgcctactctggctcccagtactaccacggagaattgtgttagacactagtctccactcaccctgttcttagtctcgaagggaaagcgccctacctctcgtcgacgtacggcctaggtacaggtacggtntacaaaccaacccgtaaacgttacggcctttcgggtttacaggtaccgaaggtaaccgtccttacgggacctacgggtacccctacccgacgggtacccttccgttacagttcgttaactaggtactcggacctacctacccgacgaacgggtccccaaccggtaacacccgtacccgtacggtaccgtaggttccgtaacggttcggccggtaaggtccggacggtacgggaccgtacgtacttccgtactacgttaccacttacactcggtaacctacggtaacgtacgtacgtccggtaagttatttacgttacgtactttacgtttaacgtagtccgtactacggtacggtaagggccgtacgtaccgttacgtccggttacgttaacgggttccgggtacgggaacccgggttaaacggttcggtaaacgggttacccgtaaagggacccgttagggttcggtacggtctacccgtaattccgggttcctaacgtttccgttaaccttacggttcccctacccggttacctaccgttaccgg

SEQ ID NO: 284965 - DNA, 861 bp, Homo sapiens
  misc_feature: GYAE6OF02F0ZH8.14.57.F02.1.454.CMB.1.raw
  modified_base (192)..(192): a, c, t, g, unknown or other
  misc_feature (192)..(192): n is a, c, g, or t
tcagcgtctagtaccacgaccggtgctcgatttagctcgatatagttgggtttggggctgagagaggagcccagtcctgggatcttcaggtgttttcatttggtgatcaggactgaacagagagaacctcaccagtggtaggtttgggctggagttggcttcttttcgttggtggtacttaattttaaaagngttacgtccagttggtaggaggtgctagtcgttggttacgggtacgggtccgggggaggtcgttacggtacggacgggtcccgggggggtacctacgaactcgtcctccgtggtacgcgtacgcctacgtaggtcttacttaagtttacgaacgtacgtatcgtacgagtagcggtacggtccggtcccgaaccggcggtaccggttaccgggaacgggggttaacggggcggttagggaggggttccggttcgacgtaagcccgttaaagtcgttaggttacggtttacggtaggtttaacggtaaccggttacctacgttaccccggtaaccggttccggtaccgggttccgtaaacgggggttccgggttcccgtttacccgtaccgttctttacccgacgtaaacgggtaactaaacccgttaactaaaccaaaccgttaaacgttaacccttagtttacctttaccgttaaacgaaccgttaggtaccgaactacgtaaacggaacggtaaaccgacggtaaccgtcggggttaaacgtttgtttacgttacggtaagtaacgttaaagtacgttaagtaacggttatacccgtaagttaacctaacgggttacgggttaacgtccgggtttcttacgtaacggttcggacgggttaacccggg

SEQ ID NO: 284966 - DNA, 860 bp, Homo sapiens
  misc_feature: GYAE6OF02HFXI9.14.57.F02.1.454.CMB.1.raw
tcagcgtctagtaccacgaccggtgctcgatttagctcgatatagttgggtttgggtgcccaagctgctggagggcacggtcaccacgctgctgagggaggcttggtacaggccggggggtccctgacactctcctgtagcagcctctggtacttcctaccttctacgttacctagtgtctatcgccacgttcgggtcccgaccgagggtccctacccgaggaccgggacggggtcggtacgggtagggttgggggtcgggtaccgttaatttaacttacttaccgaacgtagttaggtacgttacggtaaaacgttaacgtaacggtaccgtacttaaggtcccggtaccccgttacggttcccggggtaagggaacccgggtccgttacttaccccgaaccttacgttcccgaacgtaacggtaacctaaacttacccggaaaacgtaaccgaaacccgtccgtaaagttaaccggttactacgggtaactaaaacgtaacggaaccgaaccggtccgtaaggtaggaacgtaccggttaggaacgggtaccggaaccgggtttacttgggtttacgtttaacgttacggttacgggggtggttaaaggacgtacggttaggtaggtacggtagttaagttggttaggttaggttcggtagtcgtacgttacgtacgttacgtacgtacgtaccgtaccggtaccggaccggaccggtaacggtcccgtccgtacctccgttccgtaccgtacctaccgtaccgaccgtaccggtaccgtccgtaccgttcccgtaccgtcccgtacccgtacctacccgtacgtaccgaccgtccgtcccgttccggcggtacccgg

SEQ ID NO: 284967 - DNA, 504 bp, Homo sapiens
  misc_feature: GYAE6OF01B2202.37.5.A05.1.454.CMB.1.raw
  modified_base (292)..(292): a, c, t, g, unknown or other
  misc_feature (292)..(292): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagactacttgcttggtaccaacagaaagcaggacagcctcctaagttnctctattactcggcatccacccgggcagtccggggtcctgaccgattcagcggcaggcgggtctgggacaggatttcgactctcacatcagcagcctgcaggctgaacgtatgtggctagtttatttctgtctgctagttatttcgggactccgtcggtactttcggcgcgtagggaccaaggtggaagagtcaaggcgaactggtgctacg

SEQ ID NO: 284968 - DNA, 510 bp, Homo sapiens
  misc_feature: GYAE6OF01CPO1A.37.5.A05.1.454.CMB.1.raw
  modified_base (339)..(339): a, c, t, g, unknown or other
  misc_feature (339)..(339): n is a, c, g, or t
  modified_base (404)..(404): a, c, t, g, unknown or other
  misc_feature (404)..(404): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgttcagcgtcgacaataagaactactttgcttggtaccaacagaaagcaggacagcctcctaagttgctcatttactcggcatccacccgggcatccggggtcctgaccgnttcgagcggcaggcgggtctgggacagtactttcactctcaccatcagcagcctgcagctgaagntgtggctagtttattctgtctgtcagttatttgggtctccgtggtactttcgggcgcgtacgggaccaagggtggagattacgaaggacgaattcggtggctacgg

SEQ ID NO: 284969 - DNA, 588 bp, Homo sapiens
  misc_feature: GYAE6OF01DQABQ.37.5.A05.1.454.CMB.1.raw
  modified_base (305)..(305): a, c, t, g, unknown or other
  misc_feature (305)..(305): n is a, c, g, or t
tcagtagtgtagatcacgaccggtgctcgatttagatagatagacagggggagctacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactactagcttggtatcagcagaaaccagggcagcctactaactgctcatttacgngggcactcgtacccgggagtcccggggtcctgaccgattcaggtggcaggcgggtctgggacagtatttcactctcaccatcaacagcctgcaggtctaggacgggtatggtaggtacgtaattttactacgtgtcaacggtactaagttaattaataacttaccttccgtacccggtaacgttccgggaccaaacgggtaaccgtaaagggttaacggaaaacttaccgtaaaaaccggacgtttcgggacggtacctacgacctaaccgtattcgttaccg

SEQ ID NO: 284970 - DNA, 531 bp, Homo sapiens
  misc_feature: GYAE6OF01CK5EV.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactacttgcttggtaccaacagaagcaggacagcctcctaagtgctctatttactcgcatcccgaccgggcacgtcccggggtccctgaccgtattcgagcggcacggcggggtcgtgggacagtactttcactctcaccatcagcagcctgcaggctagaagatgtggctagtttatttctagttcgtgtactaattagtttacgggtacttccgttcggtactttcgggcgacgacgggtaccgaagggtggacgtatcgaacggcgaagtggtggcgtacg

SEQ ID NO: 284971 - DNA, 548 bp, Homo sapiens
  misc_feature: GYAE6OF01ED6I3.37.5.A05.1.454.CMB.1.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
  modified_base (357)..(357): a, c, t, g, unknown or other
  misc_feature (357)..(357): n is a, c, g, or t
  modified_base (414)..(414): a, c, t, g, unknown or other
  misc_feature (414)..(414): n is a, c, g, or t
  modified_base (420)..(420): a, c, t, g, unknown or other
  misc_feature (420)..(420): n is a, c, g, or t
  modified_base (471)..(471): a, c, t, g, unknown or other
  misc_feature (471)..(471): n is a, c, g, or t
tcagtagtgtagatcacgaccggtgctcgatttagatagatagacagggggagctacaacaggcagggcaggggcagcaagatggtgttgcagacccaggccttcatctctctgttgctctggatcactggtgcctacggggacatcgtgatgacccagtctccagactccctggctgtgtctcgtgggcgagaggcctccatcaactgcaagtccagccagacttgttttanacagcctaccaaacaataagaactacttagcttggtatcagcagaaaccagggcagcctacctaaactgctacatttacgngggcacgtccgtacccgggaggtcccggggtccctgacccgtnttcgaggtcggcgaggcgggtcgtagggacagtactttcacttctcacctatcaacncgtccngcgaggctggaggagtggtggacgttatttatacgtgtacagtctaagttnttaatactacctcctaccgtcgtccgacgacgggacgtaagggtacgaactacgaaacgactgtaggctcgcacgta

SEQ ID NO: 284972 - DNA, 566 bp, Homo sapiens
  misc_feature: GYAE6OF01A6Y1Q.37.5.A05.1.454.CMB.1.raw
  modified_base (304)..(304): a, c, t, g, unknown or other
  misc_feature (304)..(304): n is a, c, g, or t
  modified_base (406)..(406): a, c, t, g, unknown or other
  misc_feature (406)..(406): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactacttgcttaggtaccaacagaaagcaggacagcctctaagtcgctctatttacncgctactcccgacccgggcacgtccggggtccctgaccgattcgagccggacaggcgggtctgggacagtactttcactctcaccatcagcacgcctgcagntagagatgtggctagtttacttgtagttcgtgtactaggtttacgtttcgggtaccttccgttcggttaccgtttccgggaccggtacggtaacggggtacccgtaagggggttcgaacgtacgttacggaaacggaccgtaaagtcggtggtcgtaccg

SEQ ID NO: 284973 - DNA, 776 bp, Homo sapiens
  misc_feature: GYAE6OF01C0SYX.37.5.A05.1.454.CMB.1.raw
  modified_base (240)..(240): a, c, t, g, unknown or other
  misc_feature (240)..(240): n is a, c, g, or t
tcagtagtgtagatcacgaccggtgctcgatttagatagatagacagggggagctacaacaggcaggcaggggcagcaagatggtgttgcagacccaggccttcatttctctgttgctctggatctctggtgccgtacggggacaccgtgatcgacccagtctccagacctccctggctgtgtctcgtgggcgaggacgggcctccatcaactgacaagtccagccagtacttgttttanacagctaccaaacaataacgaacttacttagtcttaggtatacagacaacgaaaccgagggaccaacggcccttaaccgtaaactcgtaccttacgtaacgttttacgcgggtacctaacgttacccgggttaaccccggggtaccgggttccccgggggttaccctacgggtaacccgttacgttaccggtaacgggtcgggaccgtaacgggtccggggttacggtacgggggtaacctacggttacttttacccgaaccgtttcctaccctaacctacttaaccgaaaccgtcgtacccgtaggaccgtaacgggccgttagggacgggtagttcgggtacggtacgtttaacttttacgtaacggttcgtacgtaaggtacttaaggtttaactttaactaaccgttcccttacccgttacccggtacggttaccggaaccgggtaaacggtaaaccgtaaggggtaaacgtaaacttaccggaaaacggttacgttaggtaccggtctacgacctaacctgttcgttaccg

SEQ ID NO: 284974 - DNA, 528 bp, Homo sapiens
  misc_feature: GYAE6OF01BEQ6Y.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccacccgggcactccggggtccctgaccgattcgagcggcaggcgggtctgggacagatttcactctcaccatcagcagcctgcaggctgagatgtgctagtttactttctgtctgtctagttagtttcgggtactccgttcggtaccgtttcggccgtacgacgggtaccgaaagggtggaagactacgtaaggccgaaacgtcgtgggtctacgg

SEQ ID NO: 284975 - DNA, 569 bp, Homo sapiens
  misc_feature: GYAE6OF01BYT5Q.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagacttcttttgtcagcgtcgacaataagaacttactttgcttggtaccaacagaaagcaggacacgcctctaagtgctactatttactcggcactcccgaccccgggcacgtcccggggtcctcgaccgattcgagcggcaggcgggtcgtgggacagtatttccactctccacctatcagcacgcctgcgaggctagagtagtggtcggtcttagttttatttcgtgttcgtgtctaggtttgtttcgggtaccttccggttcggtaccgtttcgggccgtacggacggggtaaccgtaggggtggacgtactacgaaacggtacggtaaaggtcggttggcgtacgg

SEQ ID NO: 284976 - DNA, 542 bp, Homo sapiens
  misc_feature: GYAE6OF01BL3UJ.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctctaagttgctcatttactcggcactccgacccgggcacgtcccggggtccctgaccgattcagcggcaggcgggtcgtgggacagtactttcactctaccaccatcagcacgcctgcaggctagaagtagtgtcggtctagttttatttcgtgtctgtactaggttagtttcgggtacctccgttcggtacgtttccggcgtcgacgggtaccgtaagggtggagagtacgaacggacgaacgtggtggtcgtacg

SEQ ID NO: 284977 - DNA, 543 bp, Homo sapiens
  misc_feature: GYAE6OF01D8M7P.37.5.A05.1.454.CMB.1.raw
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
  modified_base (410)..(410): a, c, t, g, unknown or other
  misc_feature (410)..(410): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagaggccaccatcaactgcaagtccagccagacttcttttgtcagcgtcgacaaataagtaactactttgcttggtaaccaanagaaagcaggacagcctcctaagttgctcatttactcggcatccaccgggcacgtccggggtccngaccgattcagcggcaggcgggtctggggacagtatttcactctcaccatcagcacgcctgcagctagaagtntggtgctagtttacttctagttctgtctagttgtttcgggtaccttccgtcggtacgtttccgggcgttacggaacgggtaaccgaagggtcggtaagcgtaacgaacgtacggtaactcgggttggctacgg

SEQ ID NO: 284978 - DNA, 640 bp, Homo sapiens
  misc_feature: GYAE6OF01ADERV.37.5.A05.1.454.CMB.1.raw
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (368)..(368): a, c, t, g, unknown or other
  misc_feature (368)..(368): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagacctccctggctgtgtctcgtgggcgagacgggccaccatcaactgcaagtccagccagtacttctttgtcagcgtcgacaataagactacttgcttggtaccaanagaagcaggacacgcctactaagtcgctctatttacncgcactccgaccggcacgtccggggtccctgacccgattcgacggcgcgaggccgggtcncggggtacacgtactttccaccttccgtaccaaccataccgagtacctacgcccgtgacgacgggtcctaggaaacgtgttaggtcggtacttagttttactttccgtcggttcgttcgtacgttaacggtttacgtttcgggttacccttccggttaccgggttaccggttttccgggacgtacccgggtaacggggtaacccgtaaggggtccggtaaggtaaccgtaccggtaaacggtaccggtaaggtcggttccgggacgtaccgg

SEQ ID NO: 284979 - DNA, 553 bp, Homo sapiens
  misc_feature: GYAE6OF01CDEMV.37.5.A05.1.454.CMB.1.raw
  modified_base (309)..(309): a, c, t, g, unknown or other
  misc_feature (309)..(309): n is a, c, g, or t
  modified_base (428)..(428): a, c, t, g, unknown or other
  misc_feature (428)..(428): n is a, c, g, or t
  modified_base (447)..(447): a, c, t, g, unknown or other
  misc_feature (447)..(447): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagtacttcttttgtcagcgtcgacaataagaactactttgccttggtaaccaacagaagcaggacagcctcctaagttgctctatttacncggcactcccgacccgggcacgtcccggggtccctgaccgtattcagcggcaggcgggtctgggacagtatttccacttcctccacctactacgagccacgcctgcgaggctaggaagngtggtacgtctaagttttnttctgtctgtctagttagtttgggtacttccgtagtccgttcggcgtcgacgggaaccgtaagggtcggaagtcgtaacgaacggacgtaacgtggtggcgtacgg

SEQ ID NO: 284980 - DNA, 710 bp, Homo sapiens
  misc_feature: GYAE6OF01D9G5A.37.5.A05.1.454.CMB.1.raw
  modified_base (243)..(243): a, c, t, g, unknown or other
  misc_feature (243)..(243): n is a, c, g, or t
  modified_base (343)..(343): a, c, t, g, unknown or other
  misc_feature (343)..(343): n is a, c, g, or t
  modified_base (493)..(493): a, c, t, g, unknown or other
  misc_feature (493)..(493): n is a, c, g, or t
  modified_base (686)..(686): a, c, t, g, unknown or other
  misc_feature (686)..(686): n is a, c, g, or t
  modified_base (700)..(700): a, c, t, g, unknown or other
  misc_feature (700)..(700): n is a, c, g, or t
tcagtagtgtagatcacgaccggtgctcgatttagatagatagacagggggagctacaacaggcaggcaggggcagcaagatggtgttgcagacccaggccttcatctctctgttgctctggatctctggtgccgtacggggacaccgtgatcgacccagtcctccagactcccgtggctgtgtctcgtcgggcgaggacgggcctccatcaacgtgcaagtccagaccagtacttgttttanacagcctacaacaataacgaacttactagcgttaggtatacagacgaacgaaaccgacgggcacgcccttaccaaacctgtacctacgtaactttacggngggactacgtcccgtaacccggggtacggtccccggggtacctcggaccgtagttccgaggtcggaccgagggtcggtacgtacgggactagtacttcgactcgtaccacctataccgacgacgtccgtagcgtaaggctacgggaggtntacgggtacggtacgttaacttttacgtaccgttagccgtaaagtccgttaaagttaacgtttaactaaaaccttcccgttacccgtaacccggttacgggttacccggaaacccgggaaaggttaaccggaaacgggttaacgaaacgttaaacccggaaaacggttaactccgggttacggtacccgtaancccgtaaacccgtntttaaccggg

SEQ ID NO: 284981 - DNA, 699 bp, Homo sapiens
  misc_feature: GYAE6OF01DK5SO.37.5.A05.1.454.CMB.1.raw
  modified_base (336)..(336): a, c, t, g, unknown or other
  misc_feature (336)..(336): n is a, c, g, or t
  modified_base (488)..(488): a, c, t, g, unknown or other
  misc_feature (488)..(488): n is a, c, g, or t
  modified_base (564)..(564): a, c, t, g, unknown or other
  misc_feature (564)..(564): n is a, c, g, or t
tcagtagtgtagatcacgaccggtgctcgatttagatagatagacagggggagctacaacaggcaggcgaggggcagcaagatggtgttgcacgacccaggccttcatctctctgttgctctggatcacgtggtcgccgtacggggacagtcgtgatcgaccagtcctccagacctcccgtggctgtcgtctcggtgggacgaggacgggccaacatacaacgtgacaacgtccacgccagtaccttcgttttgtcacgtcgtaccgaaataacgtaaacgtaacctttacgtttgtaccgttacggaaacccaaagaacgaacgacgaacgaacnccggtacccttacgttagtcgacttactactttacgcgactaccgtaccccgaccgggctacggtccccgggtacctaggaccgtacgtcgacgggcgacggacggtcgggtacgtacgggaatacgtctttaccaccgtccaccgtaaccncgtagaccgcaccgtcagtacgacgtacgaggtagtgttcgggtacttacggtttacgtttcgtttcgaaccgttntaaccgggtatttacgggtttaacgttccgggttaaccttcggtaacggtttccggcgggtacgacccgggtaaaggggtaccaaggggtcgaacgtaagtaccggacggtacgtagtgggtaccgtctaaccgg

SEQ ID NO: 284982 - DNA, 647 bp, Homo sapiens
  misc_feature: GYAE6OF01D9SB0.37.5.A05.1.454.CMB.1.raw
  modified_base (275)..(275): a, c, t, g, unknown or other
  misc_feature (275)..(275): n is a, c, g, or t
  modified_base (316)..(316): a, c, t, g, unknown or other
  misc_feature (316)..(316): n is a, c, g, or t
  modified_base (374)..(374): a, c, t, g, unknown or other
  misc_feature (374)..(374): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagacctccctggctgtgtctcgtgggcgagagggccaccatcaactgacaagtccagccagacttcttttgtcagcgtcgacaataagaactactttgcttcggtaaccaanagaaagcaggacacgcctaccgtaagttcgctctatttacncggcactcccgaccggcacgtccggggtccctgaccgtatcgagcgcgaggcggtcgnggacagtacttcactctacacctatacaacgacgccgtagcgtacgggctaggacggtagtggtacggtacgttaattttacttacgttcgtactacggtcgttaaagtttaatttaacgttaaaccttacccgttaccccggttacccgggttaccggttacccggggaaccccgtaaacgggggtaaacccgttaaaggggtaaggtaaaacctaaccgtaaaaccggtaacgttcgggtagggtaccctcggtaacccgtaccgttaacg

SEQ ID NO: 284983 - DNA, 732 bp, Homo sapiens
  misc_feature: GYAE6OF01CT45G.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgccgtacggggacatcgtgatcgacccagtctccagactccgtggctgtcgtctcgtgggcgaggacgggccaccatcaactgactaacgtccaagccagtacctttcgttttagtcacgcgtacgaacaaataacgaacttacgttcgtacgttacggtaaccaaacgaggaaacgcgaaggaaccacgtccctacgttaagttcgccttacgtattttaccgcggactacgtccccgacccgggctacggttcccggggtaccctggaacccgtcgttacggacggccggtacgcggggtaccgggtcgttacgggaccgtaacgttacttccgacgttcctacccacctagtaccgacggtacctaccggtccgtacggacggacgggtacccgttaagggaaccgtaggttcgggttacgtaggttttaacgttttttacgttctttacgggttcctagggttaccttagggttttacggtttaccggtacccttccggttaccgggttaccgttccgggaccgtacgggtaacggggaaccgtaggggtaggaacttacggacgtaaaccggacgttaggcggtacgtcgtaaccg

SEQ ID NO: 284984 - DNA, 551 bp, Homo sapiens
  misc_feature: GYAE6OF01B6T9U.37.5.A05.1.454.CMB.1.raw
  modified_base (305)..(305): a, c, t, g, unknown or other
  misc_feature (305)..(305): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagacttcttttgtcagcgtcgacaataagaactacttgcttggtaccaacagaaagcaggacagcctctaagttgctctatttacncggcacgtcccgacccgggctacgtcccggggtccctcgaccgtacttcgacgccggcacgggtcgggtctgggacagtactttcactctcaccatcacgcacgcctgacgaggtctagaagtacgtggtcggtacttagtttttcttcgttgtcgtgtacgttagttagtttcggtactccggttcggtacgttcggcgtacgagggtaccagggtgagtatacgacgcgaagtgtggtctacgg

SEQ ID NO: 284985 - DNA, 593 bp, Homo sapiens
  misc_feature: GYAE6OF01B0UUP.37.5.A05.1.454.CMB.1.raw
  modified_base (192)..(192): a, c, t, g, unknown or other
  misc_feature (192)..(192): n is a, c, g, or t
  modified_base (463)..(463): a, c, t, g, unknown or other
  misc_feature (463)..(463): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagngggccaccatcaactgacaagtccagccagacttcttttgtcagcgtcgaacaataagaacttactttgcttggtaaccaacagaaagcaggacagcctcctaagttcgctctatttactcggcacgtccgaccggctacgtcccggggtccctgacccgtattccgagccggcgaggtcgggtcgtaggggacacggttactttcacgtcctacaccatcaagcaacgcctgcgaggctaagaagtagtcggtaggtcttaaggtttttnttccgttggttactgtactagtttagttcggttacctccggttacggttcgttccggacgacggtaacgggtactaacggggtggaacgtactaacggaaacgggcgtaaagtcgggtacggtctaccgg

SEQ ID NO: 284986 - DNA, 835 bp, Homo sapiens
  misc_feature: GYAE6OF01AQJQ9.37.5.A05.1.454.CMB.1.raw
  modified_base (474)..(474): a, c, t, g, unknown or other
  misc_feature (474)..(474): n is a, c, g, or t
tcagtagtgtagatcacgaccggtgctcgatttagatagatagacagggggagctacaacaggcaggcagggcagcaagatggtgttgcacgacccaggccttcatctctctgttcgctctggatcacgtggtgccgtacggggacatcgtgatcgacccagtctccagacctcccgtggctgtcgtctcgtgggcgaggacggccaccataccaactcgactaacgtccgagcccgaagttacctttgttttcgttacgaacggtccgtacgtaactaaacgtaaacgttaacctttaacgttttggaccgtttaccgggtaaacccaaacgaaacggtaaaccgaccgtaacggaccgtaccgtacccttaccgttaacgttcgtaccttacgttactttaccgtcggtacctaaccgtacccccggacccgggtacgaccggttccccgggggtaccctacggaacccgtnttacggacggccgggtaccggacgggtccggggtacgtacggggtactaacggttacctttccaccgttaccgacccgtaaccaccgttaccgacgtaccgtaccgtaacccgtgaccggtacggttaccgtaaggtaacgtttgtaccgggttagttaccgttacggttttactttccgtgtttaccggttagtaccgttttaacgggttacgggtttacccgtaccggtttacccggttacggttacggtttaccgggaaccggtaccgggtaaccggggtaacggttaacggggtaggtacggtaaccttaaaccggtaccgacgggttaaccgggttcggtccggttccgtacccgg

SEQ ID NO: 284987 - DNA, 674 bp, Homo sapiens
  misc_feature: GYAE6OF01D4SJF.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgccgtacggggacatcgtgatgacccagtctccagactcctggctgtgtctctgggcgagacgggccacatcaactgacaagtccagccagtacttcttttgtcagcgtacgaactaaataagtaaccttactttgacttacggtaaccaaacgaaggaaacgcaggaaccacggcccttaccgttaaaggttcgccttactacttttacgtcggactacgtcccgaacccgggtctaccggtcccgggggtaccctcggaaccgtattccgaggcggactacgggtcgggttcgtacgggactacggtactttaccgaccttctaccgacctactcgacgcacgacctcggacgagggtctacggaagtagtggtacggtactttagttttacgtttccgttcgttcgttagtcgttaggtttacgtttacgggttacccttccggttacggttaccgtttccgggacgtacgggtaacgggtaaccgtagggtacgggaagtaacgtacggtaacggtacgtagtcgggttgccgtaccgg

SEQ ID NO: 284988 - DNA, 690 bp, Homo sapiens
  misc_feature: GYAE6OF01BV3KL.37.5.A05.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (313)..(313): a, c, t, g, unknown or other
  misc_feature (313)..(313): n is a, c, g, or t
tcagtagtgtagatcacgaccggtgctcgatttagatagatagacagggggagctacaacaggcaggcaggggcagcaagatggtgttgcagacccaggtcttcatttctctgttgctctggatctctggtgcctacggggacaccgtgatgacccagtctccagactccctggctgtgtctctgggcgagagggcctccatcaactgcaagtccagccagacttgttttanacagctaccaanaataagaactacttagcttggtatcagcaagaaaccagggcagcctacctaaactcgctctatttacgngggacacgtccgtacccggggtacgtcccggggtccctaggaccgtagttcgaggtcggcgacggtcgggtcgtaggggactaggtatttaccacttctaccaaccgtactaccgaaacctcgtacccgttagaccgtaacgggtccgtagggacgggtagtttcggtagggtaccgttatttttaacgttacgtcggttacaagtactaaggtttaactttaacgttaaacttacccttacccgtaccggttaaccgggtttaccgggaacccggtaaacgggtaaccggtaaagggtaacggtaaacttaaccggaaaaccggtaacgttcgggtacggtaccgtacgacccgtaaccttacgtccgtttaccgg

SEQ ID NO: 284989 - DNA, 722 bp, Homo sapiens
  misc_feature: GYAE6OF01DMZFH.37.5.A05.1.454.CMB.1.raw
  modified_base (676)..(676): a, c, t, g, unknown or other
  misc_feature (676)..(676): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcacgtggtcgccgtacggggacatcgtgatcgacccagtcctcagacctccgtggctgtcgtctcgtgggcgaggacggcccacatacaacgtcgacaacgtccagaccagtacgtttcttttcgtcagcgtacgaactaaagtaacgtaacttactttgtacgttacggtaaaccaaacgaaggtaaacgccgtaaggacctaacggtacccttaccgttaaagttcggtactctaacgttttacgcggtaccacgtccccgaaccgggtctacggtcccgggtccacgaccgtagttccgagccggcgacggtccgggtgtacggactagttacgttccacctcgtaccaccgtatacgacgccgtagccgttacggaccgtaggcgtaaggtaagcgttaggtaccggtacgttttacgttttacgtcttggttacgttgtacggtttagtttacgggtttacgggtcccttaccgggttaaccggttcggttaccggcccgggtaaccgggtaaaggggacccggttaaagggttacgggaacgttanaacggtttaccggacgttacccgggttggttaccggtgtaacccgg

SEQ ID NO: 284990 - DNA, 671 bp, Homo sapiens
  misc_feature: GYAE6OF01BP4O9.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactcctggctgtgtctcgtgggcgagagggccacatcaactgcaacgtccagccagtacttcttttgtacacgtcgtacgaacaaattaacgtaacttactttagtaccgttacggtaaccaacaaggaaacgcgaaggactaacggtcccttcgttaaagttcgctacgtatttaccgcggtctacgtcccgaccggtctacggtcccgggtcctacggaccgtacgttcgacggtccggacgtacgggtccgggtacgtacgggaactacgttactttccgaccgttaccgtacccaaccgtacgttaccgacgtaccgtaacgtccgtagaccgtaaggtcctaaggtaaagtccgttggtacggtctttaagttttacttcgtgttacgtcgtagttacgtttacgtttacgggtacccttcggttaccggttaccgttcggaccgtacggtaacggtacgagggtacgacgtatacgaacgtcgagttcggtcggtctacg

SEQ ID NO: 284991 - DNA, 689 bp, Homo sapiens
  misc_feature: GYAE6OF01A4DDX.37.5.A05.1.454.CMB.1.raw
  modified_base (515)..(515): a, c, t, g, unknown or other
  misc_feature (515)..(515): n is a, c, g, or t
  modified_base (529)..(529): a, c, t, g, unknown or other
  misc_feature (529)..(529): n is a, c, g, or t
  modified_base (679)..(679): a, c, t, g, unknown or other
  misc_feature (679)..(679): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggttccgtacggggacatcgtgatgacccagtctccagacctccctggctgtgtctcgtgggcgaggaggcctccatcaactgcaagtccagccagacttgtttacacgagcctaccaaactaaagtaaacgtaaccttaacgtttcgtaccgtttacggtaaaccaaaccgaaggaaaacggacgtaaggacctacgtccccgtaaccttaaggttcgaccgttactacgttttaccgtccgggacctaccgtacccccgaaccccgggtcctaaccggttccccggggtacccccgttacggacccgttagttccgacggtccggaccggacggtccgggtcggtacgggtacgtaacgtactttcctacgtcctaccacctacncacgcacgtcgtcncgacggacgtaggaagtcgtgtcggtcttaggttttactggttgtctgtacgttagtttacgttcggtaccttccgtgggttaccttcggtccggaccgtacgggaccgtagggtcggacgtacgtacgaacgtaacgtacgtcgtcggngtccgtaccg

SEQ ID NO: 284992 - DNA, 803 bp, Homo sapiens
  misc_feature: GYAE6OF01E5EOZ.37.5.A05.1.454.CMB.1.raw
  modified_base (166)..(166): a, c, t, g, unknown or other
  misc_feature (166)..(166): n is a, c, g, or t
  modified_base (658)..(658): a, c, t, g, unknown or other
  misc_feature (658)..(658): n is a, c, g, or t
tcagtagtgtagatcacgaccggtgctcgatttagatagatagacagggggagctacaacaggcaggcagggcagcaagatggtgtgcacgacccaggccttcatctctctgttgctctgatcacgtggtcgccgtacgggacatcgtagactcgacccacgtccnccacgacctccgtggcgtgtgtcgtcgtgggacggaggacggaccacctacgtaccaacgtcgaccgaaccgtccgaccgaccgtacgttacctttcgttttacgtacgacgtaccgtaccaaacgtaaacgtaacgttaacctttacgttacggtacgttaacggtaaaccaacgaaacgtaacgaccgaacggaccgtaccgtacccgttaacgttacgtacgttaccttacttaaccgtttacccgtaccggtaccctacccggtaccccggacccgggtaccgttacccgggtccccggttacccgaccgtacgtacgtaccggacggtcggtacgcggtcggtacggtacgtacgtacgttaccttacccacttacccgacctaaccgtacgtaacgacccggtactacccggtcggtcgaaacggtcgtaacggtaaataggttcgtaccggttgttacgttttatttacgttcgtagttaaccgnggtttacgtttaaccggtttacggttcccggttacccgtccgggtttaacgtaccggtcgggaaaccggtacggaaacgggttaccgaacggaggttaccaaacggttacaaccgggttcgtaacgggttcgccgtcccgttacg

SEQ ID NO: 284993 - DNA, 766 bp, Homo sapiens
  misc_feature: GYAE6OF01BCXHJ.37.5.A05.1.454.CMB.1.raw
  modified_base (734)..(734): a, c, t, g, unknown or other
  misc_feature (734)..(734): n is a, c, g, or t
  modified_base (758)..(758): a, c, t, g, unknown or other
  misc_feature (758)..(758): n is a, c, g, or t
  modified_base (760)..(760): a, c, t, g, unknown or other
  misc_feature (760)..(760): n is a, c, g, or t
tcagtagtgtagatcacgaccggtgctcgatttagatagatagacagggggagctacaacaggcaggcaggggcagcaagatggtgttgcacgacccaggccttcatctctctgttgctctggatcacgtggtcgccgtacggggacagtcgtgactacgaccctagtcctccaagcctcccgtggctggttcgtctcggtcgggacgaggacgggtaccaaccagtacaagtgacctaacgccacgaccgacgtactttcgttttcgtacgagtccgtacgtaaactaaacgttaaacgtaactttacgtttacgtaccggtttaacggaaacccaaacgtaaacggaaaacggacgaaacgggaacctaaccggtacccttaaccgttaaaggtttcgtaacctaccttaacgtttaccgtacggacgtaccgtacccggtacccggggaactaccggttaccccggggtacccctaggtaaccgtaaccgttacggaaccggtcgggaccggtaacgggtccggggttacggtacgggtaactaacgttaacgtttacctacgttcccgtaaccgaacctacgtaccgaacgcgtaccggaccgtacgggaccggtagtacggtaagaggttacggttacggtacgttttacgtacgttgtacgaagtactaagttacgttacttacgttacctacgtcgtacgttggttaccggacggtaacgacgtagnggtacgagtcgactacgaatacgngnggctcg

SEQ ID NO: 284994 - DNA, 653 bp, Homo sapiens
  misc_feature: GYAE6OF01DIKTY.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcacgtggtcgccgtacggggacatcgtgactcgaccctagtctccaagcctccctggctgtcgtctcgtgggacgaggcgggcccacgatacaacctgacaacgtccaggccggtagtttcgtttaacacaactccgaaagaattaaggtagtttcttagtcgttaggtaaccagacaacgaaaccacgacacgtccctaccgtaagctcgtcgttacgtttacgcgggtcccttacggtacccgggacttccccggggtacctaggacgtacttcggaggttcgggccgggtcgggtctagggactgtacttcgactcgtacactatccgagccgcgccgtcggacggtactacggaagtacgtggtacggttcggtttaactcgtagtacacgtactagttattacttacgttacctccgtacgtacgttacgttacgggaccggtaacgggacctaaggtcgtaacgggtagaactcggaccgtaacgacgttggaccgtcgacctaccgtaacctgttccttcgg

SEQ ID NO: 284995 - DNA, 688 bp, Homo sapiens
  misc_feature: GYAE6OF01BD7M7.37.5.A05.1.454.CMB.1.raw
  modified_base (252)..(252): a, c, t, g, unknown or other
  misc_feature (252)..(252): n is a, c, g, or t
tcagtagtgtagatcacgaccggtgctcgatttagatagatagacagggggagctacaacaggcaggcaggggcagcaagatggtgttgcagacccaggccttcatctctctgttgctctggactcactggtgccgtacggggacatcgtgatcgacccagtctccagacctcccgtggctgtgtctcgtgggcgaggacggccacatcaactgacaagtccagccagtacttcttttgtcagcgtacgaanaaataacgtaacttacttgtacttacggtaaccaacgaagtaaacgacaggaactacgcccttacgtaagttcgacttactactttaccgtcgacctacgtcccgacccggctaccggttccggggtccctggaccctagtacgaggtcggacgacggcgggtacgtggactagttacttaccactcctacctaactacgtccgaacgaccacggtacctcggaccggaggtaccgtaaggtaagtagttacgggtacgtacgtttaacgttttacgtttccgtacggttacgtcgttacgttagggtttacgtttaccgggttaccgttcccggtttcgggtaccgtttccgggaacggaccggtaacgggtaacggtacgggtaggtaacggtaactaaccggaacgtacggtacgtcggtacggtctaccggg

SEQ ID NO: 284996 - DNA, 784 bp, Homo sapiens
  misc_feature: GYAE6OF01ECOB7.37.5.A05.1.454.CMB.1.raw
tcagtagtgtagatcacgaccggtgctcgatttagatagatagacagggggagctacaacaggcaggcaggggcagcaagatggtgttgcagaccaggccttcatctctctgttgctctggatcacgtggtcgccgtacggggacagtcggtgatcgaccctagtctccagcctcccgtggctgtcgtcgtcgtgggcgaggcggccacactacacgtcgactacgtccacgtcctacgttactttcgttttacgtccgacggtccgtaacgaaactaaagttaacgtaacctttacgttacgtaccgttaacggtaaacccaaaggaacggaaacgcgaacggaccgtacgtcccttacgttaacggtcgtccttactacgtttaccgcgtactaccgtccccggaccggtccgttacccgggtcccggggtacctacggaccgttactccggacggtccgtacgggtacggtccggggtacgtacgggtactacggttacctttccaccgtttaccgaccctaacctaccgtactaccgggactacccggtacgtaccgggaccgtacggggtaaccgtaaggtaccgttacgggttcggttaacggtttacgtttttagttttcggttccgttcgttacgttccggtaggttttacgtttacggtttacccggtccgtttccggttaccgggttccggtacccggacgggtaaccgggtacggtaaccggtagggttcgtaataccggtaagaccggttgaccggttggtccgcgtaaccg

SEQ ID NO: 284997 - DNA, 500 bp, Homo sapiens
  misc_feature: GYAE6OF02GFXM7.37.5.A05.1.454.CMB.1.raw
  modified_base (401)..(401): a, c, t, g, unknown or other
  misc_feature (401)..(401): n is a, c, g, or t
  modified_base (497)..(497): a, c, t, g, unknown or other
  misc_feature (497)..(497): n is a, c, g, or t
tcagtagtgtagatcacgaccggtgctcgatttagatagatagacaggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccacccgggcatccggggtccctgaccgattcagcggcagcgggtctgggacagatttcactctcaccatcagcagcctgcaggctgaagntgtgctagtttattctgtctgctagttatttgggtactccgtcggtactttcggcgtcgagggacctaagggtggagatcgaagcgaactggtggntcg

SEQ ID NO: 284998 - DNA, 502 bp, Homo sapiens
  misc_feature: GYAE6OF02GW8V5.37.5.A05.1.454.CMB.1.raw
  modified_base (402)..(402): a, c, t, g, unknown or other
  misc_feature (402)..(402): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccacccgggcatccggggtccctgaccgattcagcggcagcgggtctgggacagatttcactctcaccatcagcagcctgcaggctgaagntgtggctagtttatttctgtctgcagttattggtactcgtcgtactttcggcgtcgagggaccaagggtggagagtacgaaggcgaacgtggtggctacg

SEQ ID NO: 284999 - DNA, 497 bp, Homo sapiens
  misc_feature: GYAE6OF02I4N95.37.5.A05.1.454.CMB.1.raw
  modified_base (386)..(386): a, c, t, g, unknown or other
  misc_feature (386)..(386): n is a, c, g, or t
tcagtagtgtagatcacgaccggtgctcgatttagatagatagacagggggagctacaacaggcaggcaggggcagcaagatggtgttgcagacccaggccttcatctctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagattcactctcaccatcaacngcctgcaggctgaggatgtggcgatttatactgtcagcagtatataatactcctcgacgttcgcaagggaccaaggtcggaaatcgaaacgacgtgtaggctggcacatcg

SEQ ID NO: 285000 - DNA, 524 bp, Homo sapiens
  misc_feature: GYAE6OF02GNHLU.37.5.A05.1.454.CMB.1.raw
  modified_base (402)..(402): a, c, t, g, unknown or other
  misc_feature (402)..(402): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccacccgggcatccggggtccctgaccgattcagcggcagcgggtctgggacagatttcactctcaccatcagcagcctgcaggctgaagngtgtgctagtttatttctgttctgtcgtagttagtttgggtaccttccgttcgggtacttttcgggcgtcgacgggtaccgaagggtggaagagttacgaaggtcgtaacgtggtggctcgg

SEQ ID NO: 285001 - DNA, 494 bp, Homo sapiens
  misc_feature: GYAE6OF02G4B6F.37.5.A05.1.454.CMB.1.raw
  modified_base (403)..(403): a, c, t, g, unknown or other
  misc_feature (403)..(403): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggcctccatcaactgcaagtccagccagactgtttatacagctccaacaataagaactacttagcttggtatcagcagaaaccagggcagcctcctaaactgctcatttactgggcatctacccgggagtccggggtccctgaccgattcagtggcagcggtctgggacagatttcactctcaccatcaacagcctgcagctgaggatgnggcatttatactgtcagcagttattataatactcctcgacgttcgcgaaggccaaggtacgaaatacaaacgacgtgtaggctcgcactac

SEQ ID NO: 285002 - DNA, 512 bp, Homo sapiens
  misc_feature: GYAE6OF02GPPTS.37.5.A05.1.454.CMB.1.raw
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactactttgcttggtaccaacagaaagcaggacagcctcctaagttgctcatttactcggcatcccacccgggcacgtccggggtccctgaccgattcagcgcagcgggtctgggacagactttcactctcaccatcagcagcctgcaggctgaagntgtgntagtttatttctgtctgtcagttatttggtacttccgtcgtactttcggcgtcgaacgggaccaagggtggagtagtacaaggaccgaacgtggtggctacgg

SEQ ID NO: 285003 - DNA, 507 bp, Homo sapiens
  misc_feature: GYAE6OF02IF01O.37.5.A05.1.454.CMB.1.raw
  modified_base (401)..(401): a, c, t, g, unknown or other
  misc_feature (401)..(401): n is a, c, g, or t
  modified_base (458)..(458): a, c, t, g, unknown or other
  misc_feature (458)..(458): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactactttgcttggtaccaacagaaagcaggacagcctcctaagttgctcatttactcggcatccacccgggcatccggggtccctgaccgattcagcggcagcgggtctgggacagatttcactctcaccatcagcagcctgcaggctgaagntgtgcagtttattctgtctgctagtatttgggacttccgtgtactttcggcgtacgngggtaccctaagggtggagatcgaacggccgaacgtggtacggctacgg

SEQ ID NO: 285004 - DNA, 544 bp, Homo sapiens
  misc_feature: GYAE6OF02HS5WD.37.5.A05.1.454.CMB.1.raw
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (433)..(433): a, c, t, g, unknown or other
  misc_feature (433)..(433): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccgacccgggcacgtccggggtccctgaccgattcagcggcaggcgggtcngggacngtactttcactctcaccatcagcagctgcaggctgaagagtgtggctagttttattctgttctgntagttagtttcgggtactccgttcggtacgtttcgggcgtacggaacggggtacctaaggggtcggaagtacgttacggaaacggtccgtaacgttggtcggtccgtacgg

SEQ ID NO: 285005 - DNA, 502 bp, Homo sapiens
  misc_feature: GYAE6OF02H6U35.37.5.A05.1.454.CMB.1.raw
  modified_base (339)..(339): a, c, t, g, unknown or other
  misc_feature (339)..(339): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactactttgcttggtaccaacagaaagcagacagcctcctaagtgctcatttactcggcatccacccgggcacgtccggggtccctgaccgnttcagcggcaggcgggtctgggacagatttcactctcaccatcagcagcctgcaggctgaagatgtgctagtttacttctgtctgctagttagtttgggtacttcgtcgtactttcggcgtcgacgggtaccagggtgagtatacgagcgaactggtggctcg

SEQ ID NO: 285006 - DNA, 529 bp, Homo sapiens
  misc_feature: GYAE6OF02IVHCX.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactacttgcttggtaccaacagaaagcaggacagcctcctaagttgctcatttactcggcatccgacccgggcacgtcccggggtccctgaccgtattcagcggcaggcgggtctgggacagtatttcactctcaccatcagcagcctgcaggctagaagagtgtgtctagtttacttcgtgtctgtctagttagtttcgggtactccgtacggtcgtttcggcgtcgaaggggtacctaagggtcggagtagtacgaggacgtaacgtggtcggctacgg

SEQ ID NO: 285007 - DNA, 520 bp, Homo sapiens
  misc_feature: GYAE6OF02G498X.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccgacccggcacgtccggggtccctgaccgattcagcggcaggcggtctgggacagatttcactctcaccatcagcagcctgcaggctgaagatgtgctagtttcttcgtgtctgcgtagttagtttcgggtactccgttcgtactttcggcgtcgtacgggtaccaagggtcggtagtagtacgaacggcgaacgtggtcggtctacg

SEQ ID NO: 285008 - DNA, 503 bp, Homo sapiens
  misc_feature: GYAE6OF02HCW6T.37.5.A05.1.454.CMB.1.raw
  modified_base (403)..(403): a, c, t, g, unknown or other
  misc_feature (403)..(403): n is a, c, g, or t
  modified_base (500)..(500): a, c, t, g, unknown or other
  misc_feature (500)..(500): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactactttgcttggtacccaacagaaagcaggacagcctcctaagttgctcatttactcggcatccaccgggcactccggggtccctgaccgattcagcggcagcgggtctgggacagtatttcactctcaccatcagcagcctgcaggctgaagntgtgctagtttattcgtgtctgctagttatttgggtctccgtgtacctttcggcgcgtagggacctaagggtgagatacgaagtcgaacgtggtggntcg

SEQ ID NO: 285009 - DNA, 741 bp, Homo sapiens
  misc_feature: GYAE6OF02IGPVG.37.5.A05.1.454.CMB.1.raw
tcagtagtgtagatcacgaccggtgctcgatttagatagatagacagggggagcggtacaacaggcaggcaggggcagcaaggactggtgttcgcaggacccaggccttcatctctctgttgctctggtatcactggtgccgtacggggacattcggtgatggacccagtcctccagacctcccgtggctgtcgtctccgtgggcgaggacgggcccaccactacaactcgacaacgtccacgacctaagtacttcgttttgtacaggccgtcgaacaaagtaacgtaacttacgtttcgacgttacggtaacccaacgaagaacgtccgtaaggtaccacggtacccttaccgttaacgttacgaccttaactacgttttaccgccggtaccacgttaccccgaccccggtctaccggttcccggggttcctacggtaccgtacttaccggagtaccgggaccgacggtccgggtcgtacggggtacctagttactttaccaccgtacgtacccaaccgtacgtacgacggaccgtacggtaccgtacggtaccgtaacggtcgtaggaacgtacggtaggtacgggtacttacgttttacttcgttaggtcctaggtacgttacggttacgtttacggtaccgtccgttaccgggttaccgtttccgggacggtaccggtaacgggtaccgtagggtacggacgtacgttacgaacggtcgtacgcggttccgcgtacg

SEQ ID NO: 285010 - DNA, 751 bp, Homo sapiens
  misc_feature: GYAE6OF02JYRM4.37.5.A05.1.454.CMB.1.raw
  modified_base (746)..(746): a, c, t, g, unknown or other
  misc_feature (746)..(746): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgccgtacggggacatcgtgatgacccagtctccagacctccctggctgtgtctcgtgggcgaggacggggccaccgataccaacgttcgaccgaacggtcccacggacccgaacggtacctttctttttcggtcctacggtccggtaccgaactaaataaacggtaacttacgttttacggctttacgggtaaacccaaacgtaaggaaaacggctaacgggaccacgtccctaccttaaggttcgaccttactaactttaccgtcggacctacgtaccccgacccggggctaccggttcccggggtccctaggacccgtattaccgaggtacccggcgtacgggtccggggtacgtacgggaactacggttacctttccaccggttcctaccgaaccctagtaccgacgcaccggtccgtgccgtaaacggtcttaggtaaacgcggttaggtcgggtactttaggtttttacctgttaccgttcgtacgttacgttacgtttacgggttccgttacccgtcggttaccggtacgtttccggacgtacgggtaacgggacctttaaggggcgtaacggtatacccggtacggtccggttaagtcggttaccggnttacg

SEQ ID NO: 285011 - DNA, 686 bp, Homo sapiens
  misc_feature: GYAE6OF02J2J8W.37.5.A05.1.454.CMB.1.raw
  modified_base (427)..(427): a, c, t, g, unknown or other
  misc_feature (427)..(427): n is a, c, g, or t
tcagtagtgtagatcacgaccggtgctcgatttagatagatagacagggggagctacaacaggcaggcagggcgagcaagatggtgttgcagacccaggccttcatctctctgttgctctggatcactggtgcctacggggacatcgtgatcgacccagtcctccagacctccctggctgtgtctcgtgggcgaggcgggccactatcaactgcaagtccacgcctagtacttcttttgttccagtccgtacgaacaataacgtaaccttactttgaccgtttacggaacccaaacaaggaaacgcaacgggaccacggtccctaccgtaagttcgcctactatttaaccgtcggacacgtcccgacccggtctacgttccccggggtccctaggacccgattccgaggccggcgacggtcgggtcncggggaactgtactttccgactcgtaccacctatccagtccacgtccgtcgacgtaggtaccgtacggtaaacgtacgttcgggtacgtacgttaaggttttactttcggttcgtaccgtttcgaccggttaacgtttccggtttaacggtcccgttaccgttccggttaccgtttcgggccgttacggtaaccgggtaacgacgggttacgggaagtaccgtacggtaacgccggtaacgtcgggttcgcggttaccg

SEQ ID NO: 285012 - DNA, 715 bp, Homo sapiens
  misc_feature: GYAE6OF02JYE6S.37.5.A05.1.454.CMB.1.raw
  modified_base (338)..(338): a, c, t, g, unknown or other
  misc_feature (338)..(338): n is a, c, g, or t
tcagtagtgtagatcacgaccggtgctcgatttagatagatagacaggggagcgtacaacaggcaggcaggggcgagcaagatggtgttgcagacccaggccttcatctctctgttgctctggatcactggtgcctacgggacatcgtgatgacccagtcctcagacctcccgtcggcctgttgtcctcgttacgggcgaggacgggcccacccgtatacgaaaccgttggaccaaacgtcccgaacgcccaaggtacttccgttttgttcgacgtcgttaccgaacgaactaaacggaaccttactttggaccttaggtaaccctaacaggtaaacncgaaggaccacggcctaccgtaagtcgactctacttacgtcgacctagtccctaccgggctacgcccgggtaccctgacccgtattacgcggcggccaggtcgggtcgtagggactacggatttccgtaaccgtcctccacctactcgaacgtccaacgtccgtacgcgtaccgactacggtacgtacgtacggttcggtcttaggttttactttacggtacttccgtttcgtacgttacgtttaagttttccgggttacttaacccgtcgggtttaccggttccggccgttaaccgggtggtaacccggttaaggtcccgggtaacggaactttacggaacgtacccgggtaagttccgggttacgtagtacccgg

SEQ ID NO: 285013 - DNA, 570 bp, Homo sapiens
  misc_feature: GYAE6OF02HUNS1.37.5.A05.1.454.CMB.1.raw
  modified_base (309)..(309): a, c, t, g, unknown or other
  misc_feature (309)..(309): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagacttcttttgtcagcgtcgaacaataagaactactttgcttggtaccaacagaaagcaggacagcctcctaagttgctactatttacncggcactcccacccggggcacgtcccggggtccctcgaccgattcgaggcggcacggcgggtctgggacagtactttcactctccacactcagcagcctgcgagctgaagngtgngctagtttcttcgtgtctgacgtagttagttttcgggtacttccggttcggtccgtttcgggcgtaccggtaacgggtaaccgtaaggggtcgggtaacgtacgtaccgtaacggtaccggtaacgttcggtcgggtacttaccgg

SEQ ID NO: 285014 - DNA, 558 bp, Homo sapiens
  misc_feature: GYAE6OF02GBLKE.37.5.A05.1.454.CMB.1.raw
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagacttcttttgtcagcgtcgacaataagaacttactttgcttaggtaaccaacaagaaagcaggacagcctacctaagtgctcatttactcggcatccacccgggcacgtcccggggtcctgaccgtattcagtgcagcgggtctgggacagtactttcactcgtcacatcaacancctgcagctgagatgngacgtatttattacgtgtacagctaagttattaataacttacctaccgtaccgacggttaccggaccgtaaacgggtaaccaaagggttacggtaaaacgtacgtaaaaccgtaacgttcggtacggtactacggtacacctaacg

SEQ ID NO: 285015 - DNA, 670 bp, Homo sapiens
  misc_feature: GYAE6OF02I0E04.37.5.A05.1.454.CMB.1.raw
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (300)..(300): a, c, t, g, unknown or other
  misc_feature (300)..(300): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactcctggctgtcgtctcgtgggcgagaggccacatcaactgcaagtccagccagacttgtttanacngctacaataataagactactagcttggatcagcaagaaacnggcagtcctacaatgactatattcgnggctactccgtaccggaggtccggtcctaggacctagttcgaggtcgacgaggtccggtagtcgggaacagttacgtttacgtacttccgtaaccctacgtaacgtaccaaaccgtacggtccgttacggaccgtaacgggtctacggggaacttaggttcggttaacgggacgtttaacgtttttacctaaccgtaggttactaccggttaaccgtaaggttttaacttaaacgttaaccttaacccgtccgttaaccgggttacgtacccgggtaccgtaaaacggggaccgttaaaagggttacgtaaaacgttcccgtaaaagggaccgtttacgggtacggtaaccgtcgtaaccgtcctaacgg

SEQ ID NO: 285016 - DNA, 714 bp, Homo sapiens
  misc_feature: GYAE6OF02I1TQV.37.5.A05.1.454.CMB.1.raw
  modified_base (305)..(305): a, c, t, g, unknown or other
  misc_feature (305)..(305): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctcgtgggcgaggaggccaccatcaactgcaagtccagccagacttcttttgtcagtccgtcgacaaataagaacttactttgcttacggtaaccaacagaaagcaggacacgcctcctaagttnctactactttacgcggtacacgtcccgaacccgggtctaccgtcccgggggtacccctgggaaccctacttccgacgggccggacgacgggtccggggtcgtaggggaaccgtaggtacttttccactccgttacccaacctagtccaacgccgtacgcccgttgaccgaggtccgtaaggtaaacggtacgtacgggtcgttacgttacgtttttaacgttccgtttacggttccgtcgttacgtaacggttttacgtttaccggggttaccttacccggttacgggttaccgtttccgggaccggttaccgggtaaacggggtaacccggttaagggggttacgggaacggtacgtaacccggtaaagggtaccggttaaaccggtgggttaccgggcgttaaccgg

SEQ ID NO: 285017 - DNA, 586 bp, Homo sapiens
  misc_feature: GYAE6OF02H2DGI.37.5.A05.1.454.CMB.1.raw
  modified_base (408)..(408): a, c, t, g, unknown or other
  misc_feature (408)..(408): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccacatcaactgcaagtccagccagacttcttttgtcagcgtcgacaataagaactactttgcttggtaccaacagaaagcaggacagcctactaagttgctcatttactcggcactcccgaccggcacgtccggggtccctgaccgtattcgacggtcggcgacggcgggtcgtcgggacgagtactttccgactcctctacctatcacgcngcgtcgcaggtctagaacgagtgtcgtcgttagtttactttcgtgttccgtgtacgtagtttacgtttcgggttaccttccggttaccggttccgtttcggcggtccggtaacgggaccgtaacggggtacggtaacgtacgtacgaacggtaccggtaacgtcggtcggtctaccgg

SEQ ID NO: 285018 - DNA, 719 bp, Homo sapiens
  misc_feature: GYAE6OF02HIWIF.37.5.A05.1.454.CMB.1.raw
  modified_base (278)..(278): a, c, t, g, unknown or other
  misc_feature (278)..(278): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagacctcctggctgtgtctcgtgggcgagacgggccacatcaactgcaagtccagccagtacttcttttgtcagcgtacgaacaaataagaacttcgtttgcttaggtaccaaanagaaagcaaggacacgcctactaagtcgctctatttacncgcactcccgaccggntacggtcccgggtaccncgaccgtattccgacgggccggcacgggtccggggttacgtacgggggaacctagggttacttttaccgaccgtttacctacccgtaaccctacgttaccgacggtacctaaccggtccctgggtacccggacgggtaccttaagggaaacggtacgttcgggttacgggtacttttaacgtttttacgtttcggttacggtttacgtcggttaacgttacggttttaacgggttttccgggttaaccctttcccggttaccggggtttaaccgtttccgggaccggtccgggtaaccgggtaaccggtagggtagggtaacgtaacgtacggaaccggtacggtaacggttaggtccggtactaccgg

SEQ ID NO: 285019 - DNA, 537 bp, Homo sapiens
  misc_feature: GYAE6OF02F6TKD.37.5.A05.1.454.CMB.1.raw
  modified_base (278)..(278): a, c, t, g, unknown or other
  misc_feature (278)..(278): n is a, c, g, or t
tcagtagtgtagatcacgaccggtgctcgatttagatagatagacagggggagctacaacaggcaggcaggggcagcaagatggtgttgcagacccaggccttcatctctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccngggcagcctctaaactgctcatttactgggcatcgtacccgggagtcccgggtcctgaccgattcagtggcagtcggctgggacagatttcactctcaccatcaacagcctgcaggctaggaggtatgtggcgtaatttattactgtactagctagttatttataactcctccttaccgacgtttcggcctaaggggacctaaagggtcgaaacttccgaaaaccgtacttcggtacggtctacggaccacctattccg

SEQ ID NO: 285020 - DNA, 547 bp, Homo sapiens
  misc_feature: GYAE6OF02G30DD.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaagcaggacagcctcctaagtgctcatttactcggcatcccacccggggcacgtcccggggtccctagtaccgattcgagccggcaggccgggttcgtggggaactaggtacttttccgactccgtccaaccactcgacgctacgccctagccaggctagagagtgtggactaggttttattcgtgtctgctagttagtttcggtacctcgtcggtctttcggcgacgagggacctagggtggagtacgtacgaacggccgtaagtcgtgccgtcg

SEQ ID NO: 285021 - DNA, 510 bp, Homo sapiens
  misc_feature: GYAE6OF02HYI3S.37.5.A05.1.454.CMB.1.raw
  modified_base (304)..(304): a, c, t, g, unknown or other
  misc_feature (304)..(304): n is a, c, g, or t
  modified_base (405)..(405): a, c, t, g, unknown or other
  misc_feature (405)..(405): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactctttgtcagcgtcgacaataagaactactttgcttggtaccaacagaaagcaggacagcctcctaagttgctcatttacncggcatcccacccggcagtccggggtccctgaccgattcagcggcagcgggtctgggacagtatttcactctcaccatcagcagcctgccaggctagaagntgtgctagtttattctagtctgctagtgtttcgggtactccgtcgtacttcggcgacggtacggaccagggtcgacgagtacgaacgtcgaacgtcgtggctacg

SEQ ID NO: 285022 - DNA, 536 bp, Homo sapiens
  misc_feature: GYAE6OF02GJ1MJ.37.5.A05.1.454.CMB.1.raw
  modified_base (272)..(272): a, c, t, g, unknown or other
  misc_feature (272)..(272): n is a, c, g, or t
  modified_base (314)..(314): a, c, t, g, unknown or other
  misc_feature (314)..(314): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (419)..(419): a, c, t, g, unknown or other
  misc_feature (419)..(419): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagtactcttttgtcagcgtcgacaataagaactactttgcttggtaacccaanagaaagcaggacacgtcctaccgtaagttgctactatttacncggtcatcccacccgggcacgtcccggggtccctgaccgtattcgagcggcaggcgggtcngggacngtattcactcgtcaccatcancngccngcaggctgaangtggtgctagtttcgttcgtgtctgctagttattcggtctccgttcgtcgttcgcgtacgacgggtacctaagggtcgaagtagtacgacggtaccgaacgtggtacggtcgtacgg

SEQ ID NO: 285023 - DNA, 547 bp, Homo sapiens
  misc_feature: GYAE6OF02GMTWY.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgacaagtccagccagacttcttttgtcagcgtcgacaataagaactactttgcttaggtaccaacagaaagcaaggacagcctactaagtgctctatttactcgcatccgacccggcacgtcccggggtcctgaccgtattcagcgcgagcgggtctgggacagtactttcacgttcctcaacctatcgacgcacgtcctgcgaggctagaagtactggtggtacttagtttatttcgtagttctgacgtagttagttcggtaccttccgtacggtacgtttcgacgtcggaacgggacgtaagggtgagtagtacgaggacgtaacgtggtacgctacg

SEQ ID NO: 285024 - DNA, 634 bp, Homo sapiens
  misc_feature: GYAE6OF02GAWD0.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagtacttcttttgtcagcgtacgacaataagtaacttacttgtcttaggtaaccaacagaaagcaggacacgcctaccgtaagttcgactactatttacgcgtcacgtccgaccggactacgtcccggggtcctcggaccgtattcgacggcggcgacggcgggtcgtgggacagtactttacactctccactatcacgcacgcctacgcgacggacctaggaacgtgtacggtcggtacttacgtttactttcgttacgttctacgtacgttaagttacgtttacgggttaccgttcccgttaccgggttacggttttaccgggaccggtacgggtaacgggtaaccggttaacgggtaacgggtacgtacgtacggaacggtaccggtaacgttcgggtacggtacgtaccgg

SEQ ID NO: 285025 - DNA, 715 bp, Homo sapiens
  misc_feature: GYAE6OF02F1QRG.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcacgtggtgccgtacggggacagtcgtgatcgacccagtctcagcctcctggctgtcgtctcgtgggcgaggacggccaccataccaactgacacgtccacgccacgtacttcttttcggtcacggtccgtacgaactaaactaacgtaactttacgtttcgtaccttacggtaacccaaacgaagtaaacgcgaaggtaacacgtcccttactaaggttcgacttactactttaccgcggtactaccgtacccggaccgggctaccggtcccggggtacctaggtaccgtattcgacgggcggcggtcggcgtcgggacgtacgttacgttcctactcctccgtacacgtacgcgtacgacgtccgtcgacggacggtactacggaacgtacggtgggtacgtacgttagttttacgtttcgtcgttcgtcgttacgttcgttacgttttacgggttaccgttccgtttcggttaccggtttaccggccgggtaccggtaacgggtaacccggtaaggggtaaccgggtaagtacgttaaccggtaaccggtacgttaacgggttcggtacgggttaccgtcgaaccccg

SEQ ID NO: 285026 - DNA, 886 bp, Homo sapiens
  misc_feature: GYAE6OF02JNWDO.37.5.A05.1.454.CMB.1.raw
tcagtagtgtagatcacgaccggtgctcgatttagatagatagacaggggagctacaacaggcaggcaggggcgagcaagatggtgttgcagaccacggccttcatctctctgttgctctggatcactggtgtcctacggggacatcgtgatgacccagtctccacgacctcctggctgtgtctctgggcgagacgggccaccgactcaacgtcgacaacgtccacgccaggtaccttcttttacgtcacgtcgtccggtaactaaactaaacgtaaccttaaccgttttagtccgtttacgggtaacccaaacgtaacgaaaacggtaccgaaggtaaccgacgtacccgttaacccgttaaggttacggtaccttaccttaacgttttaaccgtaccgggtacctaccgtaccccggtaaccccggggtacctaaccgggttcccccgggggttaaccccgttaccggtaaccccgggttacgtttacccggacgggtacccgggtacccggtaacggggtcccggggtacccgggttaccgggggtaaccgaacggtttaaccgttttacccggtaacccgtttaccccgtttaacccggaaaccctaaccgtaacccggtaaccgtacccgaccggtacccggttaccgaccggtacggtaccgtacgtaacgtaacgtcggtacgggtacttacggtttacttttaccgtcggtttacgtacggttcgttaagttttaccggtttacgggttaacccgttccggttaacggtttccgtttcgggaccggttacgggaacgggttaaccggtaacggggtaggtaccgtaacgttaccggtaacggaccgttaaccggttaggtaccgggttagttaaccgg

SEQ ID NO: 285027 - DNA, 718 bp, Homo sapiens
  misc_feature: GYAE6OF02GS2T2.37.5.A05.1.454.CMB.1.raw
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgccgtacggggacatcgtgatgacccagtctccagactccctggctgtgtctcgtgggcgaggacgggccaccatcaactgacaacgtccagccagtacttcttttgtcagtcgtacgaacaataacgtaacttactttgcttaggtaccaacgaagaacgcgacggacacgcctaccgtaagttcgactactatttacncggcactcccgaccggcacgtcccggggtacccnggaccgtacttcgacgcggacgacggtccgggttctacggggactacggttactttccgacttccgtacctacccaagttcgaacgaccgtaacgcccgtaggaccgtacgggtccgtaaggtaacgtaacgttcgggtacggtacgtttacggtttttacgtttccgttacggttcgttcggtaccgtttaacggttttacggttttaccggggttacccctttccgggttaccggttacccggttttcgggacggttaccgggtaacggggtaacccggtaaggggttacggaaggttaccgtaaccggtaacgggtaccgtaacgggttcggtaccgggtacgtaaccgg

SEQ ID NO: 285028 - DNA, 602 bp, Homo sapiens
  misc_feature: GYAE6OF02FNC9B.37.5.A05.1.454.CMB.1.raw
  modified_base (318)..(318): a, c, t, g, unknown or other
  misc_feature (318)..(318): n is a, c, g, or t
  modified_base (401)..(401): a, c, t, g, unknown or other
  misc_feature (401)..(401): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgcctacggggacatcgtgatgacccagtctccagactccctggctgtgtctctgggcgaggacgggccaccatcaactgcaacgtccagccagtacttcttttgtcagcgtacgactaaataacgaacttacttgcttaggtaaccaacgagaaagcaggacagcctctaagttcgctctatttacncgcactcccgacccggctacgtcccggggtcctacggtaccgcttcgaggccggcaggtcgggtctaggggacagtactttcnccttctaccacctatcacgccacgccgtgcgacgtctacggaagtacgtgtcgggtacttaacgttttacttttcgtgttcgtgtacttacggttagttccggttaacgttcccgtacggttacgtttccgggacgtaccggtaacgggtaccgtaagggtcggtaagtagtacgacgtacggaagttggtcggtctacgg

SEQ ID NO: 285029 - DNA, 681 bp, Homo sapiens
  misc_feature: GYAE6OF02IKZQP.37.5.A05.1.454.CMB.1.raw
  modified_base (247)..(247): a, c, t, g, unknown or other
  misc_feature (247)..(247): n is a, c, g, or t
tcagtagtgtagatcacgaccggtgctcgatttagatagatagacagggggagctacaacaggcaggcaggggcagcaagatggtgttgcagacccaggtcttcatttctctgttgctctggatctctgttactacaggtgccgtacgggacatcgtgatgacccagtcctccagacctcccgtggctgtctctcgtgggcgagacgggccacgactcaaccgcaacgtccagccggtattgtttanacaactacaaagaataagtattacttagcttggaccagacaacgtaaaccacgacacgaccctacgtaagctacgcttacgttacgcggtcctaccgtacccgggtaacgtccccggggtacctacggaacgtcgttcgacggtcgggaccgggtcgggttacgacggggtacaggttactttcgaaccttcctaccgaacctatacgagaccgtacgccgtcggcggtactaggtaacggtagtacggttcggttacggttttacgttacgttagtacgtagtacgttattaagtttagttacgttaccttccttacgtacgttacggttttcggacccggtacgggtaaccgtacgacggtacggtaacgtacgtaccggtacggtaacgtaacgttcggaccggttccgtacggaccgtacctacgttacg

SEQ ID NO: 285030 - DNA, 863 bp, Homo sapiens
  misc_feature: GYAE6OF02HFE9O.37.5.A05.1.454.CMB.1.raw
  modified_base (97)..(97): a, c, t, g, unknown or other
  misc_feature (97)..(97): n is a, c, g, or t
tcagtagtgtagatcacgaccggtgctcgatttagatagatagacagggggagctacaacaggcaggcaggggcagcaagatggtgttgcagacccnggccttcatctctctgtgctctggatcactggtgcctacgggacgatctgatcgacccacgtctccacgacgtcccttcggctcgttggtcctcgtcgggacggacgtagggacccaaccagtaccaacgtgaccgaacgtcccgacggaccctacgtactttccgtttttgttccacggtacgtacgaaccgtaaagttaaacgaacctttaacgttttcgtacggtttacggtaacccctaaacgaaaggaaacgtaccgaacggggtaaaccgcgtaccccgtttacccgttaaaggttcggtacctacctttaaccgttttacggaccggtacgtaaccgttcccccggaaccccgggggtaccgaacggttttccccccggggggtaccccgttagacccggttaacgtttacgtacgggaccgtccggtacgggtcgggtttaccgacggggtaacgtacgttacttttcccgtaacttaccgtaccgtacccgtaactcgtaacccggaacgtaaccgtacccgtacggacccgtacggtaacggtacgtaaacggtacggttcgttacggtacgtttacgttttacgtttacgtttccggttacgtaccggttacgttaggtttacgttttccgggttaccgtacccgttcgggttaccggtttcccggacggtacccgggtaacgggtaaccgtaaccggggtaggtaacgtacgttacggaacggtccgtaaccggttcggttcggtacccgtacg

SEQ ID NO: 285031 - DNA, 767 bp, Homo sapiens
  misc_feature: GYAE6OF02JCHE6.37.5.A05.1.454.CMB.1.raw
  modified_base (305)..(305): a, c, t, g, unknown or other
  misc_feature (305)..(305): n is a, c, g, or t
tcagtagtgtagatcacgaccggtgctcgatttagatagatagacaggggggagctacaacaggcaggcaggggcagcaagatggtgttgcagacccaggccttcatctctctgttgctctggatcacgtggtgccgtacggggactatcgtgatggacccagtcctccagacctcccgtggctgtcgtctcgtgggcgaggacgggcccacatccaactgcaacgtccacgaccagtaccttctttgtcgacggtcgtacgaacaaataagtaaccttactttcggcgtttacggtaacccaanacggaaagcgacggaacacgtccctacgtaagttcgacgtactacgtttacgtccggacacgtccccgacccgggcctaaccggtcccggggtaccctacgtacccgtacgttcgacgtcgggacgacgggcgggtcgtacggggacctaggttactttaccgactccgtacccaccgtactcgacgcctaacgcgtacggcgacggtacgtaacggaagtacgttcggtacgttacgttaggttttactttcgttacggttccgtacggttaccggttaagggttttaccgttttaccggggtttacccgtttacccgggttaccgggttttaaccggttacccgggttacccggtaaccgggttaaccgggggtaaacccggtaaggggtaaccggttaaggtaaccgttaaccggaacgggttacccggttaaacggttccggtacggtaccggtaccg

SEQ ID NO: 285032 - DNA, 757 bp, Homo sapiens
  misc_feature: GYAE6OF02HAQW7.37.5.A05.1.454.CMB.1.raw
tcagtagtgtagatcacgaccggtgctcgatttagatagatagacagggggagctacaacaggcaggcaggggcagcaagatggtgttgcagacccaggccttcatcctctctgttgctctggatcactggtgccgtacggggacatcgtgatgacccagtctccagacctcccgtggctgtgtctcgtgggcgaggacggccaccatacaactcgactaacgccagccagtacttcttttgtcacgcgtacgaactaaataagaacttaactttgtccgttacggtaacccaaacgaagaaacgagaggacacgtcccttacgttaagttcggactacttaactttactccggtacaccgttccccgggaaccgggtcctacgggttccccggggttccctacggaaccgttcttacgacgggtcccgggtaccgtacggggtacccggggtccggttaaggggacctacggttttaccttttacctaccgtttacccgtaacccaccgttactccccgaacgtaacccgcgtacccgtgtaccggacggtacgttacgaaagttacgttgggtaccgttagttacgtttttattccgttacgttacgttcgttacgtttacgtttaaccggttttcgggttaaccctttccgggttacccgtttgggttacccggaggttaccggggtaacgggaacggtaacggtgggtactaacgttacggaacgttagtaccggttagtcggtacgtaccgg

SEQ ID NO: 285033 - DNA, 708 bp, Homo sapiens
  misc_feature: GYAE6OF02JZREB.37.5.A05.1.454.CMB.1.raw
  modified_base (223)..(223): a, c, t, g, unknown or other
  misc_feature (223)..(223): n is a, c, g, or t
  modified_base (656)..(656): a, c, t, g, unknown or other
  misc_feature (656)..(656): n is a, c, g, or t
tcagtagtgtagatcacgaccggtgctcgatttagatagatagacagggggagctacaacaggcaggcgagggcagcaagatggtgttgcagacccaggccttcatctctctgttgctcgtggatcactggtcgccgtagggacatcgtgatcgtaccagtcgtccagaccgtcccgtggcgtcgtcgtcttcgtgggcgaggacggccaccgatacaacgtnaccgtaacgtccacgccgactaccgtttcgttttacgcgtacggtcgtaaccggtaactaagtaacgtaaccgttacgtttacgtaccgtttacggtaaccgaagaagtaacggaccgaggacctacgtacccgtaacgtaagttcgtactacttaacgttccgtcgaccttacggcccgtaccgggcctaccgggttcccggccctacggtacctaactcgacggcccgacgcggtccgtgacgtgccgtattcacgtctaccgacgctacgcgtacgaccgtcgtaacgtggtacgtacgacgtaagtcggtcgtgttacctttaagtttctttacggacgttcgaccgttaaagtttcgtttaccggtttacggttccccgaaggtttcccgggtaccggtttaccggacggttaccgggttaaacgggnggttaggacgtagtacgtaacggtaccggtcgtacggtcggtccgtacgtcg

SEQ ID NO: 285034 - DNA, 735 bp, Homo sapiens
  misc_feature: GYAE6OF02F81I3.37.5.A05.1.454.CMB.1.raw
tcagtagtgtagatcacgaccggtgctcgatttagatagatagacagggggagctacaacaggcaggcaggggcagcaagatggtgttgcagacccaggccttcatctctctgttgctctggatcactggtcgccgtacggggacatcgtgatcgacccagtcctccacgtacctcccgtggctggtcgtctcgtgggcggacggagggccacctataccaactgacaacgtaccaacgaccagtaccttcttttcgtacgacgtcgtaccgaactaaataaacgtaacttacttacgtacgttaccggtaaccaaacgtaagaaacgacgaggaactaccgtcccgtactaagtcgtactaccttaagtttaccgtcgccgtacctacccgaaccccgggtactaccggttccccggggtccctaccggaccgtattaccgacgggtcggcggtacggtccgggtaccgtacgggactacgtactttccaccgtaccgtaccaccgtaactaaccgaaacctacgaccgtacgaccgtacggaccgtaggaacggattacgggtagtacgttaagttttacgttacgttaggactaagtacgttaagtaacttataaaccgttacgttacccgtacggtaccggttaccggaaccggtaaacggtaaccgtaacggtaaggaaacctaaccgaaagtacccggtaggtaccggacttaccgaccgtacctaacg

SEQ ID NO: 285035 - DNA, 793 bp, Homo sapiens
  misc_feature: GYAE6OF02GXRHS.37.5.A05.1.454.CMB.1.raw
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (776)..(776): a, c, t, g, unknown or other
  misc_feature (776)..(776): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtcgccgtacggggacatcgtgatcgacccagtcctccagacctccctggctgtgtctcgtgggcgaggacggccacatcaactgacaacgtccgacgccagtactttagtttaanacncgtcctaccaaacaataacgaacttaacgttagtacgtttaggtaactcgaacgtaccgaaacggaaaccggtacggggaccaccgtacccttaaccgtaactcgtactacttacgtttacggtcggactaccgttcccgggaacccgggtcgggtcccggggtcctaggaaccgtacttacggacggtcgggacgacgggttcccgggtacgtacggggaactaggttacctttccgaacctcgtaacccaacctaacgtacccgaaacgtaccggtccgtacggaaccgtacggggtcttagggtaacgtcgttagggtacgtttaacgttaacgttttacgttaccggttaggaccgtacggtaacgtttaacgtttaactttaacgttaacgtttcccgtaaccgggttaccccgttaaccgggttaccggtaacccgggtaaaccgggtaaccggtaaacggggttaacgtaaaacccggttaacccggtaaagttaccggttcggttaaccggtaccggttnaccccgttaccttacgg

SEQ ID NO: 285036 - DNA, 718 bp, Homo sapiens
  misc_feature: GYAE6OF02GPK2F.37.5.A05.1.454.CMB.1.raw
  modified_base (708)..(708): a, c, t, g, unknown or other
  misc_feature (708)..(708): n is a, c, g, or t
tcagtagtgtagatcacgaccggtgctcgatttagatagatagacagggggagctacaacaggcaggcaggggcagcaagatggtgttgcagacccaggccttcatctctctgttgctctggatcactggtgccgtacggggacatcgtgatgacccagtctccagacctccgtggcttgtgtctcgtggcgagacgggtccacactacaactgacacgtccacgccacgtactttcgttttgtcaggtcgtcgaacaaataacgtaaccttacgtttacgtacttacggaaccaacgaaggtaaacgacgaacggaacgaccgtaccttaccgttaacgtcggtaccttacttaacttttaccgtccggactaccggtacccgtaccccgggtacgaccgttcccgggggtccctacggaccgtacgttaccgaggcccgacggacgggtccgggtacggtacgggaacgtacggttactttaccgtaccgtactaccctacgtactacgtacggacgtaccggtacgtacggacgtacggcgttaagacgtacggttcgtacggtactttacgtttgtttacgtcgttacgtacgtacgttaggtttacggttacgttaccgttaccgtccggttaccgttacggtccgacggtaacgggtaccggtaggtaagtacgacgttacgacgggttactacgggttagngtactaccgg

SEQ ID NO: 285037 - DNA, 761 bp, Homo sapiens
  misc_feature: GYAE6OF02IJX78.37.5.A05.1.454.CMB.1.raw
tcagtagtgtagatcacgaccggtgctcgatttagatagatagacaggggggagctacaacaggcaggcaggggcagcaagatggtgttgcagaccaggccttcatctctctgttgctctggatcgactggtcgccgtacggggacatcgtgatcgaccagtctccagactcccgtggctgtgtctcgtgggcgaggacggccacatacaactgactagtccaagcctagtacttccgttttgtccacggtcgtaccgaactaaagtaaacgtaaactctttcgcgttaacggtaacctaacgaagtaaacggcaacggacaccggtaccttaaccgttaaggttccgtactacgttaacgtttaacgtccggtaaccacgttaccccgaaccggggtacctaccggttccggggtaccctacgacgtactcgtaggccggtacgacggtcggtcgtcggactaacggttctttaccgctcctacaccgtagacctacgcgtaacgtccgtacggtacgacgggactaacggtaagtacgtacggtacgttacggttacggttttaacgtttcgtacgttccggtacgtacgttaaggttttacggttacggtttaacccggtttccgttaccggggtttacccggtttcggtaacccggtacggggttaccggtaaaccggggtagggttaacgggaacgttaaccggtaacgggaacggtaccggttaaacgggttcggttaccggtacggtaacccgg

SEQ ID NO: 285038 - DNA, 745 bp, Homo sapiens
  misc_feature: GYAE6OF02GSCHS.37.5.A05.1.454.CMB.1.raw
  modified_base (722)..(722): a, c, t, g, unknown or other
  misc_feature (722)..(722): n is a, c, g, or t
tcagtagtgtagatcacgaccggtgctcgatttagatagatagacagggggagctacaacaggcaggcaggggcagcaagatggtgttgtagacccaggccttcatctctctgttgctctggatcacgtggtcgccggtacgggacactcgtgactcgacccagtcctccaagtcctcccgtggtcctgtcgtctcggtcgggacgtaggacggaccaaccgtacttacaaccgtcggaccaaacgtcccaaggaccctaggttacctttcgttttcgtacgacggtccgtaacgtaaccgtaaataaaaccggttacctttaccgtttaggtaccgtttaccgaaaccgtaaagaaacggaaacgtccgtaaaggtaccctacgtcccttaaccgttaagtccgcttaacgttactttacggccgtaactaccctccccgggaaccggtccgtccgggttaccccgggtctacggtaacctcgtaccgacggcgtacggcggtacggtacgtacggacgttacgtccgtttaccaccgtcctacgaccgtataccgacgtacgacgtccgtaccggagtccgacgttaaggaacttggtacgttacggtactttacgttttctacgttctccgtagttccgtttaaagttacgggttcgttacctccggttacgttcgtccgacgtagaccggttacggaggtacagtaccgtgaaccggntacgtacggtcacgtacgtaccg

SEQ ID NO: 285039 - DNA, 506 bp, Homo sapiens
  misc_feature: GYAE6OF01DRMEX.44.69.G03.1.454.CMB.1.raw
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtctgcaacctgaagattttgcaactttactactgtcaacagagttatactcgccccgtttactacttttgggtaccggggggtaccaaaggcgtgggaagtaataccgaaacgaactggtggctggcaccatctgtcttcattcttcccgcatctgatatatctgtctgngcgggctggacaggcgnangnn

SEQ ID NO: 285040 - DNA, 500 bp, Homo sapiens
  misc_feature: GYAE6OF01AU5TT.44.69.G03.1.454.CMB.1.raw
  modified_base (216)..(216): a, c, t, g, unknown or other
  misc_feature (216)..(216): n is a, c, g, or t
  modified_base (485)..(485): a, c, t, g, unknown or other
  misc_feature (485)..(485): n is a, c, g, or t
tcagacagtatatacacgaccggtgctcgatttagtcgctgcgtaaaggagaaagggagggaaggagactgggtcatctagatgtgacatccacgatgacccagtctccttcactccctgtctgcttctataggagacagagtcgccaatcacttgccgggcaagtcagaccattaacagcttatttaaattggtatcagcagagaccagggaaancccctgaactcctgatctactgctgcctccactctgcaaagtggagtctcttcaaggttcagtggcagtggatctgggacagatttcacgtctcaccatccagcagcctgcagcctgatgattttgctaacttattactgaccaaactagtaataagtagttacttctcagtagttttggaccgtaggggaccaagtctaggagatacaaacgaactagtgctgcactatctgtcttcatctccgcatctgatatatactgtctgacgngggctggcgtaacgg

SEQ ID NO: 285041 - DNA, 491 bp, Homo sapiens
  misc_feature: GYAE6OF01A49D5.44.69.G03.1.454.CMB.1.raw
  modified_base (378)..(378): a, c, t, g, unknown or other
  misc_feature (378)..(378): n is a, c, g, or t
  modified_base (461)..(461): a, c, t, g, unknown or other
  misc_feature (461)..(461): n is a, c, g, or t
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtcctgcaacctgaagtattttgctaacttactactgtacaacagagttatactcgccccgtttntacgttttgggcgggggtaccaagtcgtagacgatacaacgactgtgctgcaccatctgtcttcactcttcccgcatctgatntatctgtctgngcggcnggcaggcanatgn

SEQ ID NO: 285042 - DNA, 665 bp, Homo sapiens
  misc_feature: GYAE6OF01CYH19.44.69.G03.1.454.CMB.1.raw
  modified_base (332)..(332): a, c, t, g, unknown or other
  misc_feature (332)..(332): n is a, c, g, or t
  modified_base (660)..(660): a, c, t, g, unknown or other
  misc_feature (660)..(660): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtgcagtggatcgtgggacagtattcactctcaccactctccagtctgcaacctgaaagtnttttacgactaacctttactactcgtacaacgtagtagttatactcgtccccgtttcgtacgttttcggggtaccggggtacctaacggtcgtaggagtaactaccgaaacgaacgttggtacggtcgttcgaccgtaccctagttccgtcggtttccttaccgtaacgtttcccgttacccccgtaccttaaccgttccgttaacggtaacctttaacttaaaccgtttacccgttacggtttacccgtttagggaacggggttcccgggggtaccgttaccgggggaaccgtaaaccggggtcccggtaaccggtaacgtaacggngtacg

SEQ ID NO: 285043 - DNA, 643 bp, Homo sapiens
  misc_feature: GYAE6OF01CF6IB.44.69.G03.1.454.CMB.1.raw
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaatggtatcagcagagaccagggaaacgcccctgaactcctgatctctgctgcctcactctgcaaggtggagtctcttcaaggttcagtggcagtggatcgtgggacagtatttcactctcacatctccagtctagcaacctgtaagtattttcgactaaacttactacgtagtacaaactagtaacgtttactacgtcgtacccgtttacgtaccgttttggggtaccggggaactaaggcgttagggaagtaacgttaacgaaacggtaacgtggtacgtacgtacggacctaacctaagttcgttacgtttaccgttacctacgtttcccctaccccgtactaacttccgttagtaaactttaacgtactttaccgttcggttaccgtacgggacgggtccggggtaccgttacggggtaacccggtaacgggacccgttaccgtaaagtcggctag

SEQ ID NO: 285044 - DNA, 617 bp, Homo sapiens
  misc_feature: GYAE6OF01DSKOY.44.69.G03.1.454.CMB.1.raw
  modified_base (212)..(212): a, c, t, g, unknown or other
  misc_feature (212)..(212): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctaatttaaattggtatcagcagagaccagggaaancccctgaactcctgatctctgctgcctccactctgacgaaggtggagtctcttacgaaggttcaggtggcaggtggatcgtgggactagtatttcactctcaccatcctcagtctgaccaactgaagtatttacgactaactttactacgtgtacaacgtagtaagttactaccgtcgtacccgtttacgttacggttttcgggtaccggggtacctaaggtcgtagggaataactaccgaaacgtacgtcggtacggactcgacctacctacttcgttacgttaccttacctacgttcccttaccccgtactaacttccgtagtaactttacgtaactttacgtcgttacgttaggacgggtccgggtacgtcgggaaccgtaacgggccgagtaagtggtcag

SEQ ID NO: 285045 - DNA, 640 bp, Homo sapiens
  misc_feature: GYAE6OF01AHS1L.44.69.G03.1.454.CMB.1.raw
  modified_base (328)..(328): a, c, t, g, unknown or other
  misc_feature (328)..(328): n is a, c, g, or t
  modified_base (634)..(634): a, c, t, g, unknown or other
  misc_feature (634)..(634): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctcgcctccactctgcaaggtggagtctcttcaggttcagtgcaggtgatcgtggacagtattcactctcaccatctcatctgacaacctgaagtntttagctaacttactactgtacaacagtacgttataccgtcgtacccgttcgtacgtttgggaccggggacaggtcgtaggacgacgttaccgaaacgtacgttggtacggtcctacggacctaacgtacttccgttagtttacccttacctaaccgtttccccgttaccccggtacccttacgttaccgttaacgtaactttaacgttaaccgtttaccgttaccgggttcttaacgggggtacgggtcccgggggttacccgttaggggaacccgtaacggggacccgtaagtaaccggttagngtacgg

SEQ ID NO: 285046 - DNA, 642 bp, Homo sapiens
  misc_feature: GYAE6OF01AZO2X.44.69.G03.1.454.CMB.1.raw
  modified_base (638)..(638): a, c, t, g, unknown or other
  misc_feature (638)..(638): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagccccttagaactcctgatctctgctgcctccactctgcaaggtggagtctcttcaaggttcaggtggcaggtggatcgtgggacagtatttcactctcacctatcctccagtctcgacaacctgaagtatttgactaactttactactgtacaacgtagtagtttactaccgttcgtaccccgttactacggttttcgggtaccgggggtacctaggtcgtagggaacgtaactaccgtaaacgtacgttcggtacggtacgtacgacctaccgtacttcgttacgtttaccttaccgtaccgtttccccgttaccccgtacctacttccgttacgtaacttacttacgttaccgttcgttaccgttagggtacgggtcccggggtaccgttacgggaaccggtaacgggtccgtaacgtagtaggntacg

SEQ ID NO: 285047 - DNA, 631 bp, Homo sapiens
  misc_feature: GYAE6OF01BMB5E.44.69.G03.1.454.CMB.1.raw
  modified_base (212)..(212): a, c, t, g, unknown or other
  misc_feature (212)..(212): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
  modified_base (626)..(626): a, c, t, g, unknown or other
  misc_feature (626)..(626): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaacncccctgaactcctgatctctgctgcctccactctgcaaggtggagtctcttcgaaggtcagtggcagtggatcgngggacagtcttcnctcctcaccntctccagtctgccaacctggtaatagtttcgactaactttactactataccaatagtagtttactaccgttccgttaccccgttaccgttacggttttcgggtaccggggtaaccgtaacggtcgtacggtacgaacgtaaccgaaacgtaacgacggttttttacggacgtcgacgtaacctacgttacttcgttaccttaccgttaccgttacccgttacccgtcctacttaccttacgtaacttattacgttacgttacgtcgttacggtacgggtccgggtacggtacgggacgtacggacggagtacgtgngtacg

SEQ ID NO: 285048 - DNA, 593 bp, Homo sapiens
  misc_feature: GYAE6OF01C15FY.44.69.G03.1.454.CMB.1.raw
  modified_base (501)..(501): a, c, t, g, unknown or other
  misc_feature (501)..(501): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
tcagacagtatatacacgaccggtgctcgatttagtcgctgcgtaaaggagaaagggaggaaggagactgggttatctagatgtgacatccagatgacccagtctccttcctccctgtctgcttctataggagacagagtcgccatcacttggccgggcaagtcagaccattaacagctatttaaatggtatcagcagacgaccagggaacgcccctgaacctcctgactctctgctcgccctcactctgacgtaaggtgacgttcctcttacgaggttcagtggactaggtggagtcgtagggacagtactttcgactcctaccactatcctcagtctacgtacacctagaagttactttcgacttaacgttatactcgtacaactagtactttactacgtcgtacccgtttgtacgttttcggggaccgggtaactagtccggtaggtaacgtaactaaccgaaacgtactggtacgacgtcgacctaccattccgttntaccttctacgttccctccgactacttctagttatatcttactcggtacgtgggacgtcgggtccagggactaacgggtcactagngctgng

SEQ ID NO: 285049 - DNA, 631 bp, Homo sapiens
  misc_feature: GYAE6OF01B0FNQ.44.69.G03.1.454.CMB.1.raw
  modified_base (212)..(212): a, c, t, g, unknown or other
  misc_feature (212)..(212): n is a, c, g, or t
  modified_base (629)..(629): a, c, t, g, unknown or other
  misc_feature (629)..(629): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccgagggaacncccctgaactcctgatctctgctgcctccactctgcaagggtgacgtctcttcaaggttcagtggctaggtgatcgtgggacagtactttcactctcacctatctccagtcctgccaaccgtgaagtattttcgacctaaactttactacttgtacaaacgtagtagtttaactaccgttcggaccccgtttcgttaccgttttcggggaccgggggtaacctaaggtcgtagggaacgtactaaccgaaacgtaccgttggtcgtacgtcgacctaccctacgttccttcgtttaccttacgtacctttcccgttaccccgtaccctagttacctacgtacttaacttacttacgttcgttaccggtaggtaccgggtcggggtcctacggggactacgggtcccagtaacgcgtncg

SEQ ID NO: 285050 - DNA, 782 bp, Homo sapiens
  misc_feature: GYAE6OF01BNMAE.44.69.G03.1.454.CMB.1.raw
  modified_base (218)..(218): a, c, t, g, unknown or other
  misc_feature (218)..(218): n is a, c, g, or t
  modified_base (778)..(778): a, c, t, g, unknown or other
  misc_feature (778)..(778): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgtcttctataggagacagagtcgccatcacttgccgggcaagtcagacctattaacagtcttatttaaattggtatcagcagacgaccgaagggaacncccctagaacctcctgatcctactcgtctcgccctccactctaggcaagggtggtagtcctcgttacgaaggttcgaggtggacgtaggttcggactcggtacgggactacggttactttacgaccttaccgtaccctaaacccgtagttaccccttaccgacggttccgtaccggtaaccctaaccggttaggtaaaccgttttacgttttacgaaacccgttttaaacctttaccgtttaacgttaccgaaacccgttaaacgtaagggttttaacctttaacttccccggtttaccccggttaccccggttttaccgttaaccggggttttcccgggggaccggggtaacccgttagggtccggtaaggtacgtaaccgtaacgtaaccgtacgtgggttaccgactaccggtacctaccgtacttcgtacgttccttacgtaccgttacccccgttccgaccttacttacgtagttaacttacgttaccttagtacggttcgtagggtacccggtcgggaccgtacgaccggaacgggttaccaggttaacgtcgngtac

SEQ ID NO: 285051 - DNA, 675 bp, Homo sapiens
  misc_feature: GYAE6OF01DB5XI.44.69.G03.1.454.CMB.1.raw
  modified_base (671)..(671): a, c, t, g, unknown or other
  misc_feature (671)..(671): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagacgaccaagggaacgccctagaactcctagattctctgctcgcctccatctgacaggtggagtcttcttacgtaaggttcagtggcaggtgatcgtaggactagtacttcgactctcacctatcctacgacgtctcggacaaccgttagtaacttgttttacgaccttaactttaaccttacgttagtaacctaaacgtaagtaacgttttaactaacccgttcggttaccccgtttagttaccggttttacggggtaaccgggggacctaacggtcgttagggtaacgtaacgtaaccgtaaacggtacggttcgtacggtcctacggtaaccctacgtacttcgttaacgttctttaccttacttcccgtttaccccgacttacgttacgttacgtaaactttagtaaccgttcgttacggtcgtaggtacgggtcggtacgttagggaccgtaagggtccgtaactaggngctg

SEQ ID NO: 285052 - DNA, 711 bp, Homo sapiens
  misc_feature: GYAE6OF01APP5E.44.69.G03.1.454.CMB.1.raw
  modified_base (210)..(210): a, c, t, g, unknown or other
  misc_feature (210)..(210): n is a, c, g, or t
  modified_base (330)..(330): a, c, t, g, unknown or other
  misc_feature (330)..(330): n is a, c, g, or t
  modified_base (679)..(679): a, c, t, g, unknown or other
  misc_feature (679)..(679): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccggcaagtcagaccattaacagctatttaaatggtatcagcagagaccagggaaacncccctgaactcctagatctctgcctgccctccactctcgcaaggtggtactcctcttacgtaaggttcctaagtggacaggtacggtatcggtgggacctaggtaactttccgacttacnccgaccctacgttcctaccgaacgttccgttacggaccctaaccgttaggtaaacgttacgtttttacgaaccttaaactttaacccggtaccttacggtaacctaaacgttaacggtaaggttttaacctacccgtttaccggtacccccgtttagttacccgggttttacggggtacccggggaactaaacgggttcccgtaagggtactacgtaaccgaaaccggtacgttcgggttacgtaccgtacgaccgtaccgtacttaccgtcgtttccctacgtctttacccgtacccgtactcttcgatattacgtactccgtaattccggtaggacgtcgggtaacnccgggaacgtaccggtcgtacggacttgccga

SEQ ID NO: 285053 - DNA, 757 bp, Homo sapiens
  misc_feature: GYAE6OF01CDDUF.44.69.G03.1.454.CMB.1.raw
  modified_base (178)..(178): a, c, t, g, unknown or other
  misc_feature (178)..(178): n is a, c, g, or t
  modified_base (445)..(445): a, c, t, g, unknown or other
  misc_feature (445)..(445): n is a, c, g, or t
tcagacagtatatacacgaccggtgctcgatttagtcgctgcgtaaaggagaaagggaggaaggagactgggtcatctagatgtgacatccagatgacccagtctccttcctcctgtctgcttactataggagacagagtcgccatcacgttgccgggacaagtcagaccaattaacngtctatttaaattggtatcagcagagaccaagggaaacgcccctagaacctctagactctctagctcgcctaccacgttcgagacgtaagggtcgtaacgttccttactttaccggaaggttccaggttacggacaggtggtaactgtacgggactagtactttccgaacttctacgactatctacctagtcctgacctaacgtgtaaacgttactttcgaacctaacgtttactactcgtaaccaaagtacggttaacgtttaacnccggttacccgttaccccgtttacggtttaaccgggtttttcgggggaaccgggggtaacctaaggggttaccgtaagggtaacgtaacttaaaccggtaaaccgtaaggtttcggaccggttactacggtaaccctaacgttaccgttacgttactttaccgttaccgtacctttacccgttacccgtaaccttacgttacttaacggttaactttaaacgttaccgtttaacttcggttacggttacggtaaccggggttgggtaccggtacgggtaacgaacggggttacaggttaaacagggtcaagg

SEQ ID NO: 285054 - DNA, 658 bp, Homo sapiens
  misc_feature: GYAE6OF01DBQWL.44.69.G03.1.454.CMB.1.raw
  modified_base (177)..(177): a, c, t, g, unknown or other
  misc_feature (177)..(177): n is a, c, g, or t
  modified_base (336)..(336): a, c, t, g, unknown or other
  misc_feature (336)..(336): n is a, c, g, or t
  modified_base (362)..(362): a, c, t, g, unknown or other
  misc_feature (362)..(362): n is a, c, g, or t
  modified_base (655)..(655): a, c, t, g, unknown or other
  misc_feature (655)..(655): n is a, c, g, or t
  modified_base (658)..(658): a, c, t, g, unknown or other
  misc_feature (658)..(658): n is a, c, g, or t
tcagacagtatatacacgaccggtgctcgatttagtcgctgcgtaaaggagaaagggaggaaggagactgggtcatcgtagatgtgacatccagatgacccagtctccttcctccctgtctgcttctataggagacagagtcgccatcacttggccgggcaagtcagaccattaacngtctatttaaattggtatcagcagagaccgagggaacgccctgaactcctgatctctgctcgcctaccactctgacgaagggtggtacgtcttccttagtaaggttcaggtggcaggtggatcggtaggactagtctttcactctacactactcctacncgtctacgactaacgttgaacgtttntttacgaccttaaacctttactaacgttcgtaacaacgtaagtaacgtttactacccggttcgtaccccgtttagttaccgggttttcgggggacccgggtaactacgggtacggtaggaacgtactaacgaaaccgggttacgtggttacgacgttacgacctaccgttattccggttaccgtttaccttacccgtacgtttccccgtacccactttacgtcttagtaatttacgtctttaacgtcttagggaccggggtcgtcggtacggacgaacgggtcgaatatcggntgn

SEQ ID NO: 285055 - DNA, 766 bp, Homo sapiens
  misc_feature: GYAE6OF01D71EQ.44.69.G03.1.454.CMB.1.raw
  modified_base (125)..(125): a, c, t, g, unknown or other
  misc_feature (125)..(125): n is a, c, g, or t
  modified_base (160)..(160): a, c, t, g, unknown or other
  misc_feature (160)..(160): n is a, c, g, or t
  modified_base (225)..(225): a, c, t, g, unknown or other
  misc_feature (225)..(225): n is a, c, g, or t
  modified_base (766)..(766): a, c, t, g, unknown or other
  misc_feature (766)..(766): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttntaataggagacagagtcgccatcacttgccggganaagtcaagaccaattaacgagtctaatttaaattggtactcagacagacgaccgaacgggaaacncccctaggaacctctagactctctgactcgaccctcactcgtgacgtaaggtggtacgttcttacgttactaagggttacaggttaggacgtaagttgggaacttaccgtagggaacctaaggttactttcaacctctacaccacgttaccgtacctaagtctacgaccaaccgttagaagtttacttttacggaacttaaaccgtttaacgtaacttacgtaacgtaaaccgtagtaacgtttaacttacgtaccggtaccccgtttacgttaacggttttacgggaccggggtaaccttaagggtacttacgggtaaactaacgttaacccgaaaacgttaacggttgggtacggtcgttaacgtacggtaaccctattaccggttactttacccgttactaacgtttccccgttacccctaacggtacttacccggttataacgttaaacgttaccgttaccgttacggttaaccgtgggtaaccgggtacggtacccggttaggaaaccggaaccggtacgtaacctaaggttcagn

SEQ ID NO: 285056 - DNA, 501 bp, Homo sapiens
  misc_feature: GYAE6OF02IIYU5.44.69.G03.1.454.CMB.1.raw
  modified_base (500)..(501): a, c, t, g, unknown or other
  misc_feature (500)..(501): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacaggatttcactctcaccatctccagtctgcaacctgaagtattttgctaactttactactgtcaacagagttatactcgtccccgtttcacgtttttggtcgggggtaccaaggctggagactcaaacgaactgtggctgcaccatctgtcttcattccttcccgcctatctgtatatatactgtctgagcggctggcaggcgcgatagnn

SEQ ID NO: 285057 - DNA, 479 bp, Homo sapiens
  misc_feature: GYAE6OF02HC2ND.44.69.G03.1.454.CMB.1.raw
  modified_base (327)..(327): a, c, t, g, unknown or other
  misc_feature (327)..(327): n is a, c, g, or t
  modified_base (471)..(471): a, c, t, g, unknown or other
  misc_feature (471)..(471): n is a, c, g, or t
  modified_base (477)..(478): a, c, t, g, unknown or other
  misc_feature (477)..(478): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcattggatctgggacagatttcactctcaccatctccagtctgcaactgaanattttgcaactttactactgtcaacagattatactgcccgttcacgttttggtcggggaccaagctggagatcaaacgactgtggctgcacatctgtcttcatctcccgcatctgatatatctgtctgagtcggctggcaggcncatagnng

SEQ ID NO: 285058 - DNA, 490 bp, Homo sapiens
  misc_feature: GYAE6OF02IRYUT.44.69.G03.1.454.CMB.1.raw
  modified_base (376)..(376): a, c, t, g, unknown or other
  misc_feature (376)..(376): n is a, c, g, or t
  modified_base (484)..(484): a, c, t, g, unknown or other
  misc_feature (484)..(484): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctggggacagatttcactctcacatctccagtctgcaacctgaagtattttgcaaactttactactgtacaaaagtataaacagtcgcccctnactacctttcggccctgggaccacagtgatatcaagcgaactgtgctgccacatctgtcttcatccttcccgctatctgatatatctgtctgagcggctggacaggcncatacg

SEQ ID NO: 285059 - DNA, 491 bp, Homo sapiens
  misc_feature: GYAE6OF02I9AW4.44.69.G03.1.454.CMB.1.raw
  modified_base (490)..(491): a, c, t, g, unknown or other
  misc_feature (490)..(491): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctcactctgcaaggtggagtctcttcaaggttcagtggcagtggatctggggacagatttcactctcaccatctccagtctgcaacctgaagattttgcaactttactactgtcaacagagttatactgtccccgttctacttttgggtcgggggtaccaagctggagtatcaaacgactgtgctgcaccatctgtcttcactcttcccgcctatctgatatactactgtctgagcggctggcaaggcgcatgnn

SEQ ID NO: 285060 - DNA, 485 bp, Homo sapiens
  misc_feature: GYAE6OF02H1BI6.44.69.G03.1.454.CMB.1.raw
  modified_base (484)..(485): a, c, t, g, unknown or other
  misc_feature (484)..(485): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctcactctgcaaggtggagtctcttcaaggttcagtggcagtggatctgggacagatttcactctcaccatctcagtctgcaactgagattttgcaactttactactgtcaacagagttatactgccccgtttcacgttttggtcggggaccaagcttggagatcaaacgaactgtgctgcaccatctgtcttcattccttccgcatctgatatacttactgtctgagcggctggcaaggcgcatagnn

SEQ ID NO: 285061 - DNA, 481 bp, Homo sapiens
  misc_feature: GYAE6OF02GH0UU.44.69.G03.1.454.CMB.1.raw
  modified_base (481)..(481): a, c, t, g, unknown or other
  misc_feature (481)..(481): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtctgcaacctgaagattttgcaacttactactgtcaacagagttatactgcccgttcacttttggtcggggaccaagctggagatcaaacgactgtgctgcaccatctgtcttcatcttcccgcatctgatatatactgtctgacgcggtctggcaaggcgcatagn

SEQ ID NO: 285062 - DNA, 569 bp, Homo sapiens
  misc_feature: GYAE6OF02JW9AH.44.69.G03.1.454.CMB.1.raw
  modified_base (284)..(284): a, c, t, g, unknown or other
  misc_feature (284)..(284): n is a, c, g, or t
  modified_base (568)..(568): a, c, t, g, unknown or other
  misc_feature (568)..(568): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctcactctgcaaggtggagtctcttcaaggttcagtggcagtggatcngggactagatttcactctcacctatctccagtctgacctaacctgtaacgtattttcgacctaactttactactgtaccaactagtatttacactcgtaccccgttacgtacgttttcgggacggggtacctaaggtcgtgggtatactaaccgtaaacgtacgtgtaggcctggacctactattctacgttccttcaacttcccttcccgtacctacttctacgtattactattaccgtgtcctaggacggtacggcgtaggccgtaagtccggacagtacgnc

SEQ ID NO: 285063 - DNA, 535 bp, Homo sapiens
  misc_feature: GYAE6OF02HV48U.44.69.G03.1.454.CMB.1.raw
  modified_base (528)..(528): a, c, t, g, unknown or other
  misc_feature (528)..(528): n is a, c, g, or t
  modified_base (534)..(535): a, c, t, g, unknown or other
  misc_feature (534)..(535): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccaagggaaacgcccctagaactcctgatctctgctgcctccactctgcaaggtggatctcttcaaggttcagtggcaggtggatcgtgggacagtactttcactctcacctatcttcagtctgcaactgaatatttgactaactttactactgtacaactagtagttactactcgtcccgttctacgttttcgggtcggggacctaggcgtaggacgtactacgaaacgtacgttgtcgctcgacactatctgttcttcacttcctcccgctctctgtattactactactcgtctacggtaggtccggtcgtcggacgacggccgngactgnn

SEQ ID NO: 285064 - DNA, 549 bp, Homo sapiens
  misc_feature: GYAE6OF02HWC3I.44.69.G03.1.454.CMB.1.raw
  modified_base (548)..(549): a, c, t, g, unknown or other
  misc_feature (548)..(549): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaatggtatcagcagagaccagggaaagcccctgaactcctgatctctgctgcctccactctgcaaggtgagtctcttcaaggttcagtggcagtgatctgggacagatttcactctcaccatctccagtctgcaacctgaagtattttgctaactttactactagtacaacagtagttaactactcgtccccgtttctaacgtttttcgggtaccgggggtaccaaaggtcttagggaacgtataccgtaaaacgtaaacttgtaggctcggaccaccattctagttccttctacttccttcccgtctactctagtactatatacttgtctggtacgcgggtctggcgtaacggcgacgataggnn

SEQ ID NO: 285065 - DNA, 687 bp, Homo sapiens
  misc_feature: GYAE6OF02H7UOI.44.69.G03.1.454.CMB.1.raw
  modified_base (211)..(211): a, c, t, g, unknown or other
  misc_feature (211)..(211): n is a, c, g, or t
  modified_base (351)..(351): a, c, t, g, unknown or other
  misc_feature (351)..(351): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaancccctgaactcctgatctctactgcctccactctgcaaggtgagtctctcaaggttcagtggcagtggatctgggacagtatttcactctcaccatcctcagtctgccaacctgaagtattttgactaactttactactntacaactaagtagttactacgtcgtaccccgtttactacgttttcggggtaccgggggaacctaaggtccgttagggaacgtaacgttaaccgaaaaccggtaaacgttcgggttacggtccgtacggacccgtaacctaacgttcccgttacggtttacccttttaccgtaccgtttccccgttttacccccgaccccgttaatttcccggtaacggttaactttaacgtttaaccgttaccgtttacggttaccgttacggggaccgggtaccgggggtcccgttaacggggaccggtaacggggtcccgtaaccggtacggtaaggtgcgtag

SEQ ID NO: 285066 - DNA, 577 bp, Homo sapiens
  misc_feature: GYAE6OF02G9OH3.44.69.G03.1.454.CMB.1.raw
  modified_base (576)..(576): a, c, t, g, unknown or other
  misc_feature (576)..(576): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatcgtgggacagtatttcactctcaccatctcagtctgcaacctgaagtattttgactaactttactactgtacaactagtattatactcgtccccgtttctacgttttcgggtaccgggggaacctaaggtccgtagggaacgtaacgtaccgaaaacggtaacgttcggtacggtcttcgacctacctattcgtcgttaccttctacttcccgttcccgacctacttctagtacttacttactacgttgtctaggacggtccgggtcgtggacgacgggccgtacgtagtagnc

SEQ ID NO: 285067 - DNA, 658 bp, Homo sapiens
  misc_feature: GYAE6OF02G6D4M.44.69.G03.1.454.CMB.1.raw
  modified_base (642)..(642): a, c, t, g, unknown or other
  misc_feature (642)..(642): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctaatttaaattggtatcagcagagaccgaagggaaacgtccccttagaaactcctgattctctgctcgcctccactctcgacgaaggtggagtctcttacgaaggttcaggtggcaggtggtactcgtagggacagtactttcacctctacgacctatcctaccgagtctacgacctaacctagtaaagttacttttacgactaaactttacgtactacgtacaactagtacgttatactcgtacccgttagtacgtttcgggtacggggtaacaacgtcgtaggagtaactacgtaaaacgtacgttcggtagctacgactaactagttccgttaacgttccctttaccctacccgttacccgtccgtaactttacgttacgttaacgtaaccttaaattaccggttacgttcgtacggttacgggtaccgggtacggttaccggacggaacggttccggtaanaaccggtattaggatc

SEQ ID NO: 285068 - DNA, 600 bp, Homo sapiens
  misc_feature: GYAE6OF02JQ17U.44.69.G03.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (314)..(314): a, c, t, g, unknown or other
  misc_feature (314)..(314): n is a, c, g, or t
  modified_base (334)..(334): a, c, t, g, unknown or other
  misc_feature (334)..(334): n is a, c, g, or t
  modified_base (344)..(344): a, c, t, g, unknown or other
  misc_feature (344)..(344): n is a, c, g, or t
  modified_base (373)..(373): a, c, t, g, unknown or other
  misc_feature (373)..(373): n is a, c, g, or t
  modified_base (484)..(484): a, c, t, g, unknown or other
  misc_feature (484)..(484): n is a, c, g, or t
  modified_base (596)..(596): a, c, t, g, unknown or other
  misc_feature (596)..(596): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggctaagtccagaccattaacagctaatttaaatggtatcagcagagaccaggaaacgtccccttagaacttccngatctctgctgcctccactcgtncaggtgacgtctctataaggtcagtgcgagtggtatcggtggacagtacgtttcacgttcnccgtacactctccgattcgngacaccgtanacgtatttcggactactttactaccgttntactaacagttacgttactaccgtttccacccgtttcgttacgtttcggtacggggtacctacggtacgtggtaagtactaacgaacgtactcgtacgcttagactaccgnttcgtacgttcctaactccgttaccgttacccaccttacgtacttcggtaacttacgtaccttacgttagttccgtgacggttcgtacggtcgacgtacgtccgagtgtcgntacg

SEQ ID NO: 285069 - DNA, 772 bp, Homo sapiens
  misc_feature: GYAE6OF02I5LH5.44.69.G03.1.454.CMB.1.raw
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctaatttaaatggtatcagcagagaccgaagggaaacgccccttagaacctcctagactcctctgctcgccctccactcgtcgacgaagggtggacgttccttctttacgtaaggttccgaacggttggggacctagggttgggtaacgttcggtacggggactacggttacttttacccgactttccgttaccgaaccctacttcctacccgtagttccgttacggacctaacccggttagtaaacgttcttttaccgaacgtaaacctttccgtaacgtttacgtaacctaaacgtacggtaacgtttaactcccggttaccgttaccccggtttacttaaccgggtttttcggggaccggggtaacctaggtaccggtaggtactacggtaacctaaccggaaggttcggtacggtaccgtacgtaccgaacctacgttacgttccgttacgttacccttaaccgttccccggtttacccaccgtacgttacctacgtaacgtactttaaccgttacgttccggtaacgttcgggacccggtacgggtcccgtaacggtccgggtaccggaccgttaccgaagttacgccgta

SEQ ID NO: 285070 - DNA, 798 bp, Homo sapiens
  misc_feature: GYAE6OF02GH1FK.44.69.G03.1.454.CMB.1.raw
  modified_base (215)..(215): a, c, t, g, unknown or other
  misc_feature (215)..(215): n is a, c, g, or t
  modified_base (726)..(726): a, c, t, g, unknown or other
  misc_feature (726)..(726): n is a, c, g, or t
  modified_base (795)..(795): a, c, t, g, unknown or other
  misc_feature (795)..(795): n is a, c, g, or t
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagcttaatttaaagttggtatcagcagagaccagggaaacncccctgaacctcctgatctctgctcgccctacctactcgtgaccgtaagggtggtacgttccttaccgttaccgtaaagggtttccaaggttcgggaccgtaagggttgggtaacgttccgggtacggggggaacctaaggttaccttttaccctaaccgtttcccttaccaaccctatttcccctacccgtagttcccgtacgtacccaaacccgttagtaaacgttagttttaccgaaccttaaacccgttttactacgtacgttacctaaacgtaagttacgtttacgtacccgtttaccggttacccccgttttagtttaccgggtttttcgggggaacccggggtaaccttaggccggttaggaacgttacctaaccgaaaccggtcgttaggtcgtacgtcgaccctaaccgttagttccgttacgtttcccttaccgtacgtttcccccttacccggtaccttaacgttccgttaacgtactttaaaccgttattaccggtttnttaccgggtaggtacccgggtcgggttaccgtcgggtaacgaccgggtccgttaacgtacggtacgtancgg

SEQ ID NO: 285071 - DNA, 529 bp, Homo sapiens
  misc_feature: GYAE6OF02FZPIN.44.69.G03.1.454.CMB.1.raw
tcagacagtatatacacgaccggtgctcgatttagtcgctgcgtaaaggagaaagggaggaaggagactgggtcatctagatgtgacatccagatgacccagtctccttcctccctgtctgcttctataggagacagagtcgccatcacttgccgggcaagtcagaccattaacagctatttaaattggtatcagcagaggccagggaaagcccctcaactcctgatctatgctgcgtccattttgcaaagtggggtcccatcaaggttcagtggcagtggatctgggacagattcactctcaccatcagcagtctgcaacctgaagtatttcgcagctttaattattagtcaaacagagtgacaatactcccgctctactttcgggcggagggaccattggtagagatacaaacgtactggtggctgacaacctatccgtgttccttctacgttccttcccgctactcctagactattaactactacgttctggtacggcggggcttgggaccgaacgggccgactag

SEQ ID NO: 285072 - DNA, 715 bp, Homo sapiens
  misc_feature: GYAE6OF02IZ5B2.44.69.G03.1.454.CMB.1.raw
  modified_base (209)..(209): a, c, t, g, unknown or other
  misc_feature (209)..(209): n is a, c, g, or t
tcagacagtatatacacgaccggtgctcgatttagtcgctgcgtaaaggagaaaggggaggaaggagactgggtcatctagatgtgacatccagatgacccagtctccttcctcctgtctgcttctataggagacagacgtcgccatcacttggccgggacaagtcagaccatacagtctattaatggatcagcagagtacgaggaacnccctagaactcctgactctctcgctcgtcctcctacttcagtacgaagggtcgacgttctacgttacgtaagttcaggtcggacgtgtacggtctacgtgggactaggtcttccactctccgtaacctctcctactacggttctcgaactaacgttagtaagttacgtttacaccttacttacgtacgtgtaactaacgtagtacttaacgtccgtaccgttaccccgttagttaccggtttcggggtaaccgggtacgtaacggtcggtacggaacttacgtaaaccgtaaacgtacgttcggtacggtacgtcgaaccgtactacgttaccgttacgtacccgttacttaccctacccgttacccgtccgttaccgttacccgttaagttaaccggttttacttacccgttacggtttaccgttcgggaaaccggttccggggtccggtaaccggtaccggtacccggtacgggtttaaaccgacggtttaggccgtaaccgtg

SEQ ID NO: 285073 - DNA, 628 bp, Homo sapiens
  misc_feature: GYAE6OF02JFS6M.44.69.G03.1.454.CMB.1.raw
tcagacagtatatacacgaccggtgctcgatttagtcgctgcgtaaaggagaaagggaggaaggagactgggtcatctagatgtgacatccagatgacccagtctccttcctccctgtctgcttctatagggagacagagtcgccatcacttgccgggcaagtcagaccattaacagctatttaaattggtatcagcagagaccagggaaacgcccctgaacctcctgatctctgctcgcctccactctgcaagggtggagtctcttacgaaggttcaggtggcaggtggattcgtagggacagtactttcgaccgtctacacctacttcctaccgagttcctcgacctaacctaggtaaacgttattttacgaacttaacttttagttacctacgaacctaactaagttaactaaaggttactttattacgtacgtagttagtttcggaccgagggtaccaagtcgttaggagtaactacgaaacgtacgttaggcgtacgtcgaccaccgtcgttacgtcgttccttactacgtttacccgttcccgtaccctagtcgtacgtattacgtacgttaactcgttcgtaggtacgtccggtcgtacggacggacggtcgagtagtacg

SEQ ID NO: 285074 - DNA, 496 bp, Homo sapiens
  misc_feature: GYAE6OF01DDU0T.35.59.F04.1.454.CMB.1.raw
tcagtacagatcgtcacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctcttctgggtccctgatcgcttctctggctccatccttgggaacaagctgccctcaccatcgacggggcccaggcagatgatgaatctgattattactgtgtgctgtatatgggtagtggctcgttgggtgttcggcggagggaccaagctgaccgtctaggtcagccaggtcc

SEQ ID NO: 285075 - DNA, 565 bp, Homo sapiens
  misc_feature: GYAE6OF01BBMIL.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtacccaacacgaccccaggccaggctccgcgcacgctcatctacagcaacaaacactcgctcttctgggtcccctgatcgcttctctggctccatccttgggaaacaagctgcccctcaccatccgacggggcccaggcagatgatgaatctgaattattactgttagtgcttgttatagttgggtagtggtcttcggtttggggttcggtttcggggcggggtacggggacccgtaaagggccgttacgggaccccgttccgtaacgggtccaacgggcccccgtaaagggtcccccg

SEQ ID NO: 285076 - DNA, 507 bp, Homo sapiens
  misc_feature: GYAE6OF01A8HW0.35.59.F04.1.454.CMB.1.raw
tcagtacagatcgtcacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctcttctgggtccctgatcgcttctctggctccatccttgggaacaaagctgccctcaccatcgacggggcccaggcagatgatgaatctgattattactgtgtgctgtatagtggtagtggtctcgttgggtgttcgggcggtagggaccaagctgaccgtcctaggtcacgcccgaaggtcccg

SEQ ID NO: 285077 - DNA, 591 bp, Homo sapiens
  misc_feature: GYAE6OF01C8LHA.35.59.F04.1.454.CMB.1.raw
  modified_base (148)..(148): a, c, t, g, unknown or other
  misc_feature (148)..(148): n is a, c, g, or t
  modified_base (164)..(164): a, c, t, g, unknown or other
  misc_feature (164)..(164): n is a, c, g, or t
  modified_base (167)..(167): a, c, t, g, unknown or other
  misc_feature (167)..(167): n is a, c, g, or t
  modified_base (169)..(172): a, c, t, g, unknown or other
  misc_feature (169)..(172): n is a, c, g, or t
  modified_base (174)..(176): a, c, t, g, unknown or other
  misc_feature (174)..(176): n is a, c, g, or t
  modified_base (180)..(180): a, c, t, g, unknown or other
  misc_feature (180)..(180): n is a, c, g, or t
  modified_base (182)..(184): a, c, t, g, unknown or other
  misc_feature (182)..(184): n is a, c, g, or t
  modified_base (187)..(187): a, c, t, g, unknown or other
  misc_feature (187)..(187): n is a, c, g, or t
  modified_base (189)..(190): a, c, t, g, unknown or other
  misc_feature (189)..(190): n is a, c, g, or t
  modified_base (193)..(194): a, c, t, g, unknown or other
  misc_feature (193)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (201)..(205): a, c, t, g, unknown or other
  misc_feature (201)..(205): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (211)..(212): a, c, t, g, unknown or other
  misc_feature (211)..(212): n is a, c, g, or t
  modified_base (214)..(214): a, c, t, g, unknown or other
  misc_feature (214)..(214): n is a, c, g, or t
  modified_base (216)..(217): a, c, t, g, unknown or other
  misc_feature (216)..(217): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (236)..(236): a, c, t, g, unknown or other
  misc_feature (236)..(236): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcggngttcgctagcgcttanagncnnnngnnngtgngnnnggngnngcnncngngcnnnnncngncnncncnntcnctcngtagctatgctngcgcgcggtcgcgcgcgcgngcgaggcgtggnggtggtggtcgtagtagtatctatatagtagtaggtaagtaagtagtagtacgtagtacgacgtagtacgtacggtacgggtaacggtaccgtacgttacctacctacgtacctaccgacgaacgaactaacctaaccgaaaccgaacgaccgtacgtacgtacgtacgtaacgaacgtaaacgtaacgtaacgtacgtacgtacggaggacggtacggtacggacggaccggaccggtccgttaggttacggttacgttacgttacggtaacggtaacggtaaacggttaacggttaaccgttacccgttaaccggttaacg

SEQ ID NO: 285078 - DNA, 622 bp, Homo sapiens
  misc_feature: GYAE6OF01AB71U.35.59.F04.1.454.CMB.1.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
tcagtacagatcgtcacgaccggtgctcgatttagtacacacacttagggagttgggggggaaggccgtgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgnggcttgagctctggctcagtctctactagttactaccccagctggtaccaacagaccccnggccaggcctccgcgcacgctcactctacagcacaaacnctcgcctcttcgtcggtccctgatcgctttctctggcctcctatccgttagggaaaccaagtctcgccctcaccacgtccgaccgggggcccaggtcagatgatagaattcgtagtatttacgttacttggttagtgtccgttagttagtttacgtagggggtttagtcgggttcctttcgggttttcgggggtagggttttccggggaccggggtaacggggtaacctaaaccgggtcgttcccggtaaccgggttccccgtaagggtcccaacgggtcccccggtaaaggtccccgg

SEQ ID NO: 285079 - DNA, 550 bp, Homo sapiens
  misc_feature: GYAE6OF01DHWO0.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtccccctggagggacagtcacactcacttgtggcttgagctctggctcagtctctactacgttacctaccccagctggtaaccaacacgaccccaggccaggcctccgcgcaccgctcactctacagcaacaaaacactcgctcttcgtcgggtccctgatcgcttctctggctccatccgttagggaaacaagctcgccctcaccacgtcggaccggggcccaggcagactgatgaatcgtagtattattactgttagtgctagttattagtgggtatgggctttcggttgggtggttcggggcgggtagggaccgagcgtacgacccggtcgttacggacacgtcccgaggtccccg

SEQ ID NO: 285080 - DNA, 737 bp, Homo sapiens
  misc_feature: GYAE6OF01E3GLX.35.59.F04.1.454.CMB.1.raw
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcgtggtttcgtcgttaggctcttttaagaggtgtccagtgtcaggtgcagttggtggagtcgtggggggaggcgtggtccagccgtggggacgtccctgacgactctcctgtgcagcctctagacttcaccttcagtagcttatggcatgcctacgtcggggtcccgccagggtcctccgaggccgaagggggtcttggggaggttggggtggactaggtttatatctaatatggtaagtagggtaaaagttaagtggtaagttaacctagtcgactaacggtacgttaacggtaggaacggggtaccgtaactttaccgaaccctacttaccctaccgaacggtaacgtaacctaaacgtttaacccgaaaacgtaaaccgaaccggtacttacggttacttacgtaacgtaacctaaaagttacgtaaaccgtaacgtacccgttaaggacggtaagtacggtaccgggaacgggaaacccggtaacgggtacgttaggtttaacggtttaacgtttaaccgtagggttaaccgaacggtaaaacggttaaccgttaacccgggtttaaaccccgttaacggttttaacgg

SEQ ID NO: 285081 - DNA, 562 bp, Homo sapiens
  misc_feature: GYAE6OF01B6JTP.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgcttgagctctggctcagtctctactacgttacctaccccagctggtaccaacacgaccccaggccaggcctccgcgcacgctcatctacagacaacaaacactcgctctcgtgggtccctgactcgcttctctgctccatccgtaggaacaacgctcgccctacaccacgtccggaccggggcccaggcagatgatagaatctatattattatgtgtgtctagtattaggttgggtagtggtcgttcggtttgggttaggttcggggacgggtaagggaaccgtaacggtcgtacggtacccgttaccggtacggtccgacgtaccccgaagggtccccg

SEQ ID NO: 285082 - DNA, 594 bp, Homo sapiens
  misc_feature: GYAE6OF01CSOWD.35.59.F04.1.454.CMB.1.raw
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtcgtgggggaggcgtggtccagcctgggaggtccctgagactctcctgtgcagcctctagacttcaccttcagtagctatggcatgcacgtgggtcccnccgaggcctccgaggcgaaggggctgggaggtgggtgctagttatatcatatgagtaggaatangtagtactagtgcagacgtacgtaggaacgggccgtattcacctatacctcaagacgactaacttaccaacgaacaccgtctacgttatcgtagtactaaacgtacgaaccgacgtacccgtagacgacgtacgtaggacgggaccgtacgggtcgttaggttacgttacgtttacgtaggtacggaacggtaaacgtacgtttaccggttaacccgttagtttaacgg

SEQ ID NO: 285083 - DNA, 541 bp, Homo sapiens
  misc_feature: GYAE6OF01EQHKI.35.59.F04.1.454.CMB.1.raw
  modified_base (343)..(343): a, c, t, g, unknown or other
  misc_feature (343)..(343): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtcgtgggggagcgtggtccagcctgggagtccctgagctctcctgtgcagcctctagacttcaccttcagtagctatggcatgcctacgtgggtcccgcagggcctcgaggcgaaggggctgggagttgggtgctagttanatcatagngatggaatatgagtactngacagactacgtgaaggccgattcactatctacaganactaattacaacgaacacgctagtactctanacaatagaacagactagacgagcgtaggacggaacgacggtctaggttagttacgttacgtggtagtacggtaaagtacgttaccgttacccgttaagttaacg

SEQ ID NO: 285084 - DNA, 590 bp, Homo sapiens
  misc_feature: GYAE6OF01BIRNA.35.59.F04.1.454.CMB.1.raw
  modified_base (342)..(342): a, c, t, g, unknown or other
  misc_feature (342)..(342): n is a, c, g, or t
  modified_base (426)..(426): a, c, t, g, unknown or other
  misc_feature (426)..(426): n is a, c, g, or t
  modified_base (508)..(508): a, c, t, g, unknown or other
  misc_feature (508)..(508): n is a, c, g, or t
tcagtacagatcgtcacgaccggtgctcgatttagtacacacacttagggagttgggggggaagccgtgagaacacttagccttcatgagtgtccccaccatggcctggatgatgcttctcctcggactccttgcttatggatcaggtagtggattctcagactggtggtcgacccgaggagcctatcgttctcagtcgtcccctgggacgggacaggtcacgactcacttgtggcttgagctctggctctagtctactacttacgttacctaccccagctcggtaaccaacacgaccccaggccaggctccggcgcacgctcgatctacgagcaacaaacnctcgacttcttcgtcgggtccctgacgtcgtcttcgtcgtcggctaccacttccgtaagggaaaccaaggtcctacgcccctanaccacgtacgggacccgggaccaggacagatgtatcgaatcgtagtatttactagtcgtagtcgtctagtaatgtggtacgngtcttcggttaggggtcttcggggcggaggtaaccgagcccgttacggtaccggtcgtacggtcgaccggccgtaggtcccg

SEQ ID NO: 285085 - DNA, 638 bp, Homo sapiens
  misc_feature: GYAE6OF01EBEOJ.35.59.F04.1.454.CMB.1.raw
  modified_base (632)..(632): a, c, t, g, unknown or other
  misc_feature (632)..(632): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggaggcgtggtccagccgtggggacgtccctgagactctccgtgtgaagcgtctggattcattcttacaaataactatggacagtcgctacgtcggggtccgccagggcctacccgaggcgaacgggactggggagttgggttggctaggttgtggtggtaattggagttagggaaagttaatacggattactagtgacagaccgtaccggttaggaacgggcctattccgacctatccaccagacgaactaacttcccgaaagtaaccttacttttcggtaccctaggacctaaagtcgaaaccgacgtccgtaagacgtacggacccgagggtaacccacgggactaattaacttagttaccgtggtacggacggtaagacggtcgtaaggtacgggaacgtcccccggttaacccgggntacggg

SEQ ID NO: 285086 - DNA, 561 bp, Homo sapiens
  misc_feature: GYAE6OF01AZCTP.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttacctacccagctggtaccaacacgaccccaggccaggcctccgcgcacgctcatctacagcaacaaacactcgctcttcgtcgggtccctgactcgctttctctggcctccactccgttaggaacaagctcgccctcaccacgtcgaccggggcccaggcagactgatgaatcgtagtattattactgtgtgtctagttatagtgggtagtggtcgttcggttggggtggttcggggacggtacggggaccgaacggtcgtaccggtacccggtccgtacggtaccgaccggtcccgaacgggtccccg

SEQ ID NO: 285087 - DNA, 733 bp, Homo sapiens
  misc_feature: GYAE6OF01D4W0E.35.59.F04.1.454.CMB.1.raw
  modified_base (181)..(181): a, c, t, g, unknown or other
  misc_feature (181)..(181): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
tcagtacagatcgtcacgaccggtgctcgatttagtacacacacttagggattgggggagaggagcccagcactagaagtcggcggtgtttccattcggtgatcagcactgaacacagaggactcaccatgggagtttgggctgagcttgggttttcctcgttgcttcttttaagaggttntccagtgtcaggtcgctaggttggtggagtcgtaggggggcgcggtggtccaggccgtggggacggtccctggagtacctctccgtgtcgcagtccctntagtacttccaccttnacgtagctagtggcatcggcacggttcgggcccgccgaggtccctaccgacgggacgaacggggtntggggtagtcggggtcgacgttaaggttatacgtacgtaattagtaggtaagttaagggaaacgtttagtaggtaacgttaactaggtagacgtaaacggtaaccggttacgggtaggtaaccggggtctaacgttaccgaccctactccgtaaccctaaggaacggtaaacttaaccgttaaccgaaacgtaaacgtaccgtacgtacggttactacgtagaacctaaagtaaccgaaccgtacgtacgaacggaggtcgtacgtacggaacggtaccgacggttacgtaggttacgttacgtaacggtacggtaacgtaaccggtaaaggtacccggtttaaccctaaacccgtttatttaaaccgggg

SEQ ID NO: 285088 - DNA, 569 bp, Homo sapiens
  misc_feature: GYAE6OF01A98K5.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttacctacccagctggtaccaacacgaccccaggccaggctccgcgcacgctcatctacagcaacaaacactcgctcttcgtcgggtccctgatcgcttctctggctcatccgtggaacaagctcgcctcaccagtcgaccgggccaggcagatcgatgaacttctaggtaattagttacgtcgtgttacgtcgttgttaacgttaggttggggttacgtcgggtacgtttccggttggggttcggttcggggtacgggtagggaacctaacggtcgtacgtacccggtacgtcggtaccacggtcccgaacggtcccg

SEQ ID NO: 285089 - DNA, 542 bp, Homo sapiens
  misc_feature: GYAE6OF01DWP99.35.59.F04.1.454.CMB.1.raw
  modified_base (310)..(310): a, c, t, g, unknown or other
  misc_feature (310)..(310): n is a, c, g, or t
  modified_base (319)..(319): a, c, t, g, unknown or other
  misc_feature (319)..(319): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttacctaccccagctggtaccaacagaccccaggccaggctccgcgcacgctcatctacngcacaaacnctcgctcttcgtgggtcccctgactcgctttctctggcctccatccgttaggaaacaaacgctcgcccctcaaccacgtccgacggggcccaggcagatgatgatctagtattattactgtgtgcttgtattagtgggtagtggtcttgttggggtgttcgggacgggtagggaccaaggccgtaggacccgttccgtaggtaccgacgcccgaagggtcccg

SEQ ID NO: 285090 - DNA, 721 bp, Homo sapiens
  misc_feature: GYAE6OF01EECMA.35.59.F04.1.454.CMB.1.raw
tcagtacagatcgtcacgaccggtgctcgatttagtacacacacttagggattggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgctaggttggtggagtcgtgggggagcgtggtccagccgtgggacgtcctgagctctcctgtgcacgcctctagtatttccacctttcaaggttacgccttaagtcgggactagtcgaccgtacgttcgggggtcccgaccgagggtccctacccggagggaccgaaggggtacttggggacggttggggtggactaagtttaatactacaagttagtaggtaagttagggaaaagttaatggtaacgttaactagttacggacgtaacggtaccgttaacggtacgggaacgggtacccgtaacgtttaccgaacctacgttaccgtaaccgtaaggaaccgtaacgtaaaccgtttaaccgaaacgtaaaccgaccgtacgttacgtacttacgtacgtaactaaagtacgtaaacacgtacgtacggacgacgacgtacggacggacgtacggtcgtaggttacgttagttacgtaggtacgtaacggtaacgtacgttaccgttaacccgttagttaaccgg

SEQ ID NO: 285091 - DNA, 577 bp, Homo sapiens
  misc_feature: GYAE6OF01BL0HS.35.59.F04.1.454.CMB.1.raw
  modified_base (286)..(286): a, c, t, g, unknown or other
  misc_feature (286)..(286): n is a, c, g, or t
  modified_base (324)..(324): a, c, t, g, unknown or other
  misc_feature (324)..(324): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtggcttggagctctggctcagtctcttactagttacctacccagctggtacccaacacgaccccnggccagcctccgcgcacgctcatctacagcaacaaacnctcgctcgtctcgggtccctgactcgcttctcgtcgctcagtcgtaggaacaagtctcgccctacacctcgccgaccgggccaggcagagtgatgaactcgtagtaatttacgttacgtgttggtcgtagttacgttagttacggttgggttacgtgttccggttggttaggggttcggttacgggcgggtacggaccgtaacggtcgtacgtacccggtcgttaacggtccaccggtacccgtaggtccccg

SEQ ID NO: 285092 - DNA, 611 bp, Homo sapiens
  misc_feature: GYAE6OF01E0M9D.35.59.F04.1.454.CMB.1.raw
  modified_base (354)..(354): a, c, t, g, unknown or other
  misc_feature (354)..(354): n is a, c, g, or t
  modified_base (471)..(471): a, c, t, g, unknown or other
  misc_feature (471)..(471): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcgtggttttcgtcgtaggctctttaagaggtgtccagtgtcaggtgcagttggtggagtctgggggagcgtggtccagccgtggggaggtccctgagcctctcctgtgcagcctctagactttccacctttcagttagctatggctatgcacgtcgggtccgccagggcctccgaggcgaaggggctgggacggtggggtgctaggttantgatatgagtaggaacgtaatggaagtactatgacaagtacgtaggtagaacgggctagtacacctatcctacgagtacgactaattaccaaagtacaccgtactacgtatccgtanaacgtaacgtacgaaccgtacgtacgtaggaacgtacgacgtacgggaacggaccgtacgggtcgttagttagttacgttacgtacggtaaggtaaaccgtaaacgttacccggttaaccgttaaccgttaagttaaccg

SEQ ID NO: 285093 - DNA, 755 bp, Homo sapiens
  misc_feature: GYAE6OF01B4RP5.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgaccaggagccatcgttctcagtcgtccccgtggacgggacagtcacactcacttggtggtcttgacgtctcgtggctcagttcctcttaacttacgttacctacccagtccgtacggtaacccaacgaccgaacccccgaggacccagggccctcccggcgccgaaccgcctacactccgtaacgacgaccaaaccaaaacctccgtccgtccttcgtttccggtccggggttcccctaggtacgttcccggtctttcctcgttcggtccctaccgtacgttccggttaagggaaaacctaacggtcctaccgtcccctacctaacccgacggtacccgggacccgggggtaccccagggacctaaggtagtacgtaacgtacgtaacgttccgttagttaacttttacgttaacgttggttcggttacgttacgttaggttaacgttagggttagggttaggttcggtaccgttttagggttggggttccggttacggggcggggtaaccgaaccggtacggtcccgttaacggttacccggttaccggttacggaccctaccgggtaacccgtacgggtccccccg

SEQ ID NO: 285094 - DNA, 567 bp, Homo sapiens
  misc_feature: GYAE6OF01EXS84.35.59.F04.1.454.CMB.1.raw
  modified_base (325)..(325): a, c, t, g, unknown or other
  misc_feature (325)..(325): n is a, c, g, or t
tcagtacagatcgtcacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgcttgagctctggctcagtctctactacgttacctacccagctcggtaccaacacgaccccaggccaggctccgcgcacgcctcactctacagcaacaaacnctcgctcttcgtcgggtcctgactcgtcttctctcgctccatccgtaggaaacaagctcgccctacaccacgtccggaccggggccaggacagactagatagactctagtatttatacgtgtgtcgtcgttagttagttagtgggtagtcggtcgttggttcgggttcggttacgggcgggtagggaccgtaggtccgtacggtacccgttccggtacgtaccgaccgcccgtacggtcccg

SEQ ID NO: 285095 - DNA, 732 bp, Homo sapiens
  misc_feature: GYAE6OF01BA0UX.35.59.F04.1.454.CMB.1.raw
tcagtacagatcgtcacgaccggtgctcgatttagtacacacacttagggagttggggggaagcctgagaacacttagccttcatgagtcgtccccaccatggcctggatgatgcttctcctcggactccttgcttatggatcgaggagtggattctcagacttggtggtcgacccgaggacgcctattcgttctcgagtcgtccccgtgggagggacagtcacactctacttggtggtctttgagtccttcgtggcctacgtacgttcctacttacgttaacgtttaaccctaccccgagtccgttacggtaacccaaaccgaccgaacccccgacggcccgacggtcccgtccccggccgaccgaccggtcctacctacgtacctaaccgaagacccaaaccaaaacctcccttccggtccctttcccgtttccgggtccggggttacccctagtaccgttccgtccttttccgtccgtcggtcccttaccgtacgtttccggttaagggaaactaacgtcctccgccccttacaccgtacgtcccggggacccgggaccgaggcaagtacgtagtagtagtactgttattatttacgtcgtgtgtgtcgttagttagttggttagggtagtcgtcgttgggttcgggttgggtaccgggcgggtacggacgtacgtccggtaccggtacccgttacggtacggtacccgacggtccccgaggtcccccg

SEQ ID NO: 285096 - DNA, 649 bp, Homo sapiens
  misc_feature: GYAE6OF01ASQ7J.35.59.F04.1.454.CMB.1.raw
tcagtacagatcgtcacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtgtcttgagctctggctcagtctctactacgttacctacccagctacggtaccaacacgacccaggccaggcctccggcgccacgcctacactcacacgacaaccaaacactcgtcttccgttcggtcgggtccctgacgttcctctttctcgtcggtcctcctacgttccgttagggaaactaacgcctcgacccctacacctacgtccggaacccggggcccagggaccaaggtactaggtactaagacttcgtagttactttattacgtgtgttacgtacttagtagttaggttagggttacgtcggtcgtttcgggttggggttcgggttaccgggcgggtaacgggtaccgtaaacggtccggttaacggtaccccgggttacggtacgggacccgtaccggaacccgtaacgggtccccgg

SEQ ID NO: 285097 - DNA, 686 bp, Homo sapiens
  misc_feature: GYAE6OF01CUPBB.35.59.F04.1.454.CMB.1.raw
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
  modified_base (387)..(387): a, c, t, g, unknown or other
  misc_feature (387)..(387): n is a, c, g, or t
tcagtacagatcgtcacgaccggtgctcgatttagtacacacacttagggattgggggggagaggagcccagcactagaagtcggcggtgttccattcggtgatcagcactgaacacagaggactcaccatggagtttgggctgagctgggttttccncgttgctcttttaagaggtgtccagtgtcaggtgcagttggnggagtcgtggggggaggcgtggtccagcccgtggggaggtccctggagactctcctgtgcagcctntagnttcaccttcagtagctatggcatgcacgtgggtccncaggcctccgaggcgaaggggcctgggacggtggggtcggcgtaggttatacgtcaagtagtcgaagtggaaagttaacgngtaagtactaagtcgacagaacttacggtaggaacgggccgtattccgaacctagtcctaaccgtaagacggtaacctaacgtttaacccgaaagtaacccgaaccgtacgttacgttaacgtacgttacggaacctaaaagtacgtaaacccgtacgtaccccggtaggtaacggaacggtaccgtagggaccggaacccggtacggtaccgttacggttaggtttaactttaccgttaggtaccggtaacggtaaaacgttcgtttaacccggttaacccgttaagtttaacccggg

SEQ ID NO: 285098 - DNA, 582 bp, Homo sapiens
  misc_feature: GYAE6OF01EQJ0W.35.59.F04.1.454.CMB.1.raw
  modified_base (245)..(245): a, c, t, g, unknown or other
  misc_feature (245)..(245): n is a, c, g, or t
  modified_base (367)..(367): a, c, t, g, unknown or other
  misc_feature (367)..(367): n is a, c, g, or t
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtcgacccaggacgccatcgttctcagtcgtccctggagggacagtcacnctcacttggtgcttgagctctggtctctagtctctacttagttacctaccccagctacggtaccaacaccggaccccgaggccaggcctccgcgcaccgctcatcctacacgccaacaaacnctcgtctcttcgtcgggtccctgctcgtctttctcgtcgcctcctactccgtacgggaacaacgctcgcccctccaccgtacgtcccggaccggggcccaggcagagtagatagacttcgtagttattacttacgtgtgtgtcttgttagtaggttgggttaggtcgtcgttcggttggggttcggttcggggacgggtacggacgtaggtccgg

SEQ ID NO: 285099 - DNA, 813 bp, Homo sapiens
  misc_feature: GYAE6OF01CKNK9.35.59.F04.1.454.CMB.1.raw
  modified_base (258)..(258): a, c, t, g, unknown or other
  misc_feature (258)..(258): n is a, c, g, or t
tcagtacagatcgtcacgaccggtgctcgatttagtacacacacttagggattggggggggaagcctgagaacacttagccttcatgagtgtccccaccatggcctggatgatgcttctcctcggactccttgcttatggatcagggagtggtattctcagacgtggtggtacgacccgaggacgccagttccgtttctacgtacggttcggttcccccggtggggaacgggacacgtcaaccacttcgtacgttggnggtcttagacgtctcgtcggctcgagttcctacttacgttactttacccaacccgagtaccgttacggtaaccccaaacggaccgaacccccgagggtacccacgggtcccgtcccggaccgaccgtacccgccttaccaactttacccaacgaacgaacccaaaaccaaaccgtacctccgtccttcggttccggtccgggtacctacgtacttcccggtctttccgtcgtcggtcccttaccgtaacgtaccggttaagggaaaacctaagtcccgttccgaacccccttaccgaaccgtacggccccggggaccggggacctagggacgtaagcttagacttaacgaacgttcgtaattactttaaagtttcgtggtggtttacggtataacgtttagtttaggggtagggtttcggtacgggttaccgtttcggggtttagggggtcgttaccgggggggaaccgggtaaggtacccggtaggttcccgggacccgtttacggggttacccgaacggggttacccacgggtaacccggtacgggtcccccg

SEQ ID NO: 285100 - DNA, 801 bp, Homo sapiens
  misc_feature: GYAE6OF01BPOZX.35.59.F04.1.454.CMB.1.raw
  modified_base (432)..(432): a, c, t, g, unknown or other
  misc_feature (432)..(432): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcttgggttttcctcgttgcttcttttaagaggtgtcctagtgtcaggtgcgtaggttggtggagtcggtggggggaggcggtggtccaggccgtgggacgtccctgacgtactccgtcctggtcgcgacgtcctactagtactttcctaaccctttcaaggttacgtcttagtcggacctattggaccctacggttccggggtccccgaccgacgggtcccttaccggagggtaccggtaaggggggccttaaggggacggggttggggtcggtacgtaacgtttaancgtaactagttacggtaggaagttaggggtaaaagttaagttcggtaacgttaacgtttagacggtaccgtaagggtaacccgttacgggtagggtaaaccgggtaccgtaagtttacccgaacccgttaacgttacccgttaaccggaaacggtaacgtaaccgttaaaccgttaacccaaacggtaaacccgacgttaaccgttaagttaaccgttacgtaacgaacctaaacggtacgaacgtacgtaccgttaagagtacggacggtacggaaccggacgtccggtagttagttacgttacgttacgtagggtacggtaaacgtaaacggttaccgttaacccgttaacggttaacttaaccggg

SEQ ID NO: 285101 - DNA, 866 bp, Homo sapiens
  misc_feature: GYAE6OF01BPAOF.35.59.F04.1.454.CMB.1.raw
  modified_base (171)..(171): a, c, t, g, unknown or other
  misc_feature (171)..(171): n is a, c, g, or t
  modified_base (745)..(745): a, c, t, g, unknown or other
  misc_feature (745)..(745): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctctttaagnggtgtccagtgtcaggtgcagttggtggagtcgtgggggaggcgtggtccagccgtgggacggtccctgacgctctccgtgtgacacgcctcgtagtacttaccacctttcaggttacgccttaagtcggaccagtcgacctaaccggttcggggtccacccgacgggcctacccggagggaccgaaggggtccgtaggggagggttggggtacggacgtaaggtttaagtacttacgaattagtaggaagttagggaaacgttaagtaggtaacgttaacgtaagttcggaacgtaacggtaacggttaacgggttacgggaaaaccggggtcccttaactttaccccgaaacccgttacgttaccccgtaacccgaaaggggtaactaaacccgttaaaaccgttaacccggaaaaagtaaaccccgtacggtaacgtttaggtaaaccttcccggttaaacgaaaccgtaaaaacgttacccggaaaaaggttaccccggttaaacgggaacggtaacgggaaccgtacgggttaacgggtaaaccccggggaaccggttaacccggggtnttttaggggttaccggtttaaaacgtttcggtaaacggggttaccgggaaaaccggttaaaacgggttaccccgttttaacccgggtttaaaacccccggttttaagtttaaaccccgggg

SEQ ID NO: 285102 - DNA, 706 bp, Homo sapiens
  misc_feature: GYAE6OF01CXL5K.35.59.F04.1.454.CMB.1.raw
  modified_base (601)..(601): a, c, t, g, unknown or other
  misc_feature (601)..(601): n is a, c, g, or t
  modified_base (610)..(610): a, c, t, g, unknown or other
  misc_feature (610)..(610): n is a, c, g, or t
  modified_base (617)..(617): a, c, t, g, unknown or other
  misc_feature (617)..(617): n is a, c, g, or t
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggacctccttgcttatggatcaggagtggattctcagactgtggtcgacccgaggacgccatcgttctcagtcgtcccgtggagggacagtcacactcacttgtggcttgagctctggctcagtctctacttagtttaaccaccccgagcgttacggtacccaaacgacgaacccccgaggccctaacgggcctcccggacgccaaccggtctccaactccgtaacacgacccaaaccgaaaacctaccgtccgctttccgtcggtccggggtccctggaccttccgtccttcgtcgtcggtccttacctacgttaccgttaggggaaaaccctaaaggtccctaccggtaccccctacaacccgtacgtaccccgggaacccgggggacccctaggggaccaacggtagtcgtaagtgtaaacgtgttagtaatttacttacggttntacgggttnacgtttnttaaggttaggttgggttaaggttcgggttacgtttcgggttcgggggtttcgggtacgggaggggtaacgggacctacgggtacccgg

SEQ ID NO: 285103 - DNA, 583 bp, Homo sapiens
  misc_feature: GYAE6OF01DARGL.35.59.F04.1.454.CMB.1.raw
  modified_base (169)..(169): a, c, t, g, unknown or other
  misc_feature (169)..(169): n is a, c, g, or t
  modified_base (171)..(171): a, c, t, g, unknown or other
  misc_feature (171)..(171): n is a, c, g, or t
  modified_base (174)..(175): a, c, t, g, unknown or other
  misc_feature (174)..(175): n is a, c, g, or t
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (184)..(184): a, c, t, g, unknown or other
  misc_feature (184)..(184): n is a, c, g, or t
  modified_base (190)..(190): a, c, t, g, unknown or other
  misc_feature (190)..(190): n is a, c, g, or t
  modified_base (193)..(193): a, c, t, g, unknown or other
  misc_feature (193)..(193): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcggtgttcgcgtagcgtcttagagncntgnngngcngtgnggatgnggngcngcngcnggcgtccagnactntcntgcntctnagntanacctgatcnctgtgctnagctacgttcgggacccncgcgctcgaggcgaggcgttggnggnggagacgtagttatactggtatagtagtagtaaggtaagtagtagtaacgtacgtagtagtacgtacgtacgtacggtacggtacggtaccgtacgtactacgtacgtacgtacgtacgacgtacgtaactaacgtaaacgaacgtacgtacgtacgtacgtacgtacgtaacgtaacgtaacgtacgacgtacgtacgacgacgacggtacggtacggacgtacggtcgtagttagttagttagtacgtacgtacgtaacgtaacgttaaccgttacgttacgttacg

SEQ ID NO: 285104 - DNA, 753 bp, Homo sapiens
  misc_feature: GYAE6OF01CA2ML.35.59.F04.1.454.CMB.1.raw
  modified_base (235)..(235): a, c, t, g, unknown or other
  misc_feature (235)..(235): n is a, c, g, or t
tcagtacagatcgtcacgaccggtgctcgatttagtacacacacttagggattggggggggaagcctgagaacacttagccttcatgagtcgtccccaccatggcctggatgatgcttctcctcggactccttgcttatggatcagggagtggattctcagactggtggtacgacccgaggacgcctattcgttctcagtcgtccccgtgggagggacagtcacactcacgttgnggtcttgagcctcgtggctcagttcctacttaacttacgttacctacccagtctacggtaaccaaacacgaccccgaggccaggcctccggcgcactctcatactacacacaacaaaactctccgcttcgttccgcgggtccctaggacttccgtcttctcgtacggtcctacccgtaagttacccggttaacgggaaaacaaacggtccttaccggccccttacgaacccctaacggttacccgggaaaccggggggttcccaaggggaccaaggtaacgttaggaacgtaggtaaactttccgttaaggtaattttaaacgttacgtttaggtcggtcgttagttaggttaaagttaggtttaggggtagttcggggtactttccgggggtttgggggttacgggttaccggggggaacgggtaacggggaacccgtaacgggtaccggttaacccggttaaccccggttacggtaacgggttacccaaacggtcccccgggaaagggttcccccg

SEQ ID NO: 285105 - DNA, 655 bp, Homo sapiens
  misc_feature: GYAE6OF01EWG9N.35.59.F04.1.454.CMB.1.raw
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (344)..(344): a, c, t, g, unknown or other
  misc_feature (344)..(344): n is a, c, g, or t
  modified_base (361)..(361): a, c, t, g, unknown or other
  misc_feature (361)..(361): n is a, c, g, or t
  modified_base (461)..(461): a, c, t, g, unknown or other
  misc_feature (461)..(461): n is a, c, g, or t
  modified_base (491)..(491): a, c, t, g, unknown or other
  misc_feature (491)..(491): n is a, c, g, or t
  modified_base (513)..(513): a, c, t, g, unknown or other
  misc_feature (513)..(513): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatgggagtttgggctgagcgttgggttttccttggtgtacttaattttaaaagtgtcagtgtgaggtgcacgtgggtggaggtcgggcggaggtcttcggtaagccgaggacggtcctaagctctctgtgctagttcngtacttccttnatgtcnctggatgaactggtccgcacggctaccggaggggaaggcgtgggaggtcgggttcgacccgntaaaggttaaaacgggngtaatggtaagtgggacggaacaacgaacgcctacgtctaccgaccgttgacgggcagtactaccgactctacaggtatatgtactcgatcggtattacncgttgtaccttactaactaacgtacgaacncggtaccaggtaacccaacggnaacccgagacgtacccgttatacgttaccgacgtaaccctacgtctaacaccctacgtccgtaccggtactaccgtaccgtaacggaacgttacggttcgggggaaccgggggttacccggtaaactcccgggttaacccgg

SEQ ID NO: 285106 - DNA, 934 bp, Homo sapiens
  misc_feature: GYAE6OF01BIDXH.35.59.F04.1.454.CMB.1.raw
  modified_base (181)..(181): a, c, t, g, unknown or other
  misc_feature (181)..(181): n is a, c, g, or t
  modified_base (211)..(211): a, c, t, g, unknown or other
  misc_feature (211)..(211): n is a, c, g, or t
tcagtacagatcgtcacgaccggtgctcgatttagtacacacacttagggattgggggggagaggagcccagcactagaagtcggcggtgtttccattcggtgatcagcactgaacacagaggactcaccatggagtttgggctgagtcgttgggttttcctcgttgcttcgttttaaggnggtgtccagtgtcgaggtgctaggtttggnggagttcggtggggggagtcggtcggtccaggcccgttggggacggttcccctggacgtaccttccgttccgtaggtcgcctacgtcccttacgttaagtactttcctaaccgtttcgaaggttacgcttagtcgggactaagttcggacctaccgggttcgggcccgtacccgacgggtccctaccggagggaaccgtaaggggacgtggggtacgggttggggtcgacgttaagtttatacgtactaagtttagtaggtaaggttaaagggtaagttaaacggtgtaaacgtttacgtagttacggaacctaacgttaaccggttacggggtaacgggtaaaccggggttccctttaaccgttaacccgaacccgttaacttaccccggtaaaccggtaaacggtaaacccggtaaaaccctttaaaacggttaacccccgaaaaacgttaacccgtaacccggttacgttttaaacccgttaccgttaacccgttaaacggtaaaacctaaaacgggtacccgtaaaacggttacccggaaacggttacgggtaaaccgtacgggtaaccgggtaaccgggtaaaccggggaacgtttaccggggtacgttttacggttaacggttttaacggtaacccgggttaagggaaccggttaaaacggttaaacggtttaaccccggttaaccccggttttaaacgtttacggtttaaaccggg

SEQ ID NO: 285107 - DNA, 666 bp, Homo sapiens
  misc_feature: GYAE6OF01DG7D5.35.59.F04.1.454.CMB.1.raw
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
  modified_base (399)..(399): a, c, t, g, unknown or other
  misc_feature (399)..(399): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
tcagtacagatcgtcacgaccggtgctcgatttagtacacacacttagggattgggggaaaaggccctgaggaaaacaaaccccagcgtgggaagcctgagaacacttagccttcatgagtcgtccccaccatggcctggatgatgccttctcctcggacctccttgcttatggatcgaggagtgtattcncagactgtggcgaccgaggacgccatcgttnacgcgtcgtacccgtgggacggacagtcactactcgngttggcggtcttgagtctcgtggctctaggtcctacctaatacgttacccaccccgtaagtccgtacggaaccaaccgaccgaccccgaacggcctacgggccctccggcgaccaccggtcctaacaccttacaacgganaacccaaactaaaccnctcgctccgttcggacgggtcccngtacgcctntctcgcgcctactgtaccgtaggaacaagtcaccgtccacgtacnggcgggacccggncggaaccnacggttgagtacctaataccgttagttaacctttgtaaccgtggttgacgggttcctagttaccgggttagggtgggttccgggaacgttccgggttttggtccgggggttggttacccggggaagggaccgggttaccgaggtttcccggg

SEQ ID NO: 285108 - DNA, 788 bp, Homo sapiens
  misc_feature: GYAE6OF01B97QB.35.59.F04.1.454.CMB.1.raw
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcgaggagtggattctcagtactgtggtgacccgaggacgccatcgttctcgagtcgtccctgggacggacagtcactactctacgttggtcggtcttggagtcttcgtcggtctctagttccttaccttaacttacgttaccctaccccgtacggtctacggtaaccaaccgaaccgaccccgacggacccgaccggtcccgtcccggaccggaccaccgtaccctccgtaacttacccgtaaccacgaaccctaaaccaaaaccctccgtaccgtcccgtttccgtttccggtccggggttacccctggtaccgttcgtccctttaccgttccgttacggtcccttcccgtacgttacccggttaaggggtaaaaccctaaacggtcccgtaccgtaccccctacccgaacccgtaccgtacccggggaccccggggtacccgaacgggtacgaacgttacgtacggtactacggtaacttccgtaggttactttaagttcgtaggttcgttagttacgttaggtacgttagggttggggtacggtttggtaccggttttgggttacggggttcgggttacgggggacgggtaaccgggacgttagggtacccgg

SEQ ID NO: 285109 - DNA, 610 bp, Homo sapiens
  misc_feature: GYAE6OF01A4SO3.35.59.F04.1.454.CMB.1.raw
  modified_base (338)..(338): a, c, t, g, unknown or other
  misc_feature (338)..(338): n is a, c, g, or t
  modified_base (496)..(496): a, c, t, g, unknown or other
  misc_feature (496)..(496): n is a, c, g, or t
tcagtacagatcgtcacgaccggtgctcgatttagtacacacacttagggattggggggggaagcctgagaacacttagccttcatgagtgtccccaccatggcctggatgatgcttctcctcggactccttgcttatggatcaggagtggattctcagactgtggtcgacccaggagccatcgttctcagtcgtcccctgggagggacagtcacactcacgttgtggcttgagctctggctcagtctctactacgttacctacccagtctacggtaaccaacacgaccccacggccaggcctccgccgcaccgctcactcctacacgacaacaaacnctcgtctcgttcgtcgggtccctgtactcgctttcgtcgtcgccgtactacttccggttaagggaaacctaacggtcctacgcccctacaccgtacgtaccgggacccggggtcccaaggcaacggattaggactagtatctagtaactttattacgngttcgtgtcttagtagttaggtgggttgtggtcgtttacgggtcgggttggttcgggcgggtacgggacgtacgtcggtacgtaccgtcgtacggtacgcgtaccgaggtcccg

SEQ ID NO: 285110 - DNA, 616 bp, Homo sapiens
  misc_feature: GYAE6OF01A19S5.35.59.F04.1.454.CMB.1.raw
  modified_base (174)..(174): a, c, t, g, unknown or other
  misc_feature (174)..(174): n is a, c, g, or t
  modified_base (301)..(301): a, c, t, g, unknown or other
  misc_feature (301)..(301): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcttgggttttcctcgttgcttcttttaagnggtgtccagttgtcaggtgctaggttggtggagtcgtgggggaggcgtggtccagccgtgggacgtcctgagctctctgtgagcgtctgattcatctacaatactatggcatgcacgtcggggtccnccgaggcctccgaggcgaagggcgtgggagtggttggctaggtttgtggttaggtatgagtaggaaagttaatagaattaactagtacgacgagaaccacggtaggaacgggtaccgtagttaccactactacgtaccaagagaaactaacttaccgaaagtaaccttacgtttacgttaccgtagtaacctaaagtacgaaacgtacgaccgtaggtaacgacggacgaacggacgaacggcgtaataagtacttagtcgtagacggagaacgacgaggtacgggacgtacccggtaccccgagtcggtaacgg

SEQ ID NO: 285111 - DNA, 929 bp, Homo sapiens
  misc_feature: GYAE6OF01APSR4.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtcgacccgaggacgccattcgttctcgtagtcgtccccgtgggacggacagtcacactctacgttgtggtcgttgacgtcttcgtcggtctcgtagttccttaccttaacgttaacggttaaccctaacccccgaaggtccgttaccgggttaaacccaaaccgaaccggaaccccccgacggggacccaaccgggcccgttccccggccggtaccgacccggtctaccacgttacctaaccgtaacggaccaaacctaaaaccctaaccgtaccggttcccttcccgtttttccggtaccgggggtttccccgttcggtaacgttcgttcctttccgttccgttacggtcccttaccctacgttacccggtttaaacgggaaacctaaacgggtcccgttaccgtccccgtacccgtaacccctacggtaccccggggaccccggggtaccccgaacggtaaccacggtaacgtacggtaacgttacgacgttcgttaacgtttacttttaacgttacgtttcggtttacgtacggtccgtttagttaacgtttaagggtttacgggttacgggttacggttccggttttggggtttcggggtttacgggtttccgggggggtaaacgggtaaccccgggggttaaaccctaacggggtaccccgtttaccggggtaaccccccggttttcccggggtttaaacgggttacccccggaaaacccgggttacccccggtaacccgggggtttaccccccccggg

SEQ ID NO: 285112 - DNA, 818 bp, Homo sapiens
  misc_feature: GYAE6OF01E04V8.35.59.F04.1.454.CMB.1.raw
  modified_base (178)..(178): a, c, t, g, unknown or other
  misc_feature (178)..(178): n is a, c, g, or t
tcagtacagatcgtcacgaccggtgctcgatttagtacacacacttagggattggggagaggagcccagcactagaagtcggcggtgtttccattcggtgatcagcactgaacacagaggacctcaccatggagtttgggctgagtcttgggttttcctcgttgtcttcttttaaggnggttgtcgagtgtcaggtgcgtaggttggtggtaggttcggtgggggaggtcgtcggtccgaggtccgtggggtacgtccgtgacgtaccgtccgttctaggtcgacgtacgtccttagtacgtctttaccaccgtttacgaggttacacgttaggttcgacgtacgtcgtaccgtaccggttccgggtacccgaccgtacgggtcccgacggaaggaccggggtagggtcgtagggtagggtcgggtacgtacgtttaagttactacgttacgtaaagtgttacggaaggtaacggtaaagttaggtaagttaacgtaacgttagtacggtacggtaacggttaaggttaccggtaagggtaacccggtaccttaaccgttacctaacccgttaattaccccgtaggaaacgtaccgtaaaccttaaacgtaaccgtaaacgtaaccgtaccgtacttaacggttacctaacgacggttaaacctaaggtaacgaaccgaaccggttagaaccggtagtaacggtcgtaacgggacgtaaccggtacggttcgttaaggtttaccgttaacgttacggttagtaaccgggtaaaaccgttccgtttaagttaaccccgtttaacgttacgtttaacggg

SEQ ID NO: 285113 - DNA, 692 bp, Homo sapiens
  misc_feature: GYAE6OF01AUZ17.35.59.F04.1.454.CMB.1.raw
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
tcagtacagatcgtcacgaccggtgctcgatttagtacacacacttagggagttgggggaaaaggccctgaggaaaacaaaccccagctgggaagcctgagaacacttagccttcatgagtgtccccaccatggcctggatgatgcttctcctcggactccttgcttatggatcgaggagtggattctacagactggtggtcgacccaggacgccatcgttctcgagtcgtccccgtggaggacagtccacnctctacttggtgtcgttgagtctcgtcggtctacgtagttccttactacgttacgttacctaacccccgngtaccgtacggtacccaaacgacccgaccccgacggtcccacgggccctcccggccgcaccgtcctacactcacacgaccaacgaaaccgtcccttccgtccttccgttcggttaccggggtccctgtaccgttccgtcttccgtcgttcggtcccttaccgtagtacctacgaaccctaaccgtacccggttcccctttccccttacccgtcccgttcggtccgggtccttaccgaacgtcgtacggacgtagtacggacgtacgttattacgtttacgtacctgcctcgtctactagtcgtacgagtacggctaccggtaccgttacggtttacgtacggttacgggacgggtaacgtacgtaacggg

SEQ ID NO: 285114 - DNA, 996 bp, Homo sapiens
  misc_feature: GYAE6OF01CBYTO.35.59.F04.1.454.CMB.1.raw
tcagtacagatcgtcacgaccggtgctcgatttagtacacacacttagggattggggagaggagcccagcactagaagtcggcggtgtttccattcggtgatcagcactgaacacagaggactcaccatggagtttgggctgagtcgttgggttttcctcggttgcttcgttttaaggaggttcgtccagtgtcgtaggtgcgtaggttggtagggtaggtcggtgggggaggtcggttggtccgaggccggttggggtacggtcccctaggacgtaccgttccgttccgttggtcgaccgtacggtcccttacgttaacggtacttttcccaacccgttttacgaacggttaacgttaccgttaagtacgggtcctaacggtccggtaaccgacccggtttccggggggtacccccaccgggtaaccgggtcccttacccgggaaggggggtaccggaaaacgggggggtccgttaacgggggtaacgggggtttgggggtccggggttaaccgtaacgggtttttaaacgtaagttaccggttaaaagttaggttaaacgggtaaggtttaaaggggtaaaaaccgtttaaacgggtttagggtaaaacgtttaaccgttaagggtaacggtaacccggtaaaggttaaacccggtttaaccgggggaagggttaacccggggtaaccggtttaaacttacccccgtaacccgttaaacgtttacccgggtaacccgaaacgtaaacggtaaaccccgttaaaattaacccgaaaacgggaacccttacgttacgttaaggtttaaccctacgggtaacgttaaacgaaacggtacgtaaacgtacggtacccgtagggaacgtaccgggtaaccgttagggaaaccggtaaacccggtccgggttattacgggttaacgttaagtttccgggtaagtaccgggtaacggaaacgtttaccgtacccggtttaaaccgttagtttaaacccggg

SEQ ID NO: 285115 - DNA, 763 bp, Homo sapiens
  misc_feature: GYAE6OF01BEQVY.35.59.F04.1.454.CMB.1.raw
  modified_base (181)..(181): a, c, t, g, unknown or other
  misc_feature (181)..(181): n is a, c, g, or t
  modified_base (705)..(705): a, c, t, g, unknown or other
  misc_feature (705)..(705): n is a, c, g, or t
tcagtacagatcgtcacgaccggtgctcgatttagtacacacacttagggattggggagaggagcccagcactagaagtcggcggtgtttccagttcggtgatcagcactgaacacagaggactcaccatggagtttgggctgagcgttgggttttcctcgtttgcttacgtttttaaagnggttgtaccaggtgtcagggtgctaggttggtggagttcgtggggggagcggtcggtccaggtccgtgggacggtcctgagctcctccgtgtcgcacgtcctactagtacttacacctttgagttacgtctagtgggactaagtcgaccgtacggttccggggtcccgaccgtagggccccttaccggaaggggtaccggaaacgggggtctacggggtacgggtggggttacgaccgttaaggtttaactacgtacgtaagttacgtagaacggttaggtaaaaggttacttacggtaagtaactagtggactaaggtacgtacggtacggacggtaccgtaacgtaccgtactactaccgacgtaacggtaacctaaccgtaaaccgttaaacgaaaccgtaaccgacgttacgtagtaacttacgtaagaaccgtaaagtaacggaactaacgtccggaaggacggtacgttacggacgggaagtaccggtaacggtcgttaaggttagttaacgttacgnggttaaacggtaaccggtaagaacccggtttacccggttaccgttaaggtttaaccgg

SEQ ID NO: 285116 - DNA, 775 bp, Homo sapiens
  misc_feature: GYAE6OF01E35N9.35.59.F04.1.454.CMB.1.raw
  modified_base (147)..(147): a, c, t, g, unknown or other
  misc_feature (147)..(147): n is a, c, g, or t
tcagtacagatcgtcacgaccggtgctcgatttagtacacacacttagggattgggggaaaggccctgaggaaaacaaaccccagctgggaagcctgagaacacttagccttcatgagtgtcccaccatggcctggatgatgcttcncctcggactccttgcttatggatcaggagtggattctcagactgtggtcgacccaggacgccagtcgttctctagtcgtccctggagggacagtcacactcacttgtggcttgagctcgtcggctctagtcctactacttacgttaccctaccgtagccgtacggtaccaacgacggtaacccccgaggtacccgacggtcctccggaccgtcccgaaccggtccctacgtaactaccctaaccgacggtaaccctaaaccgaaaacccgtaaccgttccgtaaccgttcccggtttccggttacgggggttccccttaggtaaccttcccggtacctttccgttacgtccgggccttacccgtacgttaccgttacggggaaaccctaaacgtccgtacgtacccctacctaaccgtacgttacccggacccgggggtacccgtacggaccgtaacgacgtacggtaagtaccggtaacttacgttacggtaacgtttaacgtacgttagtcggttacggtacgttaggttacgttacgggttagggtacggttcgggttccgtttacggttacggggttacggttaccggggtacgggtaaccgggtaaccggtaacgttaccggg

SEQ ID NO: 285117 - DNA, 658 bp, Homo sapiens
  misc_feature: GYAE6OF01CRUKE.35.59.F04.1.454.CMB.1.raw
  modified_base (353)..(353): a, c, t, g, unknown or other
  misc_feature (353)..(353): n is a, c, g, or t
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
  modified_base (557)..(557): a, c, t, g, unknown or other
  misc_feature (557)..(557): n is a, c, g, or t
  modified_base (565)..(565): a, c, t, g, unknown or other
  misc_feature (565)..(565): n is a, c, g, or t
tcagtacagatcgtcacgaccggtgctcgatttagtacacacacttagggattagggggaaaaggccctgaggaaaacaaaccccagctgggaagcctgagaacacttagccttcatgagtgtccccaccatggcctggatgatgcttctcctcggactccttgcttatggatcaggagtggtattctcagactggtggtcgaccgaggacgccatcgttctctagtcgtcccgtggaggacagtcacactctacgttgtgcttgacgtctcgtcggactctagttctactacgttacgttacctacccctagtcgtacggtaaccaaccgacgaccccgaggcccacggtcncccgcgccacgctcactcctacgacgaccaaacgaaacctacctcgtcccttcgtttccggacggggtttccctgtacgttccgtccttcgtcgtccgtctacctcgttacgtacgggaaacctaagcctacgccctccgacncgtccgggaccgggacccnggacgagtacgtcgatagtaactcgtaattaacttacggttntacgggtnttcggacttaggttaacttaggtggggttacttgggttcgttgggtttacgggttccgggtacggggacggggaaacgggccttgggacccgg

SEQ ID NO: 285118 - DNA, 893 bp, Homo sapiens
  misc_feature: GYAE6OF01BN5AY.35.59.F04.1.454.CMB.1.raw
  modified_base (184)..(184): a, c, t, g, unknown or other
  misc_feature (184)..(184): n is a, c, g, or t
  modified_base (208)..(208): a, c, t, g, unknown or other
  misc_feature (208)..(208): n is a, c, g, or t
tcagtacagatcgtcacgaccggtgctcgatttagtacacacacttagggattgggggaaaaggccctgaggaaaacaaaccccagctgggaagcctgagaacacttagccttcatgagtcgtcccaccatgcctggatgatgcttctcctcggactcttgcttatggatcaggagtggattcncagactgtggtcgacccgaggacnccattcgttctcgacgtcgtccccgtgggaggaccacgtacacaccttcgacgtttggtcggtcttaggacgtccgttcgttggccttacgtcgtttaccttaccttaacttaccgtttaaccctacccccgtaaggtccttacgggtaaacccaaccgaaccgtaacccccgagggacccgcgggtaccctcccggccgaaccgtaccgtacctaccgtaaccttacctaaccgacggtaacccctaaaccgaaaacccgtccgtacccgtcccgttttaccggtttcccgggtaccgggggttaccccgttggtcccggtttacccgttccgtttcccggtccgttccggtacccttacccgttaaccggttacccggtttaaacggggtaaacccgtaaaacccggttccgtaacccgggtacccccaccgtaaccccgttaaccgggcccccgggaaccccgggggtaccgacgggaccgtaaggtaacgtaagtacgttaacgtaaccttcgttaaacgtttacgtttaaccgttacgtttcgggtccgttacggttacttacggttaaaggtttcggggttacggttaacgggttcggttacggtttccggggtttagggggtttacccgggtacggggggtaacccggttacggggtaaccggtaccggttacccggg

SEQ ID NO: 285119 - DNA, 723 bp, Homo sapiens
  misc_feature: GYAE6OF01AUS1F.35.59.F04.1.454.CMB.1.raw
  modified_base (252)..(252): a, c, t, g, unknown or other
  misc_feature (252)..(252): n is a, c, g, or t
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtcgacccaggagccattccgttctcagtcgtcccccgtgggagggactagtccacactcacttggtggtcttgacgctcgtggcctnacgtctctacgtagttacctacccagctcggtaccaacaccgaccccgaggccgagcctccggcncacgctcactcgtacacgacaaccaaacncctcgccttcgttcggtccgggttccctgtactccgtcttcgtcgtcggcctacctacgttaccggttaggaaacctacgctacccgtccctacccaccgtaccgttaccgggaccccggggacccgtaggaccctaaggacgtacgtaagtacgtaacgttaccgtatttaacgtttaatttaacggtcgttggttacggttacgttaggtttaacgttagggttacggggttaaccgttgggttccgtttaggggttttccgggttacggggttacggggtaaccggggtaaccgggtaccgtaaggacccggtttaccggacccgtttaaccggttacggaacccggtaccgacccgggtaaccggttccccgg

SEQ ID NO: 285120 - DNA, 918 bp, Homo sapiens
  misc_feature: GYAE6OF01BRPAB.35.59.F04.1.454.CMB.1.raw
tcagtacagatcgtcacgaccggtgctcgatttagtacacacacttagggattgggggaaaaggccctgaggaaaacaaaccccagctgggaagcctgagaacacttagccttcatgagtcgtccccaccatggcctggatgatgcttctcctcggtactccttgcttatggatcgaggtagtggtacttctcagtacgtggtgggtcgacccgagggacgcctatccgttctcgagttccgtccccgtagggacggactacgtccactacctctacttggtcgcgttaggacgtccgttcgtcggtcctcgtacgttccttaccttaacgttaaccgtttacccctaacccccgtaggtccgtttaaccgttaaaccccaaaccgtacccggaaaccccccggagggacccccgtaacggggtccccgtacccggacccgtaccgacccggtcccttaacctaacgttaccccgtaaaccacggaacccaaaacccgaaacccgttacccgttccgttacccgttcccggtttacccgggtacccgggggttacccccttagggttaacccgttccgttcccttttccggtcccggttacccggtacccctttaccccggttaaccggtttaaccccgggtttaaaccggggaaaacccgtaaaccgggttccccgtaacccggttccccctaccccgtaacccggtacccggtaacccccggggacccggggtaccccgacgggtaccgtaacgtacggtacgtaacgtacgtaacgttcgttaacggtttaactttacgttacgttagtcgttagtccgttaaggttacggtaggttgggttaggtccggttggttcgggtttcggggttacgggttaccggggacgggtaaccggtccggtaacggttcccggg

SEQ ID NO: 285121 - DNA, 747 bp, Homo sapiens
  misc_feature: GYAE6OF01C48PU.35.59.F04.1.454.CMB.1.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (624)..(624): a, c, t, g, unknown or other
  misc_feature (624)..(624): n is a, c, g, or t
tcagtacagatcgtcacgaccggtgctcgatttagtacacacacttagggattgggggaaaaggccctgaggaaaacaaaccccagctgggaagcctgagaacacttagccttcatgagtcgtccccaccatcggcctggatgatgcttctcctcggacttccttgcttatggatcgaggagtggattctcagactggtggtcgacccgaggacncctattcgttctcgtagtccgtcccgtagggacgggacacgtcaacctacttcctacgttggnggtcgtgacgtctcgtcgctctagtctacttacttacgttacctaccccgagtaccgtacgtaacccaacgaccgaccccgacggccgacggcctcccgacgccaccgctcactctaacacgaccaaacaaactacgttccgtactttcccggttacggtccgggtcccttagtaccgttccgttccttcgttcgtaccggtcctaccgtacggttccggttaacgggaaaaccctaacgtccctacccgtccccgtaaccacccggtacggtacccggggacccggggtaccgacggaccgtagtacgtaacggtatacgtacttacgtacgttatttaacgttntacggttcggttagtcgttaaggtacggttagggtttacgggttaggttcggtttacgggtttggggtttacggggtttcgggtaccgggggtacgggtaaacggtcccggtaggtacccggg

SEQ ID NO: 285122 - DNA, 681 bp, Homo sapiens
  misc_feature: GYAE6OF01A9PWS.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtccacactcacttgtggcttgagctctggctcagtctctacttagttacctaccccagctcggtaccaaccacgaacccccgacgccgacggcgtcccgcgccacgctcactctacagaccacaaaccactcgacttccttcgcgggtcccctgactccgtcttccgtctcggcctcctacgttcccggttaacgggaaaactaacgccgttcccgaccctacaaccctaccgtaccgggacccggggaccccgacgggacacggtagtacgtagtagtaacgttctagttatttaacgttacgtgttacgtcggttcgttggttaacttagggtacgggttacggtccggttcgttacgggtttggggttccgggtttcccggggacgggtaacgggaccctaagggttcccgtaacggtaccccggttaacggtaacgttaccggaccggtacccggtaaaccggtcccgg

SEQ ID NO: 285123 - DNA, 684 bp, Homo sapiens
  misc_feature: GYAE6OF01D8L5W.35.59.F04.1.454.CMB.1.raw
  modified_base (141)..(141): a, c, t, g, unknown or other
  misc_feature (141)..(141): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (417)..(417): a, c, t, g, unknown or other
  misc_feature (417)..(417): n is a, c, g, or t
  modified_base (500)..(500): a, c, t, g, unknown or other
  misc_feature (500)..(500): n is a, c, g, or t
tcagtacagatcgtcacgaccggtgctcgatttagtacacacacttagggagttggggggggaagcctgagaacacttagccttcatgagtcgtccccaccatggcctggatgatgcttctcctcggactccttgcttagnggatcgaaggagtggacttctacagacgttggtggtacgacccgaggacgtcctattccgtttctcgtaggttcccgttccccggtaggggacgggacacgtaccacctacttactacgtttggtgtcttagaccgttctcgtcggtctagtaccgttctacttaacttacgttaccctaccgacgtacgtacgtaaccaacgaccgacccggcgaccgacgccnccgcgacncgccatactcacgacacaacactctcgctcgtcggtcgtcctntcgtctctctacgcgtcctaccgtacgtacggtacgaacactccgtaccctccgtactaccgtcgtaccggggcccgggaacncggtagtacgagtcggaatacgtactacttacgttaactttacgttagtggtagttcgagttacgtaggttggtacggttggtccgttgggttggttccgggtagggttcgggacggtaacggaccggttcgacggttaccggtaccggtcgtaccggacccgtaccgaccgtccgggtccccg

SEQ ID NO: 285124 - DNA, 816 bp, Homo sapiens
  misc_feature: GYAE6OF01DPN5H.35.59.F04.1.454.CMB.1.raw
tcagtacagatcgtcacgaccggtgctcgatttagtacacacacttagggagttgggggggaagcctgagaacacttagccttcatgagtgtccccaccatggcctggatgatgcttctcctcggactccttgcttatggatcgaggagtggattctcgagactgtggtcgaccgaggacgccagtcttctcgtacgtcgtcccgtggagggacagtccactacgtctacgttggtcggtcttgacgcttccgtggtctcgtacgttcgtacgttaacttacggttaacctaccccgtagtaccgttacggtaacccaacgtaccgaaccccgcggaccgacggcctaccggcgcaccgtcctctacgtacctacgacgtacaaccgtaaactaccgtcgtaccttcgtttaccggttcgggtacccgtagtaccgttccgtacttttcggtcctcgaccgttactaccgttaccggttaacggaacgtaaacgtccgtaccgacccttacaacccgtagtacccgggaacccggggacccaagggtacgtaacgagttaacgtaaacgtacgtaaacgtaccgttaagtttaactttaacgtttacgtgggttaccgttacggtacgtttaggttaaacggtttacggttaggggtttaccggtacggttacgtttcggggtttaggggtcccgggtttaagggggtccgggtaaaccgggtacggtaaccgttaccggttacccggttaacccgtaccgggtttaacccggacccgaaaccgggttaaccccggaaccccggttaccccccggg

SEQ ID NO: 285125 - DNA, 715 bp, Homo sapiens
  misc_feature: GYAE6OF01BT5W8.35.59.F04.1.454.CMB.1.raw
  modified_base (280)..(280): a, c, t, g, unknown or other
  misc_feature (280)..(280): n is a, c, g, or t
  modified_base (308)..(308): a, c, t, g, unknown or other
  misc_feature (308)..(308): n is a, c, g, or t
  modified_base (641)..(641): a, c, t, g, unknown or other
  misc_feature (641)..(641): n is a, c, g, or t
tcagtacagatcgtcacgaccggtgctcgatttagtacacacacttagggagttgggggggagaggagcccagcactagaagtcggcggtgtttccattcggtgatcagcactgaacacagaggactcaccatggagtttgggctgagcttgggttttcctcgttgcttcttttaaggaggttgtccaggtgtcgagggtgctaggtttggtggaggtcgtggggggagcggtggtccaggccgtgggacgtccctggagcctctccgtgtcgcagcctntagtacttccacctttgagtagcttagnggctagtagcctacgttcggggtccccgaccgacggggcctacccggaacgggacgtaaacgggggtccttggggaagggttcgggggtcggtacgttaaggtttaacgtaacttacgtaagttagtaggaacgttaaggggtaaaatagttacggaaagtttacgtaagtacggactaacgggtaacgttacgggtacgggtaacggggtaccgtaacgttaccaaccgtacgttccgtaaccgtaaggaacgtaacgtaacgttaaccgaaagtaaccacggtacttagtactcgtaagaacgtaagacgtaacgagtccgaagagtacgnggagaacggaccgcgtcgttgtagtactttagaggtacgaacgtaagtaccgttacgttaccgttaagttacgg

SEQ ID NO: 285126 - DNA, 818 bp, Homo sapiens
  misc_feature: GYAE6OF01BM5U5.35.59.F04.1.454.CMB.1.raw
  modified_base (158)..(158): a, c, t, g, unknown or other
  misc_feature (158)..(158): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (313)..(313): a, c, t, g, unknown or other
  misc_feature (313)..(313): n is a, c, g, or t
  modified_base (809)..(809): a, c, t, g, unknown or other
  misc_feature (809)..(809): n is a, c, g, or t
tcagtacagatcgtcacgaccggtgctcgatttagtacacacacttagggattgggggggagaggagcccagcactagaagtcggcggtgtttccattcggtgatcagcactgaacacagaggactcaccatggagtttgggctgagctgggtttccncgttgctcttttaagaggtgtccagtgtcaggtgcagcgtggtggagtcgtggggggagcgtggtccagccgtgggacgtcctgagactctcngtgagcgtctggnttcacttcttacaaataactagtcggctagtgacctacgtcggggtccnccgtaggtcctaccgagggaccgaacggggtaccgtggggtaggttcggggtttacggacgttaggttttggtgggttaggttactaggaggttagggtaaagttaaagtaagtaacttacgtaagtcgactaacggaccgtaaccgggttacgggaaacggggtcccgtaaccgttaccgtaaccccgtacgttacccgtaccgaaacggtaacggtaaaccgttaaaccgtttaccccgtaaaaacggttaaaccccgtttaccgttttttaccgttaaccccgtttaacggtaaacccgttaaaagtaccgtaaaacccggtaggttaaccccggttaaggaaaccgggtacgggtacccgggaaacgggtaaaccggaccgggtaacgtaacgttaacgtttaacgtttaccggttaggtaccggacggtaaacggacgggtacggtaacgggtacccggggaaccggtaccccccggtaaaccccggggtntaaccgggg

SEQ ID NO: 285127 - DNA, 791 bp, Homo sapiens
  misc_feature: GYAE6OF01BIV01.35.59.F04.1.454.CMB.1.raw
tcagtacagatcgtcacgaccggtgctcgatttagtacacacacttagggagttggggagaggagcccagcactagaagtcggcggtgtttccagttcggtgatcgagcactgaacacagaggactcacagtggacgtttgggctgagtcgttgggttttcctgttgtcttacgttttaaggaggttgtcctaaggtgtcgaggtgcgtaggttggtgggtacgttcggtggggggacggtccggttgggtccgacggtccggtacggggacggttcccgtaggaacgtccgtcttccgtgtcgcacggtctacgtagtcttacctccttagaagttgtacctagttcggactacgtcggacctggttccgggaccgccgttagacccgtacggacggtaggaaccgggtcggtagggtacggtgggtacgacgttaagttagtgttaaccgagttagtaggtaacgttaaggtaagttaagaggtacgttacgtacggacgtaacgtaaagtccggttaaacgggtacggtaacggttaccgaactttaccggaacctacgtaccgttaaaccggaacgtaaaggtaacctaaacccgttacgaaaccggaaagtccgtaccgttaagtacctacgtaacgaaaccgttaacacgggtaccaacgtaccggtagacggaagtccggtaaggacgaacgtacggttaccgttaggtaccgttaacgttgtaacccggtagtaaacccggtaaggttacccgttacccgggttaaacgttccgtttaaaggg

SEQ ID NO: 285128 - DNA, 943 bp, Homo sapiens
  misc_feature: GYAE6OF01AF76V.35.59.F04.1.454.CMB.1.raw
tcagtacagatcgtcacgaccggtgctcgatttagtacacacacttagggattggggggaagcctgagaacacttagccttcatgagtgtccccaccatggcctggatgatgcttctccttcggactccttgcttatggatcgaggagtggattctcagtactgtggtcgtacccgaggacgccattcgttcctctacggtcgttcccccgtaggggtacgggacctacggtacaccgtaccgtcctaacgtttcggtcgggtcctttaggacggtccgttcgtcgggtcctacgtacgttcttacttacctttaaccgttaccctaaccccgacgtaccgttaccgggtaacccaacgaacccggaacccccgacgggtaccccgacggttccccgtaccccggacggaccgtaccggtcctacgtaacttacctaaccgacgtaacccaacctaaacccgtacccgttacccggttaccttcccggttttacgggttaccccggggtttacccgttaccgtttaacgtccccggtttaccttttcccggttccggtttacggtccctttaccccgtttaacgtttccccggttaaaggggtaaacccttaacggtcccttacccgggttcccctaaccgtaacccccgttaaccgggttacccggggaccccggggtaacccgtacgggtaaccgttaaacgttaccggtagtaaaccggttacgtaacggtttccgttaaacgttacgtttaacccgttttggtttacggttacggttttcgtacgtttagtaaggtttacgggttaggttacgggttacggttacccggttttgggtcccggggtttaacggtccggggtacggtaacggtaccggtcgtccgttaaccgttccgggttacgacgggttaccgcccgttaaccggtcccgtacccccgg

SEQ ID NO: 285129 - DNA, 502 bp, Homo sapiens
  misc_feature: GYAE6OF02I9BGW.35.59.F04.1.454.CMB.1.raw
tcagtacagatcgtcacgaccggtgctcgatttagtacacacacttagggattggggggaagcctgagaacacttagccttcatgagtgttcccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagacccccaggccaggctccgcgcacgctcatctacagcacaaacactcgctcttctgggtccctgatcgcttctctggctccatcctggaacaagctgccctcaccatcacggggcccaggcagatgatgaatctgattattactgtgtgctgtatagtgggtagtggctcgttgggtgttcggcggagggaccgaagctgaccgtccgtaggtcaggcccaaggtccg

SEQ ID NO: 285130 - DNA, 511 bp, Homo sapiens
  misc_feature: GYAE6OF02HS2F5.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctctctgggtccctgatcgcttctctggctccatccttggaacaagctgccctcaccatcgacggggcccaggcagatgatgaatctagatttattactgtgtgctgtatagtgggtagtggctcgttgggtggttcgggcgggacgggaccaaggctggacccgtcgtaggtcacgcccgaggtcccg

SEQ ID NO: 285131 - DNA, 504 bp, Homo sapiens
  misc_feature: GYAE6OF02I1ADM.35.59.F04.1.454.CMB.1.raw
tcagtacagatcgtcacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctcttctgggtccctgatcgcttctctggctccatccttggaacaaagctgccctcaccatcacggggcccaggcagatgatgaatctgattattactgtgtgcttgtatagtgggtatggcttcgttgggtgttcgggcggtagggaccaagctgaccgtccgtaggtcacgcccaaggtccg

SEQ ID NO: 285132 - DNA, 516 bp, Homo sapiens
  misc_feature: GYAE6OF02GNKJJ.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctcttctgggtccctgatcgcttctctggctccatccttgggaacaagctgccctcaccatcgaccggggccaggcagatgatgaatctgattattactgtgtgtctgtatagtgggtagtggtctgttgggtgttcgggcggtagggaccaaggtcctggaccgttccgtaggtccacggtcccaaggtcccg

SEQ ID NO: 285133 - DNA, 570 bp, Homo sapiens
  misc_feature: GYAE6OF02JDI5F.35.59.F04.1.454.CMB.1.raw
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (430)..(430): a, c, t, g, unknown or other
  misc_feature (430)..(430): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcgtggtttcgcgtaggctctttaagaggtgtcagtgtcaggtgcagttggtggagtctgggggagcgtggtccagcctgggaggtccctgagactctcctgtgcagcctctagattcaccttcagtagctatggcaatgcatgggtccccagctcgagcgagggtctggngtgggngactagttatatcatatgagtaggtaagtagtagagtactatgactagtactaggtaggaacggtcctatccaacctatcctacgaagtacgactactaccaaagaaccncgactagtactacgtagaactaatacgaacgaacgtaccgtacgacgacgtacgtaggacggacgtacggtacggtaggttacggttaacgttaacgtacgtacggtaacggtaagtacgtacgtacgttaccgttaacg

SEQ ID NO: 285134 - DNA, 515 bp, Homo sapiens
  misc_feature: GYAE6OF02I4RZF.35.59.F04.1.454.CMB.1.raw
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgccacgctcatctacagcacaaacactcgctcttctggggtccctgactcgctttctctggctccatccttgggaacaagctcgccctcaccatccgaccggggcccaggcagatgatgaatctgattatactgtgtgctgtatgtggtagtggtcttgttgggtgttcgggcggtagggaccgagtccg

SEQ ID NO: 285135 - DNA, 506 bp, Homo sapiens
  misc_feature: GYAE6OF02HIRE8.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagacccccaggccaggctccgcgcacgctcatctacagcacaaacactcgctcttctgggtccctgatcgcttctctggctccatccttgggacaagctgccctcaccatcacggggcccaggcagatgatgaatctgattattactgtgtgctgtatatgggtagtggtctcgttgggtgttcgggcgggagggaccaagcgtgaccgtcgtaggtcacgcccgaggtcccg

SEQ ID NO: 285136 - DNA, 532 bp, Homo sapiens
  misc_feature: GYAE6OF02GYLQ4.35.59.F04.1.454.CMB.1.raw
  modified_base (321)..(321): a, c, t, g, unknown or other
  misc_feature (321)..(321): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagacccccaggccaggcctcccgcgcacgctcatctacagcacaaacnctcgctcttctcgggtccctgactcgcttctctggctccatccttgggaacaagctcgccctcaccatcgacggggcccaggcagatgatgaatctgtattattactgtgtgctgtatagttgggtagtggtcgttcgttgggtggtttcgggcgggtacgggaccgaaggtcgtcgacccgttcgtacggtcgacgtacccgaggtcccg

SEQ ID NO: 285137 - DNA, 498 bp, Homo sapiens
  misc_feature: GYAE6OF02HDXC5.35.59.F04.1.454.CMB.1.raw
  modified_base (398)..(398): a, c, t, g, unknown or other
  misc_feature (398)..(398): n is a, c, g, or t
tcagtacagatcgtcacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctcttctcgggtccctgatcgcttctctgctccatcctggacaagctgccctcaccatcgacggggcccaggcagangatgaatctgtattattactgtgtgctgtatagtggtagtggctgttgggtgttcggcggagggacgaagctgaccgtcctaggcacgcccgaaggtccg

SEQ ID NO: 285138 - DNA, 498 bp, Homo sapiens
  misc_feature: GYAE6OF02FKVTU.35.59.F04.1.454.CMB.1.raw
  modified_base (420)..(420): a, c, t, g, unknown or other
  misc_feature (420)..(420): n is a, c, g, or t
tcagtacagatcgtcacgaccggtgctcgatttagtacacacacttagggattgggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggcccaggctccgcgcacgctcatctacagcacaaacactcgctcttctgggtccctgatcgcttctctggctccatccttggaacaagctgcctcaccatcacggggcccaggcagatgatgaatctgattattacttgngttgctgtattagtggttagtggcttctttgggtgttcggcggaggaccaagctgaccgtctaggtcacgcccaaggc

SEQ ID NO: 285139 - DNA, 534 bp, Homo sapiens
  misc_feature: GYAE6OF02G529R.35.59.F04.1.454.CMB.1.raw
  modified_base (412)..(412): a, c, t, g, unknown or other
  misc_feature (412)..(412): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtcgtgggggaggcgtggtccagcctgggaggtccctgagactctcctgtgcagcctctagattcaccttcagtagctatggcatgcacgtggggtcccgccaggcctccgaggcgaagggggctgggaggtggggtggctaggttatagtcatatgatgggaaagtatgagtactatgcagactacgtgaagggcgatcacatctcaganacaattaccaagacacgctagtatcgtgacaaatcgaacacgcctagagagctagaggacgacggctaggttagttaagttacgtagtagacggaaagtacttacggttacccgtattaacg

SEQ ID NO: 285140 - DNA, 521 bp, Homo sapiens
  misc_feature: GYAE6OF02ICELO.35.59.F04.1.454.CMB.1.raw
  modified_base (320)..(320): a, c, t, g, unknown or other
  misc_feature (320)..(320): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacacgaccccaggccaggctcccgcgcacgctcatcacagcaacaaacnctcgctcttcgtcgggtccctgactcgctttctcgtcgcctccatcccgttagggaaccaagctcgccctcaccactccgacggggcccaggcagatgatgatctagtattattactgtgtgtctgtattagtggtagtgtcgttgttgggtggtcggcggaggacgagcgtcgaccgtcgtacggtcacgccgagtcccg

SEQ ID NO: 285141 - DNA, 523 bp, Homo sapiens
  misc_feature: GYAE6OF02FRCXH.35.59.F04.1.454.CMB.1.raw
  modified_base (320)..(320): a, c, t, g, unknown or other
  misc_feature (320)..(320): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttacctaccccagctggtaccaacagaccccaggccaggctccgcgcacgctcatctacagcaacaaacnctcgctcttctgggtccctgatcgcttctctgctccatccgttgggaacaagctcgccctcaccatcgaccggggcccaggcagatgatgaatctagtatttattactgtgtgctgtatagtggtagtggcttcgttgggtgttcgggcgggagggaccgaagtcgtggtaccgtccgtaaggtcacgtacccgaaggtcccg

SEQ ID NO: 285142 - DNA, 505 bp, Homo sapiens
  misc_feature: GYAE6OF02IKI45.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggcctccgcgcacgctcatctacagcaacaaacactcgcttcttccgtcgggtccctgactcgcttctctgctccatcctggaacaagctcgccctcaccactccgacggggcccaggcagatgatgatctgattatactgtgtgctgtatgtgggtatgcttgtgggtgttcgggcggacggacagcgtcgaccgtcgtggtccacgcccgaggtccg

SEQ ID NO: 285143 - DNA, 520 bp, Homo sapiens
  misc_feature: GYAE6OF02F32O1.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttacctaccccagctggtaccaacacgaccccaggccaggcctccgcgcacgctcatctacagcacaaacactcgctcttctgggtccctgatcgcttctctgctccatcctggaacaagctcgccctcaccatccgaccggggcccaggcagatgatgaatctgtattattactgtgtgctgtatagtgggtagtggtcttgttgggttgtcgggtcgggacgggaccgaagcgtagacccgtcgtacggtcacggcccgaaggtcccg

SEQ ID NO: 285144 - DNA, 539 bp, Homo sapiens
  misc_feature: GYAE6OF02I20BU.35.59.F04.1.454.CMB.1.raw
  modified_base (320)..(320): a, c, t, g, unknown or other
  misc_feature (320)..(320): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaaccaacacgaccccaggccaggctccgcgcacgctcatctacagcacaaacnctcgctctctgggtccctgactcgcttctctgctccatccttaggaacaaagctcgccctcaccatccgacggggccaggcagatgatagaatctagtatttatacgtgtgtgtctgtattagtgggttagtggtcgttgttgggttggttcgggcgggtacgggaccgtaggtccgtcggtacccggttccgtaggtcgacggacccgaaggtcccgg

SEQ ID NO: 285145 - DNA, 509 bp, Homo sapiens
  misc_feature: GYAE6OF02FHCIO.35.59.F04.1.454.CMB.1.raw
tcagtacagatcgtcacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagacccccaggccaggctccgcgcacgctcatctacagcacaaacactcgctcttctgggtccctgatcgcttctctggctccatccttgggaacaagctgccctcaccatcgacggggcccaggcagactgatgaatctgtattattactgtgtgctgtattagtggtagtgctcgttgggtgttcggcggaggaccaagcgtggacccgtccgtaggtcacggcccaaggtcccg

SEQ ID NO: 285146 - DNA, 533 bp, Homo sapiens
  misc_feature: GYAE6OF02IP8KA.35.59.F04.1.454.CMB.1.raw
  modified_base (263)..(263): a, c, t, g, unknown or other
  misc_feature (263)..(263): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatgggagtttgggctgagctgggtttcctcgttgctcttttaagaggtgtccagtgtcaggtgcagttggtggagtcgtgggggaggcgtggtccaggccgtgggaggtccctgacgacgtctcctgtgcagcctntagattcaccttcagtagctatggcatgcacgtgggtcccgcaggcctccgaggcgaaggggctgggagtgggngcagttantcatatgatggaaatatgagtactatgacagtactagtgaacggctatcacatcacaganacaattacaagacacgctagtatcganacaaatagaacacgtacctagagagtcgtagacgacgacgggtctggtagttaactacgtaggtacgacggtaaagtacgttaccgttaccgttattacgg

SEQ ID NO: 285147 - DNA, 606 bp, Homo sapiens
  misc_feature: GYAE6OF02GH4VE.35.59.F04.1.454.CMB.1.raw
  modified_base (297)..(297): a, c, t, g, unknown or other
  misc_feature (297)..(297): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtcgtgggggagcgtggtccagcctgggaggtccctgagactctcctgtgcagcctctagattcaccttcagtagctatggcatgcactgggtccnccaggctccgaggcaaggggctggagtgggtgctagttatatcatatgagtaggaagtatggaagtactagtgacgtaagtactacggtaggaacgggccgtaattaccgaacctattaccgtaccgaaggtaacgacctaaactttacccgaaacgtaaaccacggtaccttaggttaactaccgtacgaactaaactacgaaactacgaccgttagaagacgacgtaggacggacacgggtcttaggttagttaacttacgtggtacgacggaaacgtcttaccggttaacccgttagtttaaccgg

SEQ ID NO: 285148 - DNA, 568 bp, Homo sapiens
  misc_feature: GYAE6OF02IUW62.35.59.F04.1.454.CMB.1.raw
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctacttagttacctaccccagcctggtaccaacacgaccccaggccaggctccgcgcacgctcatctacngcacaaacnctcgcttctcgtcgggtccctgactcgtctttctctcggcctccgtattccgttaggggaaacaaacgtcctacgcccctacaccacgtccggaccgggggcccagggcagagtgatagtaatcgtagtatttattagtgttgtgtctagttatagttgggtagtggtcttcggttcggggttggttccgggcgggtacgggactagcgtacggtaccgtcgtacggcgacggaccctaggtcccg

SEQ ID NO: 285149 - DNA, 629 bp, Homo sapiens
  misc_feature: GYAE6OF02G32EA.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtggcttgagctctggctcagtctctactagttacctacccagctggtaccaacacgaccccaggccaggcctccgcgcacgctcatctacagaccaacaaacactcgctcttcgtcgggtccctgtactcgtctttctcgtcggctcctacttccgtagggaactaagcctcgccctacaccgactccggaccgggggtccacggacaagtagtagatagtaatctagtaactttacttacgttgtggttcgtcgttagttagttaggttaggggttagtcgggtcgttcggtttggggttcggttaccggggtacgggtaaccggggaaccggtaacggtacccggttacggtacccggttaccggttaccgggtacccgtacggtaccccggtaaccggtccccgg

SEQ ID NO: 285150 - DNA, 651 bp, Homo sapiens
  misc_feature: GYAE6OF02J11PS.35.59.F04.1.454.CMB.1.raw
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
tcagtacagatcgtcacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggtcttgagtctcgtggctcgacgtctctacttacgttacctaccccgagtccgtacggtaaccaaccgaccggaacccccgaggcccacggcctcccggcgccacgctccactcctaacncgccaaacaaaccnctcgcctcgttcgtcgggtccctgacttcgtccttctaccgtgtacctccaccgttccgtacgggaaaccaacgtccgtctacccctcaaccccgtacgtcccgggaccgggtacccgaggacacggtagccgttaacgtaacgtacgtaccgtagttactttaacttaccgttggttgtcgtcgttagttaagttcggttaagggtcgttcgtcgttccggttgggtcgttcggggacggtacggactacggtcgaggtacccgtcggtacgtccgacgtcccgtacggtccccg

SEQ ID NO: 285151 - DNA, 536 bp, Homo sapiens
  misc_feature: GYAE6OF02F5GTC.35.59.F04.1.454.CMB.1.raw
  modified_base (221)..(221): a, c, t, g, unknown or other
  misc_feature (221)..(221): n is a, c, g, or t
  modified_base (312)..(312): a, c, t, g, unknown or other
  misc_feature (312)..(312): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgnggcttgagctctggctcagtctctactagttacctaccccagctggtaccaacacgaccccaggccaggcctccgcgcacgctcatctacngcaacaaacactcgctcttcgtcgggtccctgatcgcttctcgtgctcatccttagggaacaagctcgaccctcaccactccgacgggggcccaggcagtatgatcgaatctagtattattactgtgtgtctgtatagtggtagtggcttgttgggtgttcgggcggagggtaccgaagtcgtacggtaccgttccggtaggtccgacggtcccgtaggtcccg

SEQ ID NO: 285152 - DNA, 590 bp, Homo sapiens
  misc_feature: GYAE6OF02HUHO8.35.59.F04.1.454.CMB.1.raw
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttacctaccccagctggtaccaacacgaccccaggccaggcctccgcgcacgctcatcacagcaacaacactcgctcttcgtcgggtccctgactcgctttctctggtcctcctacttccgttagggaaaccaacgcctcgcccctacacctacgtccggaccgggggcccacggcagatgatgaacttctagtatttattacgtgtgtgtcgttagttaacgttaggttgggtagttcgggtcgtttgggtttcggggttcggttcggggacggtaacgggaaccaggtccgttacggacccgttcggtaacggtaccgaccggtacccgaggtccccg

SEQ ID NO: 285153 - DNA, 592 bp, Homo sapiens
  misc_feature: GYAE6OF02H1MF8.35.59.F04.1.454.CMB.1.raw
  modified_base (260)..(260): a, c, t, g, unknown or other
  misc_feature (260)..(260): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctcttttaagaggtgtccagtgtcaggtgcagttggtggagtcgtgggggaggcgtggtccagcctgggacggtccctgagactctcctgtgcagcctntagattcaccttcaatatgtatagcatgacctgggtcccgccaggtctccgtgggaacggggctgggaggttgggtctcgtatctagttggaagttagtggttgttttatactattattatggagacggtcgggtggggggtccagtttcgaaccagtacctcctagacgacaacgaccaacgaacgcagttactttcgtagactaaatgaacacgcgtagcgaagacgaacggacgacggtctgtgttattacgtgtgacggagtaggtaggagggcgtacgggtccggttcccccggggttatacgggtaccgttcggtcgggtaaccgg

SEQ ID NO: 285154 - DNA, 583 bp, Homo sapiens
  misc_feature: GYAE6OF02G90PW.35.59.F04.1.454.CMB.1.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagttggtggagtcgtgggggaggcgtggtccagccgtgggacggtccctggagactctcctgtgcagcctctagacttccaccttcagtagctatggcatgcacgtggggtcccnccgaggcctccgaggcgaaggggctgggagtgggtgctagttantcatatgatggaatatgaatactangacagtacgtaggtaggaacgggccgtattcacctattaccgtacgaagaacgaactaacttaccgaaacgtaaccaccgtacttagtactcgtagaactaaagtacgaaacgacgtaccgtaggagacgcgtaggacggtaaccgaggtctggttacgttaacgttacgtggtacgacgtaacggaaccgtaggtaggagtaacgg

SEQ ID NO: 285155 - DNA, 568 bp, Homo sapiens
  misc_feature: GYAE6OF02GGQSN.35.59.F04.1.454.CMB.1.raw
  modified_base (228)..(228): a, c, t, g, unknown or other
  misc_feature (228)..(228): n is a, c, g, or t
  modified_base (389)..(389): a, c, t, g, unknown or other
  misc_feature (389)..(389): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgngctctggctcagtctctactagttacctaccccagctcggtaccaaccacgaccccaggccaggcctccgcgcacgctcactctacagcaacaaacactcgctcttcgtcgggtccctgactcgcttctctcggcctccattccgtgggaaacaacgctcnccctacaccacgtcggacgggtcccgaggccagatgatagtaacttcgtagtatttattacgtgttgttgcttagttagtagttgggtacgttggtcgttgtttggggtcgttcgggcgggaaggaccgtaaggtcgtacgtaccgtaccggttacgtacgacggtaccgaggtccccg

SEQ ID NO: 285156 - DNA, 600 bp, Homo sapiens
  misc_feature: GYAE6OF02FNYY7.35.59.F04.1.454.CMB.1.raw
  modified_base (164)..(164): a, c, t, g, unknown or other
  misc_feature (164)..(164): n is a, c, g, or t
  modified_base (173)..(173): a, c, t, g, unknown or other
  misc_feature (173)..(173): n is a, c, g, or t
  modified_base (185)..(185): a, c, t, g, unknown or other
  misc_feature (185)..(185): n is a, c, g, or t
  modified_base (190)..(190): a, c, t, g, unknown or other
  misc_feature (190)..(190): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
tcagtacagatcgtcacgaccggtgctcgatttagtacacacacttagggattgggggggagaggagcccagcactagaagtcggcggtgtttccattcggtgatcagcactgaacacagaggactcaccatggagtttgggctgagcggcgttcggctaggcncttagtagngcagtgcagtgnagtgngagtcngggagcgngtcagctggngcctgagtacgtctctgngacgcgtcgtcgtagatcgactntataataactatcgngtagtgtcgtcgtcggtcgtcgacgcgcgacggacgacggacgtaggtagtggtggtgtagtgtgtaggtagtagtagtaaggtaagtagtagtaagtagtagtacgagacgacgacgtacgacgtacgtacgtactacgtactcacgtacgacgtaacgtaacgtaacgtaacgtaacgttacgttacgttacgtacgtaacgtaactaacgtacgtacgtacgtacgaacgaacgacggaacggaacgacggtacgtacgtacgttacgtacgtaggtacggaacgtacgagtaggtacggtacggtacggaccgtaccgtacgtacg

SEQ ID NO: 285157 - DNA, 636 bp, Homo sapiens
  misc_feature: GYAE6OF02JK781.35.59.F04.1.454.CMB.1.raw
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccgaggacgccatcgttctcagtgtcccctgggacggacagtccacactcacttgtggcttgagctcgtggctctgtctctactagtttacctaccccagtctacggtacctaacgacgaccccaggccagggcctcccggagtcccacgtcctacgactcgtacagccaacaaacacctcgcttctacgtcgggtccctgactcgtcctttcgtactcggtcctcctacttcccgttagggaaacaaacggccttaccgccctacctacccgtacgtcccggaacccggggcccacggcagacgtgacgtgaattccgttagtattacgttacgtgttcgtcggtacttaggttagttacggtagggttacggtggttccgttgggtttgggttacgggttccggggacggttacggggacccggtaagtccggg

SEQ ID NO: 285158 - DNA, 765 bp, Homo sapiens
  misc_feature: GYAE6OF02ILSYK.35.59.F04.1.454.CMB.1.raw
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcttgggttttcctcgttgcttcttttaagaggttgtccagtgtcaggtgcagttgggtggagtcgtgggggagcgtggtccagctgggagtccctgacgctctctgtgcagcctctggacttcacctttcagtacgtcacgtggatgcctacgtcgggtcccgtagtaacgggttccgggggaagggcttgggtggttgggttttcacgttattacggagtgagttagggactagaccaactaacgtccgtaacggcggtaccttaccggtaggaaacggggcccgtaactttccccgaacccccccgtcgaaacggacgtaaacccgaaaccggacccgtaaaacggaaaccctaaccgtaaaccttaacttaaccttacccgtaacgaaaccgtaaaacgtttacgaaaccgacgttacctagggaacgtaccggacccggaaggaccccgtaaaggtccttacgttaccgtttaaagttaccgttaggtacgaccggtaaaggggtacgggttaccggtaaccgttaaacctaacgttaccgtaagtttttaccgggtttttacgtaaccgtttccggtaacccgggtacgggggtaaccccgttaaaggggaacccg

SEQ ID NO: 285159 - DNA, 568 bp, Homo sapiens
  misc_feature: GYAE6OF02I3HMQ.35.59.F04.1.454.CMB.1.raw
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (352)..(352): a, c, t, g, unknown or other
  misc_feature (352)..(352): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgnggcttganctctggctcagtctctactagttactacccagtctggtaccaacacgaccccagccaggctccgcgcacgctcagtctacagacacaaacnctacgctctcgtcggtcctgatcgcttcntcgctcnctctaggacaacgctcgccncacagtaccgacgggcccagtcagacgtcgtatacgactcgtatactttaacgtttcgtagtacgttcgtagttaggtattaaggttcgggttaagttcggtcttcggtttacgggggttcgtttacgggggacgggttacggggtaaccagggttcccg

SEQ ID NO: 285160 - DNA, 850 bp, Homo sapiens
  misc_feature: GYAE6OF02IUP5A.35.59.F04.1.454.CMB.1.raw
  modified_base (332)..(332): a, c, t, g, unknown or other
  misc_feature (332)..(332): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaggttggtggagtcggtggggggaggcggtcgggtccaggccgtggggacggtcccctggacgtacctcctccgtgtcgcacgcctctagtacttccaccttcgagtacgcttatggctatgacctacgtcggggtcccnccggacgggcctcccggaagggaccggtaacggggggtcttagggggtacgggttggggggtacgggtaccgttaaggttttaacgtagttaccgtaaattaaacggttgggtaaacggttaggggtaaaaagtttacggtaaggtaaagtttaaccgttagttacggaccgtaaggtaaccgttaacggggtacgggtaacggggtacccgttaacgtttacccgaaccgtaccgttaccgtaacccgtaaggtaaccgtaaaccgttaaacctttaacccgaaaaccggtaaacccgtaaccgtaccgttaacgttaaccgttaccgttaacgtaaccgtaaaacttaaccggaaacgtaaccggttaccgtagggaaacgtcgggtaccgttacgggacgggtaaccggacgggttaaccgttcggttaacgttaaccgtttacggttacggtaacggtaaaccggtaaacggttaccggtttaacccggtttaaccggtttacttttaaccggg

SEQ ID NO: 285161 - DNA, 674 bp, Homo sapiens
  misc_feature: GYAE6OF02GMKCU.35.59.F04.1.454.CMB.1.raw
  modified_base (326)..(326): a, c, t, g, unknown or other
  misc_feature (326)..(326): n is a, c, g, or t
tcagtacagatcgtcacgaccggtgctcgatttagtacacacacttagggattgggggggaagcctgagaacacttagccttcatgagtgtctccaccatggcctggatgatgcttctcctcggactccttgcttatggatcaggagtggattctcagactgtggtgacccaggagccatcgttctcagtcgtcccctgggagggacagtcacactcacttgtggcttgagctctggctcagtctctactagttacctacccagctggtaccaacacgaccccaggccaggctccgcgcacgctcatctacagcaacaaacactcnctcttccgtggggtccctgatccgtctttctaccgtggcctccacttccggttaggggaaacctaaacggtcctacggtacccctacaacccctaggtacccggaacccggggggcccaagggaccaacggtagttacgaagttacgaacgttcgtagttaattttaactttaacgttggttacggttcgtacgttaggttaaattaggttacggggttaagttcggttccggttttcgggtttcggggttcgggtttacggggaccgggggttaacgggaacccgtaacggtccgttaccggtacccggttaccggtacgggttacccgaccggacccgtaaccggg

SEQ ID NO: 285162 - DNA, 720 bp, Homo sapiens
  misc_feature: GYAE6OF02HJ8S0.35.59.F04.1.454.CMB.1.raw
  modified_base (260)..(260): a, c, t, g, unknown or other
  misc_feature (260)..(260): n is a, c, g, or t
  modified_base (359)..(359): a, c, t, g, unknown or other
  misc_feature (359)..(359): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttactcttttaagaggtgtccagtgtcaggtgcagttggtggagtctgggggagcgtggtccagccgtggggacgtccctggagactctcctgtgcagcctntagattccaccttcagtagctagtcggcatcgcacgttgggtcccgccgaggcctaccgaggcgaacggggtctaggggagtggggtgactaggtttanagtctaagtatggaagttaggaaagttaagtggaacggttaactagtcggactaagtacgttacggtacgggaacgggtcctacttacccgaacctacttaccgtccgaaagaacgtaacccgtaaacttaacccgaaacgtaaacccgtacgtaccgttagtactaccgtacgaaacgtaaacgtacggtaaacccgacggtacccgtaagggaacgtacggtaccggtaacgggtaacgggacccgtacgggttaccgtttagggttaacttaacggtttaacgtacgggtaacggtaacgttaaacggtaccgtttaccccgggtttaaaccgtttaacgtttaaccggtttaacggg

SEQ ID NO: 285163 - DNA, 774 bp, Homo sapiens
  misc_feature: GYAE6OF02I3FWU.35.59.F04.1.454.CMB.1.raw
  modified_base (192)..(192): a, c, t, g, unknown or other
  misc_feature (192)..(192): n is a, c, g, or t
tcagtacagatcgtcacgaccggtgctcgatttagtacacacacttagggattgggggggaagcctgagaacacttagccttcatgagtgtcccccaccatggcctggatgatgccttctcctcggactccttgcttatggatcaggagtggattctcagactgtggtgacccgaggagcctaatccgtttntcacgtcgtccccgtgggacgggacgtacgtacacacctcaccgttggtggtcttcggagtccttccgttggcctcgagttcctaccttaactaacgttacctaacccctagaccgttacgtaaaccaaccaaccgaacccccgacggaccgacgggccctcccggaccgccgaccggtcctacctaactaccgtaaccgaaacggaaccaaaaccctaaaacctaccgtaccgttaccgtttaccgttaccggttcggggtcccctacgtaaccgttcctccttttaccgtcgtggtacccttacctacgttacccggttaagggaaacctaaacggcctaccgcccctactaccgaacgtccgggaccgggtaccgacggtaccgaagacgtgttaagtataacgttctaacttagttaaactttgtacggttagcggtatttagttaagttaacgggttgggttaggtcggtcggtttcggttacgggtttggtacggggaccgggtaacggtaaccgtacggtacgttaccgggtaaccgtccggttaaggacccggtacgtacccggacggtccccg

SEQ ID NO: 285164 - DNA, 537 bp, Homo sapiens
  misc_feature: GYAE6OF02JG7IG.35.59.F04.1.454.CMB.1.raw
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (335)..(335): a, c, t, g, unknown or other
  misc_feature (335)..(335): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (407)..(407): a, c, t, g, unknown or other
  misc_feature (407)..(407): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggtttcctcgttgctcttttaagaggtgtccagtgtcaggtgcagttggtggagtctgggggaggcgtggtccagcctgggaggtccctgagactctcctgtgcagcctntagattcaccttcagtagctatggcatgcactgggtccncaggcctccaggcaagggctgggagtgggtgctagttantcatatgagtggaagtatgatactatgacagactagtgaagggccatcactntcncaganactaattcaaanacacgctagtatctagataaatgaaacacgcctaggaacgagcgtaggagtaaccgcgggtcttacggttagttaacttacgtcggtacgaacggtaaacgtactacccggtttacccttaagttaacgg

SEQ ID NO: 285165 - DNA, 802 bp, Homo sapiens
  misc_feature: GYAE6OF02H213H.35.59.F04.1.454.CMB.1.raw
  modified_base (258)..(258): a, c, t, g, unknown or other
  misc_feature (258)..(258): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagttggtggagtcgtgggggagcgtggtccagccgtgggacggtccctgagctctccgtgtcgcncgccttcgtggactctaccgttggagttacgctagtcggctaagtggacgtcgtcggggtcccgaccgagggtcccgtaccggaaggggaccggggtacgtaggggtacgggttcgggggttccctttcggtttacgttaaggtttacggtggttaccgttaggggttcgggtttacgggttccttaacggtaaccgttaacgttaacccggttaccggtaccgtaacggttccctttcggttacgggttaaccggggtaaaccgggggttcccggtttaccgttacccggttacccgtacccggaacggtaacggtaacctaaacgttaacccgaaacgtaaacccgtaacccgttagtttacgtcgtacgaactaaacgtacggaactaccgacgtacggacgtaacggaccgaaccgaccgacggtaccttaagttaacgttacgtacggttacgaacggtaacggtttcgggaaccgttaaggtacgggggttacggtacggttaccgtttacggtacgttaccggttcgggtcccgggg

SEQ ID NO: 285166 - DNA, 704 bp, Homo sapiens
  misc_feature: GYAE6OF02JM4EV.35.59.F04.1.454.CMB.1.raw
  modified_base (223)..(223): a, c, t, g, unknown or other
  misc_feature (223)..(223): n is a, c, g, or t
  modified_base (416)..(416): a, c, t, g, unknown or other
  misc_feature (416)..(416): n is a, c, g, or t
tcagtacagatcgtcacgaccggtgctcgatttagtacacacacttaggattgggggaaggccgtgagaacacttagccttcatgagtgtcccaccactggcctggatgatgcttctcctcggactccttgcttatggatcaggagtggattctcagactgtggtgacccaggagccatcgttctcagtcgtcccctggacgggtacagtcacactcacttgngcttgagctctggctcagtctcttactagttacctaccccgagtcttcggtaacccaacgaccgaacccccgacggccaacggtccttcccgggcgtaccaccggccttacaacttaccgtaaccgacgcctaacgaaaaacctccgtccgcttaccttccggtcggggtccctagtacgtcgtaccttttcnccgtggtcctcctaacgtttcccggttaagggaaacctaaccgtcgtccgaccccgttcaaccccgtacgtcccgggaccgggggtaccctacgggaccgtaacgacggttcgaagtacggaacttccgtagttaacttaacgggtttactcggtcgtacgtcttaacggtattaggtcgggttaaggtccggttacgttggtttggggttacggccgggttagggaacgggttaacacggttcgtacgtacccggtcgttacggaccgacgtaccgaacgttcccgg

SEQ ID NO: 285167 - DNA, 555 bp, Homo sapiens
  misc_feature: GYAE6OF02F4E3T.35.59.F04.1.454.CMB.1.raw
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
  modified_base (491)..(491): a, c, t, g, unknown or other
  misc_feature (491)..(491): n is a, c, g, or t
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacaggtcacactcacttgtggcttgagctctggctcagtctctactagttactaccccagctggaccaacacgaccccaggccaggctccgcgcacgcncatctacngcacaacactcgctcttctcggggtccctgactcgcctttctcgtcggcctcctactccgttgggaaacaaacgtcctacgccctacacctactccgaccggggcccacggcacgactgagtacgactctcgtattattactgtgtcgtntcgtatagtgggttagtcgtcgttagttcgggttggttcgggagggtacgggtacgaaggtcgg

SEQ ID NO: 285168 - DNA, 677 bp, Homo sapiens
  misc_feature: GYAE6OF02FN0L9.35.59.F04.1.454.CMB.1.raw
  modified_base (666)..(666): a, c, t, g, unknown or other
  misc_feature (666)..(666): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagttggtggagtcgtggggggaggcggtggtccagccgtgggcgtccctggagactctcctgtgaagcgtctggattcatcttcaataactatggcatgccacgtcgggtcccgccgaggcctaccgaggacgaagggctaggggagtcggttggctaggttgtggtggtatgagtaggaagttaatagaattactatgacgtaacggaccgtaccgggtaggaaccggggacctaagtttacccgaacctacgttcccgtaccgaagtacgtaaacctaacgtaccaaacggtaacttaccgtttttacgtcccgtaagtaacctaaacgttaacgaaaccacggttacccgtaggaaaccggaccggtaccggaaggtaaccgaaccgggaactaagttacttagttacgtaggtacgaacgaaggtaacggcgtagggtaccgggtaaccggacccccgtaacccgggtanacggtaaccgg

SEQ ID NO: 285169 - DNA, 733 bp, Homo sapiens
  misc_feature: GYAE6OF02JG4PL.35.59.F04.1.454.CMB.1.raw
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtggcttgagctctggctcagttctctacttagttacctaccccagctggtaccaacacgaccccaggccaggctccgcncacgctcatctacngaccacaaacactccgctccttcgtcgggtccctgactccgtctttcctctggtacctcctacgttcccgttaggggaaacctaaacggtcctacggtccccctacgaccccgtaacgttcccgggaaacccggggggcccctaacgggaccgaacgtaaccgttaggaacgtttaggtaaaccgttccgttagttaaacgtttttacgttttaaaccgttgggtttacggttacgttacgtttaaggttaaggtttaacgggttaggggggttaacggttcgggttaccgttttcgggtttcggggggttacggttccgggggtaacggggttaacgggtaacccgtaaacggtccgttaccgggtaccccggttccggttaccgggtacccgaccggtaccccgaaggttcccccgg

SEQ ID NO: 285170 - DNA, 850 bp, Homo sapiens
  misc_feature: GYAE6OF02GS2DT.35.59.F04.1.454.CMB.1.raw
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcgagtcgtcccctggaggacagtcacactcacgttgtgcgttgagctctcggctcgacgttctacttacgtacgttacctaccccagtccgtacgggttaacccaaacgtacgaacccccgacgggaccgacgggcccgtcccggccggaccaccggtccttacctaactcctaaccgaacgtacccgaaaacctaaaacctccttacccgtcccttccgtttaccgggttccggggttaccccgtggtacccttcccggtcccttttccgtttcccggtccgttacccgttcccgttaaccgttttaccccgggtttaacggggtaaaaccgtaaaccgggtacccgttaccccgggtaccccctacccgtaaccccgtaccggtaccccggggaccccggggtacccccggacgggtaccgaacggtacgtacggtacgttacggtaaaccgttcgttaacgttaacgttttaacgtttacggttacgttgggttcgttacgttaggtttacggtttaacgggttggggtttaacggttcggttaccggtttacggggttttcgggggtttccggggtttaccgggggaaccgggggtaccgggtaaccggtaacccggttaaccccgggg

SEQ ID NO: 285171 - DNA, 727 bp, Homo sapiens
  misc_feature: GYAE6OF02JZ9CE.35.59.F04.1.454.CMB.1.raw
  modified_base (325)..(325): a, c, t, g, unknown or other
  misc_feature (325)..(325): n is a, c, g, or t
  modified_base (468)..(468): a, c, t, g, unknown or other
  misc_feature (468)..(468): n is a, c, g, or t
tcagtacagatcgtcacgaccggtgctcgatttagtacacacacttagggagttgggggaaaaggccctgaggaaacaaaccccagctgggaagcctgagaacacttagccttcatgagtgtccccaccatggcctggatgatgcttctcctcggactccttgcttatggatcaggagtggattctcagactgtggtgacccaggacgccctatcgtttctcaggtcgtcccctgggacgggactagtccactacctctaccgttaggtcggtccttgtacgcgtcgtggtctctacgtctctacttacgttaccttaaccccgngtacctacggtaccaaccacgaaccccgacggaccgacggaccgtcccgaccgctaccgtctcactactaccacgacacgaaacctcgtaccgtactccttcgtaccgggtcctacgtactccgtcgttcctcgtcgtacccnctactccgttaggaacctaacgtccgtacgtccctaaccgaccgtaccgttaccggaacccgggcccggtaaacggcccgtaacggtaaccgtggtaacgtcgttaaacgtcttaaccggtaactttagtacgtttacggtaccgttaggttcttacggttaacgttaggggttaaccggttgggttaaccggtcgtttacggtttacgggttaccggttccggggttaccgggtaccgggtaccgtaacggtacccgg

SEQ ID NO: 285172 - DNA, 741 bp, Homo sapiens
  misc_feature: GYAE6OF02HT6FN.35.59.F04.1.454.CMB.1.raw
  modified_base (266)..(266): a, c, t, g, unknown or other
  misc_feature (266)..(266): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
tcagtacagatcgtcacgaccggtgctcgatttagtacacacacttagggattgggggaaaggccctgaggaaacaaacccagctgggaagcctgagaacacttagccttcatgagtcgtcccacatggcctggatgatgcttctcctcggacttcttgcttatggatcaggtagtggacttcacaggactggtcggtgacccagggacgccaagttccgttctcagtcgtccctggggagggacttagcaaccacgtcagttggnggcttcgagctctcgtcgtcagtctcttaacgtacgtttaccacccagccgttcgaaccaaccgaccgaacccncggacccncggtaccnccggacgcctaccgctcgaactccaagacgtccaaacaaaccgtcaccggtcttaccgtttccggttggggtacccctcggtaactcccggttctttccggttcctcgggtccctttacccgtaaccgttccgtttaacgggaaacgtaaaaccgtccggtaccttaccctaccctaacccgtaccggtaacccgggcggggaccccgtacggaccgaacggagttaccggaataccggtaattaccgttattaacgggtttaaacttacggtttaggcgtttagtacccgtttaggtagttaggttaccgggttaggtcgttccggttgggtttcgggttcgggtaggggttacccgggtagggaccggtaacggttacccggg

SEQ ID NO: 285173 - DNA, 565 bp, Homo sapiens
  misc_feature: GYAE6OF02GKBSH.35.59.F04.1.454.CMB.1.raw
  modified_base (328)..(328): a, c, t, g, unknown or other
  misc_feature (328)..(328): n is a, c, g, or t
  modified_base (359)..(359): a, c, t, g, unknown or other
  misc_feature (359)..(359): n is a, c, g, or t
  modified_base (388)..(388): a, c, t, g, unknown or other
  misc_feature (388)..(388): n is a, c, g, or t
  modified_base (454)..(454): a, c, t, g, unknown or other
  misc_feature (454)..(454): n is a, c, g, or t
  modified_base (557)..(557): a, c, t, g, unknown or other
  misc_feature (557)..(557): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtggcttgagctctggctcagtctctactagttacctaccccagcctaggtaccaacacgacccccaggccagcctccgcgcacgctcatcacagcaacaaacactcnctcgttcgtcgggtccctgactcgtctttcnctgcctccatccgttaggaacaagcctcnccctcaccacgtccggaccggggccaggacaggactgactgaattcctagtatttgttcgtgtgtntgttgtagttagtgggtacgtggtcttggttgggttcggtacggggcgggtaagggccaaggtccgtacggtacccggttcgtacggtaccgaccggacccgnggtccccg

SEQ ID NO: 285174 - DNA, 729 bp, Homo sapiens
  misc_feature: GYAE6OF02H5MIX.35.59.F04.1.454.CMB.1.raw
  modified_base (208)..(208): a, c, t, g, unknown or other
  misc_feature (208)..(208): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagtacagatcgtcacgaccggtgctcgatttagtacacacacttagggagttggggggaagcctgagaacacttagccttcatgagtgtccccaccatggcctggatgatgcttctcctcggactccttgcttatggatcgaggagtggattctcagactgtggtgacccgaggagccatcgttctcagtcgtcccctggagggangtcacactcacgttgtggcttgagctcgtggctacagtctacttactattacctaccccagtccgttagaaccaacncgaccccgagccaaggtcctacccggctacgaccgtccnctatcacgacgacaacaaaactcctcgtcttccttcggtcgggttacccctggtactcgtctttacgtctcggacccttacctacgtttaccccggttaggggaaaaacctaaacggttcctacgtccccctacaacccgtaacgtacccgggaccggggggttacccaacgggtccaaggttaacacggtaattaacggtaactttacctaaggttaacctttaagtttaacgttacggttgttagtaccgtttaaggttaagttacgggtttagggttaacggttacgggttccgtttagggtttcgggtttcgggtttaccggggaccgggttacgggaacgtaccgtacgtaccgttacccggtccggttaccggtacgaccggtaccgtaacggtccccg

SEQ ID NO: 285175 - DNA, 742 bp, Homo sapiens
  misc_feature: GYAE6OF02F3S5P.35.59.F04.1.454.CMB.1.raw
tcagtacagatcgtcacgaccggtgctcgatttagtacacacacttagggattgggggaaaaggccctgaggaaaacaaaccccagctgggaagcctgagaacacttagccttcatgagtgtcccaccatggcctggatgatgcttctcctcggactccttgcttatggatcaggagtggattctcagactgtggtgacccaggagccatcgttctcagtcgtccccgtgggacgggacacgtcacactctacttggtggcttgagtctctggctcacgtctctacttacgtacctacccagcctggttaacccaacgaccgaacccccgtaggacccgtacgggcctccggccgaccgaccggccttacacgtacctaccgacgaccaacgaaactaccgacgtccgttacgtttccggtaccggggttccctaggtacgtcccgttacctttccgtacgttcggtccctaccgttacgttaccgttacgggaaactaacgtcgtaccgaccctaccaacctacgtaccggacccggggtaccacggacctacgagtacgaagtagtaacgtcgttaacgtaactttaacgttacgttagggttccgttacgttacgttaggttacggtttaacgggttacggggtttaaggttcccgggttaccggttttccggggtttaggggttttaccgggttacgggggaccggggtaaccggggtaacggtaacgggtacccggg

SEQ ID NO: 285176 - DNA, 748 bp, Homo sapiens
  misc_feature: GYAE6OF02GPTEQ.35.59.F04.1.454.CMB.1.raw
  modified_base (354)..(354): a, c, t, g, unknown or other
  misc_feature (354)..(354): n is a, c, g, or t
tcagtacagatcgtcacgaccggtgctcgatttagtacacacacttagggattgggggggaagcctgagaacacttagccttcatgagtgtccccaccatggcctggatgatgcttctcctcggactccttgcttatggatcaggagtggattctcagactgtggtgacccaggagccatcgttctcgagttcgtcccctggagggacagtcacactcacttgtggcttgagctcgtggctcagttctctactagttacctacccgagtctacggtaacccaacacgtacccccaggcccaagggtcctccggcgccgaacgcctacacgtcctaacacgaccaaacaaaaccncctacgtaccttcgttccggtacgggtccctaggtacgttaccgtcctttacgtcgtcgggtacccttacccgaagtttcccggttaaggggaaaacccttaaacggccttacccgtccccgtaaccgtaccccgtaacgttacccgggaacccgggggtacccagggtaccaggtaacgtcgtaagtacgtaactacgtagtaacttttaacgttacgtggttacgtcggtcgttaagttacgttaacgggttgggttacggtaggttccgttaccgggttttaggggtcggtttaccggggacggggttaaccggaacccgtaacggtccggtaaccggtacccggttaccggttaaccggtaccgtacccgggacccgtacggtcccccgg

SEQ ID NO: 285177 - DNA, 721 bp, Homo sapiens
  misc_feature: GYAE6OF02I84BO.35.59.F04.1.454.CMB.1.raw
tcagtacagatcgtcacgaccggtgctcgatttagtacacacacttagggattggggagaggagcccagcactagaagtcggcggtgtttccattcggtgatcagcactgaacacagaggactcaccatggagtttgggctgagtcttgggtttttccctcgttgcttcttttaaagaggtgtccagttgtcgaggtgctaggttggtggagttcggtgggggagcggtggtccaggtccgtaggggcgttccctggacgtaccttccgtccgtgtgccagtcccttacgtagacttcaccctttcagtacgtcttaagtggacacgttgaccgacggttcggggtaccccgccgacggtcctaccggagggtacggaacgggggtcctaggggacggtggggtggactaggttacagtactatacgtgagtaggaatagtagaacgttactagtacgactaacgtacgtacggtaacggaacgggtacccgtacgttaacctacctaacgttcccgtaacgaacggtaacgtaaaccttaaacgttaaccgaaacgtaacccgtaccgtacttacgtacgtacgtaacgtaaccgtaaagttaccgaactacggtacgttagaacgtacggtacgacggacgacgtacggcgttagttacgttaagtacttaggtacgtaacggtaaccgtaaccggttaccgtttaacctacgtttacg

SEQ ID NO: 285178 - DNA, 807 bp, Homo sapiens
  misc_feature: GYAE6OF02FX233.35.59.F04.1.454.CMB.1.raw
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgcttcttttaagaggtgtccagtgtcaggtgctagttggtggagtcgtgggggagcgtggtccagcctgggacgtccctgagactctcctgtgcacgcctactagacttccaccttacagtagctagtggcctatcgactacgttcgggtcccgccgacggtcctccggaggacgaaaggggcctagggagggttcgggtaggtcgtaaggttactaactcgtaagttagtaggtaacgtagggtaaagtaacgttaggtaaacgttactaagtcggtaacctaacggtaaccgttaacggtaacgggtaaaccggggtacccgttaacgttacccgtaaacccgtactttacccggtaacccgtaagggtaaaccgtaaaccgtaaacgtttaacccggtaaaacgtaaacccgtaacccggtacctttacggttaacttaccggtaccgaaacggttaaacgttaaaccgtaaaaccgtaccgggttaaccctacggtaaacggtacggtaaccggttacgggaaccgggtaaccggtacccgggttgttaaccgggtttacgttaacggtttaacgttaacgggttacggtaaccggtaaaaccgttacggtttaccccgggttaacctttacggtttaaccgg

SEQ ID NO: 285179 - DNA, 666 bp, Homo sapiens
  misc_feature: GYAE6OF02JJT7A.35.59.F04.1.454.CMB.1.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttgctcttttaagagtgtccagtgtcaggtgcagttggtggagtcgtgggggaggcgtggtccagccgtgggaggtccctgacgactcctcctggtgaagcgtctggattcgatcgttacaatactancgcatgcacgtcgggtccncgaggctccgaggcgaagggtctgggagttcggtggcctaggttgtagtggtatgacgttagggaagttacgtanaacgttaactgtacggtacgacggtaccggtaccggtagggtaaccgggtaccgtacgttacccgaacctactaccgtaccgaagaacgaacgtaacttaccaacgtaacctttacctttcgttactacgtactaacgtagaacctacgcgtacgaacggtaccggaccggtaacggacgacgggacgtaactattaacgttacgtacggtacggacggtaacggaagtacggtaacgggtacgggtaacccgtaccccgggtaaccccgtagtaccgtaaccggg

SEQ ID NO: 285180 - DNA, 540 bp, Homo sapiens
  misc_feature: GYAE6OF02FL72T.35.59.F04.1.454.CMB.1.raw
  modified_base (336)..(336): a, c, t, g, unknown or other
  misc_feature (336)..(336): n is a, c, g, or t
  modified_base (360)..(360): a, c, t, g, unknown or other
  misc_feature (360)..(360): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtcgtcccctggagggacagtcacactcacttgtggcttgagctctggctcagttctctactagttacctaccccagcctcggtaccaaccacgaccccaggcccaggctcccggcncacgctcactctacagcaacaacnctcgctcttcgtgggtccctgactcgtctctctgtctcctntccgtaggaacaagctcnccctcaccnctcggaccgggcccaggacagatgatgtanctgttattatcgttgtctgtcttgtagtgtagggttagtggtcgttcgttgggttcggttcgggcggacggaccgaggtccg

SEQ ID NO: 285181 - DNA, 651 bp, Homo sapiens
  misc_feature: GYAE6OF02GJIGP.35.59.F04.1.454.CMB.1.raw
  modified_base (161)..(161): a, c, t, g, unknown or other
  misc_feature (161)..(161): n is a, c, g, or t
  modified_base (282)..(282): a, c, t, g, unknown or other
  misc_feature (282)..(282): n is a, c, g, or t
  modified_base (316)..(316): a, c, t, g, unknown or other
  misc_feature (316)..(316): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (378)..(378): a, c, t, g, unknown or other
  misc_feature (378)..(378): n is a, c, g, or t
  modified_base (470)..(470): a, c, t, g, unknown or other
  misc_feature (470)..(470): n is a, c, g, or t
  modified_base (520)..(520): a, c, t, g, unknown or other
  misc_feature (520)..(520): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagctgggttttcctcgttncttcttttaagaggtgtccagtgtcaggtgctagttggtggagtcgtggggggagcggtggtccaggccgtggggacggtccctgagtactctcctggtgcagtcctctagcttcaccttnagtactctagtcgcatgaccgtcgtcgggtaccncgacggcctcggaggcgaagggtntagggaggtgggacgnttaaggttatatacgattacgngaagtaggtaaattagcggtaagttacagtctaacgacgttaacgtacggtaggaaaccgggtcctaacttacccgaactacttcaccgaanacgtaactaacgtaaccaaacgaactcgacgttagtacctctaacgtaanaacgtacgaagcgtacgtaaggagcgtacgacggtacgaacgtcggttcgtagtttaactaacggttacgtttaggaacggtaacggtaagttaccccggttttaacggtaaccccgttagttttaaccgg

SEQ ID NO: 285182 - DNA, 796 bp, Homo sapiens
  misc_feature: GYAE6OF02IN3PU.35.59.F04.1.454.CMB.1.raw
tcagtacagatcgtcacgaccggtgctcgatttagtacacacacttagggagttgggggggaagcctgagaacacttagccttcatgagtgtccccaccatggcctggatgatgcttctcctcggactccttgcttatggatcaggagtggattctcagactgtggtcgaccaggagccatcgttctcagtcgtccctgggaggacagtcacactctacttgtgcgttgagctcgtggactcacgtctcttaacttacgttacctaccccagtctacggtaaccaacgaccgaccccaacggccgaggtcccgccggtccgaccgaccgcctacctactaccgtacacgaccaaccaaaccactcgccttcgtccgtcggggttccctgacgtccgtctttactccgttacgtccgttccaccgtttccgttaacgggtaaacctaaacgtccgtcccggtcccctaccacccgtaacgtacccgggaaccgggggtacccgacggtaacccgagggtaaacgtaggtaaacgttacgtaaacgttcgttaaacggtttactttaacgtaacgtttcggttaacggttaccggttcgtttaaggtttaacggtttaacggttggggttaccggtttcgggtaaccggtttttccgggtttacggggtttacgggtttacccgggggtaccgggtaaccgggttaacccgggaacggttccggttaacccggtttcccggttaccggggtttaacccggtacggtaacccgggtaccccgggtacggtacccccggg

SEQ ID NO: 285183 - DNA, 650 bp, Homo sapiens
  misc_feature: GYAE6OF02GGZWT.35.59.F04.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (212)..(212): a, c, t, g, unknown or other
  misc_feature (212)..(212): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (449)..(449): a, c, t, g, unknown or other
  misc_feature (449)..(449): n is a, c, g, or t
  modified_base (572)..(572): a, c, t, g, unknown or other
  misc_feature (572)..(572): n is a, c, g, or t
  modified_base (577)..(577): a, c, t, g, unknown or other
  misc_feature (577)..(577): n is a, c, g, or t
tcagtacagatcgtcacgaccggtgctcgatttagtacacacacttagggattgggggaaaaggccctgaggaaaacaaaccccagctgggaagcctgagaacacgtttagccttcaatgagtgtcccccaccatggcctggatgatgcttctcctcggactccttgcttanggatcaggagtggatctcanactgtggtgacccgaggacnccagtccgtttctacaggttcgtcccctagggaacgggtaccagtcctacacctactacgttggtcggacttgacgctacgtggcctagacggttctacttaaccgtagtttaacccaccccgtagtcctacggtaacccaaccgtaaccgaccccgacggtcccacggaccctccgaccgtcaccgcctcacttcacagccaacaaacncgtacncttccgtcgtcggtacctagntaccgtcttactcgtacgtctacctctaccggttaggaaacacgacgtccacccgtacacgacgtaccgggaccgggaccctaggactagacgttaagacgataacgttatacttaatagttntggtntacgtcttagtacgtgttagggtcgtcgttcgttaggttcgggtacgttgggacgggaaccgacgtagtccgg

SEQ ID NO: 285184 - DNA, 695 bp, Homo sapiens
  misc_feature: GYAE6OF02JCG03.35.59.F04.1.454.CMB.1.raw
  modified_base (300)..(300): a, c, t, g, unknown or other
  misc_feature (300)..(300): n is a, c, g, or t
  modified_base (448)..(448): a, c, t, g, unknown or other
  misc_feature (448)..(448): n is a, c, g, or t
  modified_base (579)..(579): a, c, t, g, unknown or other
  misc_feature (579)..(579): n is a, c, g, or t
tcagtacagatcgtcacgaccggtgctcgatttagtacacacacttagggattggggagaggagcccagcactagaagtcggcggtgtttccattcggtgatcagcactgaacacagaggactcaccatggagtttgggctgagcgttcgggttttcctcgtttacttctttttaagaggttgtccagtgtcaggtgctagttggtggacgttcgtggggggaggcgttggtccagtccgtgggtacgtccctggagtacctctccgtagtcgcacgccttctagtacttcctaccgttnacggtacgtcttagtcggatacgtcgactcgtcggggtcccacgcggtctaccgagggcgaaggggtctggggacggtggggtcggacttagtattagtcgtataggagtaggtagggtaatacggttagtaagttacagtccgtaanaccggttaacgttagggtaagggtaccgggtacttacttaccgaactctccgtacgaagtaactacgtaacttacgaaacgtaccagtccttagtctacgtacaactaaagcgtaaaccgtgcgtaaacgngtacgtacggaggtaccggacgtacggttagttacggtttaacttacgggttacttagggtacgtaacggtaaccgtaccggtttacccgtaacgttttaacgttacggttacggg

SEQ ID NO: 285185 - DNA, 821 bp, Homo sapiens
  misc_feature: GYAE6OF02HZ4AG.35.59.F04.1.454.CMB.1.raw
tcagtacagatcgtcacgaccggtgctcgatttagtacacacacttagggattggggagaggagcccagcactagaagtcggcggtgtttccattcggtgatcagcactgaacacagaggactcaccatggagtttgggctgagtctgggttttcctcgttgcttcgttttaagaggtgtccagtgtcaggtgcaggttggtggagtcgtgggggagcgtggtccagccgtgggacgtccctgagactctccgtgtcgcacgcctctagtcttccaccttcagttacgctagtggactagtcgaccacggttcgggtcccgaccgtagggtccctacccggaagggaccggaaacggggggtccgtaggggtacgggtttcgggggtcgtaccgttaaagggttttaacgtaggtttacgggtattacgggtaaacggttcggggtaaaaacgttaccgtaaaaggttaaaaacggtaccgttaagtccggtaaccggtaaacggtacccggtttaccgggtaaaggggtaacccgggtacccgttacgttaaccccgaaccgttaacggttacccgtaaccggtaaaggaaccgtaaaccgtttaaaccgttaacccgaaaacgtacccgtaacggtaccgttacgttaaccttcgtaacgtaaacgtaaacgtaaccgaaccgtacggaccgttaagggaaccggaccgacccggtaagtacccggtacggttcgttacggtaacgtttaccgtaacggttcggtaccggaacggtaacgaaccggttaccggaagtaacggtacgttaccggtaaacg

SEQ ID NO: 285186 - DNA, 621 bp, Homo sapiens
  misc_feature: GYAE6OF02IWXM9.35.59.F04.1.454.CMB.1.raw
  modified_base (372)..(372): a, c, t, g, unknown or other
  misc_feature (372)..(372): n is a, c, g, or t
tcagtacagatcgtcacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactggtggtgaccaggagccatcgttctcagtcgtcccctgggagggacacgtcacactctacttggtggcttgagctctggctcgtagtctactactacgttacctaccccagtctacggtaccaacacgaccccgaggccaggccgtccgcgcaccgctcatcctacacgacaacaaaccnctcgtccttcgttcggtcggggtccctgactccgtctttcgtctcggtcctcctacgttccgttagggaaaccaacgtcgtccaccctccaccgtacgtaccggacccggggccgacggacacgtgtagatacgaacttcgtattatttacgttagtgttgtgtacgttgttagtggttagggtaggttcggtcggtttgggttcgggttcgggttccgggacggggtaacgggtaccgtacggtccgg

SEQ ID NO: 285187 - DNA, 995 bp, Homo sapiens
  misc_feature: GYAE6OF02FRT4P.35.59.F04.1.454.CMB.1.raw
  modified_base (161)..(161): a, c, t, g, unknown or other
  misc_feature (161)..(161): n is a, c, g, or t
tcagtacagatcgtcacgaccggtgctcgatttagtacacacacttagggattggggagaggagcccagcacgtagaagtcggcggtgtttccattcggtgatcagcactgaacacagaggactcaccagtggagtttgggctgagcgttagggttttccncgttgccttacgttttaagaggttacgtcctaggtgtcgaaggttgcgttaggttcggtaggtacgttcggtggggggtactcggttacggtaccgacgcccggttagggaacggttcccgtaggtacggtacccgttaccgttccggttacggtacggaccgtaaccggttcccgttagtaaccggttactttcccccgtaaacccgtttttccggaaacggtttacgtttaccccggttaggtttacgggtacccggttaaacttcccggggtaaccccgttaaccgggtttacccgggggggttcccccgttaacccggttaacggggggttaccccccttacccggggggaacggggttaaccccgggttaaagggggggttccccgttaaagggggtttacccgggttcggggggttaaccggtcgttaaaccgggtttaacgttacgtaccggttaacgttaggggttaccggtaacgttaacgggggtaaaacgtttaacgttcgggtaaacgttttcccgtaacggtttaccgacgtaaaccggttacgttacgggtaacggttaaccgggtccgtttacgtacgtaccgtaacgttccgtacgtaacggaccgtaacgtaaccgttaaccgtaacgtaccgtaacgttccgtacggtaacgttacgtaccggtaacgtaaacgtacccggtaagtacccggttacgtaacggtaacggtacggtaccgtaacgtacgggtaacccgtagggtcgttaccgggtttaataccggttacgcgttaccggtaggtaaccgttaacggtacggtaacggtgtaaccggg

SEQ ID NO: 285188 - DNA, 738 bp, Homo sapiens
  misc_feature: GYAE6OF02G5J1N.35.59.F04.1.454.CMB.1.raw
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
  modified_base (409)..(409): a, c, t, g, unknown or other
  misc_feature (409)..(409): n is a, c, g, or t
tcagtacagatcgtcacgaccggtgctcgatttagtacacacacttagggattggggagaggagcccagcactagaagtcggcggtgtttccattcggtgatcagctactgaacacagaggactcaccatggacgtttggctgagctgggttttcctcgttgctcttttaagaggtgtccagttgtctaggtgacagctggtggagtgtgggggagtcgtggtccaggtccgtggggacggttcccctaggaacgtccgtaccttccgttggagtaacgcgttcgnggtacttcagttccttacaagttaacctagttaggccaattcgactaaccgttcggggtcccnccgtacgggcctaccggaggaccgaaagggtcctagggacgtaggttcgactaggttcgnggtacggtagtgtacgtaggaaaggtactagggtaattacgtagtacgtacgaagaccggtacggtacggtaaacgggccgtaacttaccgaaccgtactacccgttaccgtaaacgtcctaaaccggtaaaccttaccgtaaaaccgtacgtttaaaccgtttccggttacccgtaacctaacggttaaacctagtaaccctacgtacccgttaggacggtacgtaccgaaggaaccgtacggacggtactagttacgttactacggtaggtaaccggaagtacggaacgtacgtcgggtaaccgcccggtacccggtagtaaccggg

SEQ ID NO: 285189 - DNA, 796 bp, Homo sapiens
  misc_feature: GYAE6OF02HALQO.35.59.F04.1.454.CMB.1.raw
  modified_base (118)..(118): a, c, t, g, unknown or other
  misc_feature (118)..(118): n is a, c, g, or t
  modified_base (291)..(291): a, c, t, g, unknown or other
  misc_feature (291)..(291): n is a, c, g, or t
  modified_base (338)..(338): a, c, t, g, unknown or other
  misc_feature (338)..(338): n is a, c, g, or t
tcagtacagatcgtcacgaccggtgctcgatttagtacacacacttagggattgggggggagaggagcccagcactagaagtcggcggtgtttccattcggtgatcagcactgaacanagaggactcaccatggagtttgggctgagcgttgggtttcctgtgcctgttttaaggacggtgtaccgagtgttcagggtcgcgtaggttggtggtggtcggtaggggggacgtcggtcggtccgagttcggtcggggaacgttccctaggaacgtccttctccgtagtcgcncgtcctagtagtacttcctaccttacgtaatacgttgtacgttagtntacgtaccggtaccggttcgggtcccgaccggtaccggtccgttaccggggtacgggggtaacgggtaccgttggggtaccgggttcgggtccctgttaaccggtttacgttaacgggttacggttaaaggttcggtttagtttacggttttaaaacttactaggttttaagttacggtaacgggtaacgggtaccggggggtttcgggggtacggggggtacccttacgtttaacccgaccttacgttcccgtaaccgagaaacccggtaaccggaaccgtaccgaaacggaaccgtcgttaagtttacccgttactaggaaacttaacgacgtacgacgctacggacgtacggacgtaaggacctaggtccttaggcttagttatcgtagaccggaatggtacggcgtacggtcggttccccggtaccggttagacccggtggtccgaggtaccgg

SEQ ID NO: 285190 - DNA, 222 bp, Homo sapiens
  misc_feature: GYAE6OF01BS0SR.12.78.H01.1.454.CMB.1.raw
  modified_base (222)..(222): a, c, t, g, unknown or other
  misc_feature (222)..(222): n is a, c, g, or t
tcagatacgacgtacacgaccggtgctcgatttagtgtgagtagttgggttgggaggatgaggctgattattactgtgcagcatgggatgacagcctgaatggtccggtattcggcggagggaccaagctgaccgtcctaggtcagcccaaggctgcccctcggtcactctgttcccaccctcctctacgtcgtatctgagcgggctggcaaggcgcatagn

SEQ ID NO: 285191 - DNA, 171 bp, Homo sapiens
  misc_feature: GYAE6OF01BDRFP.12.78.H01.1.454.CMB.1.raw
  modified_base (171)..(171): a, c, t, g, unknown or other
  misc_feature (171)..(171): n is a, c, g, or t
tcagatacgacgtacacgaccggtgctcgatttagtgtgagtagtttgggtttggggaagaggaagactgacggtcccccaggagttcaggtgctgggcacagcggccctgggctgcctgtcaaggactacttcctacgtcgtatctgagcgggctggcaaggcgcatagn

SEQ ID NO: 285192 - DNA, 224 bp, Homo sapiens
  misc_feature: GYAE6OF01CFPV0.12.78.H01.1.454.CMB.1.raw
  modified_base (224)..(224): a, c, t, g, unknown or other
  misc_feature (224)..(224): n is a, c, g, or t
tcagatacgacgtacacgaccggtgctcgatttagtgtgagtagtttgggtttgggaggatgaggctgattattactgtgcagcatgggatgacagcctgaatggtccggtattcggcggagggaccaagctgaccgtcctaggtcagcccaaggctgcccctcggtcactctgttcccaccctcctctacgtcgtatctgagcgggctggcaaggcgcatagn

SEQ ID NO: 285193 - DNA, 324 bp, Homo sapiens
  misc_feature: GYAE6OF01C2VVX.12.78.H01.1.454.CMB.1.raw
  modified_base (295)..(324): a, c, t, g, unknown or other
  misc_feature (295)..(324): n is a, c, g, or t
tcagatacgacgtacacgaccggtgctcgatttagtgtgagtagtttgggtttgggggtgtggtggtctccactcccgccttgacgggctgctatctgccctccctggccatcagtgggctccagtctgaggatgaggctgattattactgtgcagcatgggatgacagcctgaatggtccggtatttcggcggagggaccaagctgaccgtcctaggtcagcccaaggctgccccctggtcactctgtcccacctcctctacgtcgttctgagcgggctggcaaggcgcatagnnnnnnnnnnnnnnnnnnnnnnnnnnnnnn

SEQ ID NO: 285194 - DNA, 151 bp, Homo sapiens
  misc_feature: GYAE6OF01AE25P.12.78.H01.1.454.CMB.1.raw
  modified_base (130)..(151): a, c, t, g, unknown or other
  misc_feature (130)..(151): n is a, c, g, or t
tcagatacgacgtacacgaccggtgctcgatttagtgtgagtagtttgggtttggcacagcggccctgggctgcctggtcaaggactacttcctacgtcgtatctgagcgggctggcaaggcgcatagcnnnnnnnnnnnnnnnnnnnnnn

SEQ ID NO: 285195 - DNA, 173 bp, Homo sapiens
  misc_feature: GYAE6OF01C3H3W.12.78.H01.1.454.CMB.1.raw
  modified_base (173)..(173): a, c, t, g, unknown or other
  misc_feature (173)..(173): n is a, c, g, or t
tcagatacgacgtacacgaccggtgctcgatttagtgtgagtagtttgggtttgggggaagaggaagactgacggtcccccaggagttcaggtgctgggcacagcggccctgggctgcctggtcaaggactacttcctacgtcgtatctgagcgggctggcaaggcgcatagn

SEQ ID NO: 285196 - DNA, 173 bp, Homo sapiens; identical to SEQ ID NO: 285195
  misc_feature: GYAE6OF01BBN3X.12.78.H01.1.454.CMB.1.raw
  modified_base (173)..(173): a, c, t, g, unknown or other
  misc_feature (173)..(173): n is a, c, g, or t

SEQ ID NO: 285197 - DNA, 305 bp, Homo sapiens
  misc_feature: GYAE6OF01EGRPW.12.78.H01.1.454.CMB.1.raw
  modified_base (297)..(305): a, c, t, g, unknown or other
  misc_feature (297)..(305): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacaccctgactggtccgggagtgttcggcggaggaccaagctgaccgtcctaggtcagcccaaggcacgcccctcggtcactctgttcccgcctcctctacgtcgtatctgagcggctggcaaggcgcatagnnnnnnnnn

SEQ ID NO: 285198 - DNA, 588 bp, Homo sapiens
  misc_feature: GYAE6OF01CFYPQ.12.78.H01.1.454.CMB.1.raw
tcagatacgacgtacacgaccggtgctcgatttagtgtgagtagtttgggtttggggaggcttggtacagcctggggggtccctgagactctcctgtgcagcctctggattcacctttagcaactatgccatgagctgggtccgccaggctccagtgaaggggctggagtgggtctctggtctgaattggaatggtgatagtatagattatgcaggctctgtgaggggccgattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcacgcctccaccaacgggcccatccggtccttccccctcggccacccctccctccaagacgccaccctcgtcgggggccacgacgccggcccgtcggggcctcggcccgtcgggtccgaaacgggtacccttaaccgtttcccgttaaccgttccggttaacttccgttaggacggccggggtccgg

SEQ ID NO: 285199 - DNA, 174 bp, Homo sapiens
  misc_feature: GYAE6OF01CP9EO.12.78.H01.1.454.CMB.1.raw
  modified_base (173)..(174): a, c, t, g, unknown or other
  misc_feature (173)..(174): n is a, c, g, or t
tcagatacgacgtacacgaccggtgctcgatttagtgtgagtagtttgggtttgggggaagaggaagactgacggtcccccaggagttcaggtgctgggcacagcggccctgggctgcctggtcaaggactacttcctacgtcgtatctgagcgggctggcaaggcgcatagnn

SEQ ID NO: 285200 - DNA, 503 bp, Homo sapiens
  misc_feature: GYAE6OF01D30QU.12.78.H01.1.454.CMB.1.raw
  modified_base (499)..(503): a, c, t, g, unknown or other
  misc_feature (499)..(503): n is a, c, g, or t
tcagatacgacgtacacgaccggtgctcgatttagtgtgagtagtttgggtttgggggaagaggaagactgacggtcccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatcggtcttccccctggcaccctcctccaagacgcacctctgggggcacagcggccctgggctgccctggtcaaggactacttcctacgtctatctgagcgggctggcaaggcgcatagnnnnn

SEQ ID NO: 285201 - DNA, 555 bp, Homo sapiens
  misc_feature: GYAE6OF01D74LU.12.78.H01.1.454.CMB.1.raw
tcagatacgacgtacacgaccggtgctcgatttagtgtgagtagtttgggtttgggggaggcttggtacagcctgggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggtttcgaccctggggccagggaaccctggtcaccgtctcctcagcctccaccaacgggcccactcgtccttccccctcggccaccctccctccaacgacgcacccgtcgtcgggggccacgacgccggcccgtcgggctcgcctggtcaacggactacgttcctacgtcgtactctgacgcggctggcaggcgcg

SEQ ID NO: 285202 - DNA, 304 bp, Homo sapiens
  misc_feature: GYAE6OF01EP3HK.12.78.H01.1.454.CMB.1.raw
  modified_base (301)..(304): a, c, t, g, unknown or other
  misc_feature (301)..(304): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgtatcatgggctgacaccctgactggtccgggagtgttcggcggagggaccaagctgaccgtcctaggtcagcccaaggcagccccctggtcactctcgttcccgccctcctctacgtcgtatctgagcgggctggcaaggcgcatagnnnn

SEQ ID NO: 285203 - DNA, 551 bp, Homo sapiens
  misc_feature: GYAE6OF01AIVIZ.12.78.H01.1.454.CMB.1.raw
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggtcgaccccgtggggccagggaccctggtcaccgtctcctcagcctccaccaacgggccccagtccggtcttccccctggccaccctccctccaacgacgcaccctcgtcggggccacgacgccggccctgggcctgcctggtccaaggactacgttcctacgtcgtntctgngcggctggcaggcgacg

SEQ ID NO: 285204 - DNA, 227 bp, Homo sapiens
  misc_feature: GYAE6OF01ERLVK.12.78.H01.1.454.CMB.1.raw
  modified_base (226)..(227): a, c, t, g, unknown or other
  misc_feature (226)..(227): n is a, c, g, or t
tcagatacgacgtacacgaccggtgctcgatttagtgtgagtagtttgggtttggggaggatgaggctgattattactgtgcagcatgggatgacagcctgaatggtccggtattcggcggagggaccaagctgaccgtcctaggtcagcccaaggctcgccccctcggtcactctgttcccaccctcctctacgtcgtatctgagcggctggcaaggcgcatagnn

SEQ ID NO: 285205 - DNA, 442 bp, Homo sapiens
  misc_feature: GYAE6OF01CN3RK.12.78.H01.1.454.CMB.1.raw
  modified_base (435)..(442): a, c, t, g, unknown or other
  misc_feature (435)..(442): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctcgttcccaccctcctctacgtcgtatctgagcgggctggcaaggcgcatagnnnnnnnn

SEQ ID NO: 285206 - DNA, 229 bp, Homo sapiens
  misc_feature: GYAE6OF01A1OZV.12.78.H01.1.454.CMB.1.raw
  modified_base (225)..(229): a, c, t, g, unknown or other
  misc_feature (225)..(229): n is a, c, g, or t
tcagatacgacgtacacgaccggtgctcgatttagtgtgagtagtttgggtttgggaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtatctgagcgggctggcaaggcgcatagnnnnn

SEQ ID NO: 285207 - DNA, 515 bp, Homo sapiens
  misc_feature: GYAE6OF01CL07R.12.78.H01.1.454.CMB.1.raw
  modified_base (504)..(515): a, c, t, g, unknown or other
  misc_feature (504)..(515): n is a, c, g, or t
tcagatacgacgtacacgaccggtgctcgatttagtgtgagtagtttgggtttgggggaagaggaagactgacggtcccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctgggccagggaccctggtcaccgtctcctcagcctcaccaagggcccatcggtcttccccctggccaccctcctccaagacgcacctcgtcgggggcaccgagccggcccctgggctgcctggtcaaggacctacttcctacgtcgtatctgacgcgggctggcaaggcgcatagnnnnnnnnnnnn

SEQ ID NO: 285208 - DNA, 572 bp, Homo sapiens
  misc_feature: GYAE6OF01D67T2.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgctacgattggggagcgactggttcgacccgtggggccagggaccctggtcaccgtctcctcagccctccaccaaacgggccccagtccggtccttccccctgggcccaccctcctcccaagacgcaccgtcgtggggccacgacggccggcccgtgggcctcgcccgtggtccaaagggaccttaccgttccgtacgttcgtactcgtgacggcgggctcggcaaggcgacg

SEQ ID NO: 285209 - DNA, 530 bp, Homo sapiens
  misc_feature: GYAE6OF01DUO1H.12.78.H01.1.454.CMB.1.raw
  modified_base (521)..(521): a, c, t, g, unknown or other
  misc_feature (521)..(521): n is a, c, g, or t
  modified_base (528)..(528): a, c, t, g, unknown or other
  misc_feature (528)..(528): n is a, c, g, or t
tcagatacgacgtacacgaccggtgctcgatttagtgtgagtagtttgggtttgggggaggcttggtacagcctggggggtccctgagactctcctgtgcagcctctggatttacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggagcgactggttcgaccctggggccagggaccctggtcaccgtctcctcagcctccaccaaggcccatcgtcttcccctggcaccctcctccaagacgcacctctggggcacagcgccctgggctgcctggtcaaggactacttcctacgtcgtatctgagcgggctggnaaggcgnag

SEQ ID NO: 285210 - DNA, 321 bp, Homo sapiens
  misc_feature: GYAE6OF01AUOKJ.12.78.H01.1.454.CMB.1.raw
  modified_base (302)..(321): a, c, t, g, unknown or other
  misc_feature (302)..(321): n is a, c, g, or t
tcagatacgacgtacacgaccggtgctcgatttagtgtgagtagtttgggtttggggggtggtggtggtctccactcccgcccttgacggggctgctatctgcctcccgtggccatcagtgggctccagtctgaggatgaggctgattattactgtgcagcatgggatgacagcctgaatggtccgtattcggcggaggaccaagctgaccgtcctaggtcagcccaaggctcgcccccgtcggtccactctcgttcccgcctcctctacgtcgtatctgagcggctggcaaggcgcatagnnnnnnnnnnnnnnnnnnnn

SEQ ID NO: 285211 - DNA, 298 bp, Homo sapiens
  misc_feature: GYAE6OF01CSPXX.12.78.H01.1.454.CMB.1.raw
  modified_base (295)..(298): a, c, t, g, unknown or other
  misc_feature (295)..(298): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacagcctgaatggtccggtattcggcggaggaccaagctgaccgtcctaggtcagcccaaggctgcccctcggtcactctcgttcccgcctcctctacgtcgtatctgagcgggctggcaaggcgcatagnnnn

SEQ ID NO: 285212 - DNA, 294 bp, Homo sapiens
  misc_feature: GYAE6OF01B1XUW.12.78.H01.1.454.CMB.1.raw
  modified_base (293)..(294): a, c, t, g, unknown or other
  misc_feature (293)..(294): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgcccctggtcactctgttcccacctctctacgtcgtatctgagcgggctggcaaggcgcatagnn

SEQ ID NO: 285213 - DNA, 173 bp, Homo sapiens; identical to SEQ ID NO: 285195
  misc_feature: GYAE6OF01DJA9R.12.78.H01.1.454.CMB.1.raw
  modified_base (173)..(173): a, c, t, g, unknown or other
  misc_feature (173)..(173): n is a, c, g, or t

SEQ ID NO: 285214 - DNA, 304 bp, Homo sapiens
  misc_feature: GYAE6OF01DCN69.12.78.H01.1.454.CMB.1.raw
  modified_base (300)..(304): a, c, t, g, unknown or other
  misc_feature (300)..(304): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctcgttccccgcctcctctacgtcgtatctgagcgggctggcaaggcgcatagnnnnn

SEQ ID NO: 285215 - DNA, 594 bp, Homo sapiens
  misc_feature: GYAE6OF01CL12V.12.78.H01.1.454.CMB.1.raw
  modified_base (402)..(402): a, c, t, g, unknown or other
  misc_feature (402)..(402): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagacacgctgtatttgcatatgaacagcctgagagccgaggacacggccgtatattactgtgcgaagcttagcggttaccggctacgattggggagcgactggttccgacccgtggggccagggaccctggtccaccgtctccncacgcctaccaccgacgggccccagtccggtccttccccgtcggccctaccctccctaccaacgacgcacccgtcgtcggggaccacgacgccggcccgtcgggcctcggcccgtggtaccgaacggtacctaccgttcccgtacgttccgtacttccgtggacggtccgggtctgggccgtagggcgtacg

SEQ ID NO: 285216 - DNA, 587 bp, Homo sapiens
  misc_feature: GYAE6OF01D3YFX.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggtcgacccctggggccagggaaccctggtcaccgtctcctcagcctccaccaacgggccccagtccggttccttccccctcggccctaccctccctccaacgacgcctacccgtcgtcgggggaccaccgacggccggtacccgtcgggccgtcggcccgtggtaccgaaacgggacttaccgttccgtacgtcgtactccgtgacgtcgggctggcaggcgtacg

SEQ ID NO: 285217 - DNA, 539 bp, Homo sapiens
  misc_feature: GYAE6OF01D1WOG.12.78.H01.1.454.CMB.1.raw
  modified_base (529)..(529): a, c, t, g, unknown or other
  misc_feature (529)..(529): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagctagcggttaccggctacgattggggagcgactggtcgaccctggggccagggaccctggtcaccgtctctcagcctccaccaacggcccatccggtcttccccctggccaccctcctccaacgacgcacctcgtggggccacgagccggccctgggctcgccgtggtcaggactacgttcctagtcgtatctgacgtcggcnggcaggcgcg

SEQ ID NO: 285218 - DNA, 230 bp, Homo sapiens
  misc_feature: GYAE6OF01AW9MS.12.78.H01.1.454.CMB.1.raw
  modified_base (224)..(230): a, c, t, g, unknown or other
  misc_feature (224)..(230): n is a, c, g, or t
tcagatacgacgtacacgaccggtgctcgatttagtgtgagtagtttgggtttgggaggatgaggctgattattactgtgcagcatgggatgacagcctgaatggtccggtattcggcggagggaccaagctgaccgtcctaggtcagcccaaggctgccccctggtcactctgttcccgccctcctctacgtcgtatctgagcgggctggcaaggcgcatagnnnnnnn

SEQ ID NO: 285219 - DNA, 228 bp, Homo sapiens
  misc_feature: GYAE6OF01DURH2.12.78.H01.1.454.CMB.1.raw
  modified_base (226)..(228): a, c, t, g, unknown or other
  misc_feature (226)..(228): n is a, c, g, or t
tcagatacgacgtacacgaccggtgctcgatttagtgtgagtagtttgggtttggggaggatgaggctgattattactgtgcagcatgggatgacagcctgaatggtccggtattcggcggaggaccaagctgaccgtcctaggtcagcccaaggctcgccccctcggtcactctgttcccgccctcctctacgtcgtatctgagcgggctggcaaggcgcatagnnn

SEQ ID NO: 285220 - DNA, 304 bp, Homo sapiens
  misc_feature: GYAE6OF01B6G8H.12.78.H01.1.454.CMB.1.raw
  modified_base (297)..(304): a, c, t, g, unknown or other
  misc_feature (297)..(304): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccgcctcctctacgtcgtatctgagcgggctggcaaggcgcatagnnnnnnnn

SEQ ID NO: 285221 - DNA, 520 bp, Homo sapiens
  misc_feature: GYAE6OF01DXVCG.12.78.H01.1.454.CMB.1.raw
  modified_base (503)..(503): a, c, t, g, unknown or other
  misc_feature (503)..(503): n is a, c, g, or t
  modified_base (506)..(520): a, c, t, g, unknown or other
  misc_feature (506)..(520): n is a, c, g, or t
tcagatacgacgtacacgaccggtgctcgatttagtgtgagtagtttgggtttggggggaagaggaagactgacggtcccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgatttggggagcgactggttcgacccctggggccagggaaccctggtcaccgtctcctcagcctccaccaagggcccatcggtcttccccctggcacccctctcccaagacgcacctctcgggggccacgagcggccctgggctgcctggcaaggactacttcctacgtcgtatctgagcggctggcaaggcgcatagncgnnnnnnnnnnnnnnn

SEQ ID NO: 285222 - DNA, 549 bp, Homo sapiens
  misc_feature: GYAE6OF01ADE5L.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccccgtggggccagggaaccctggtcaccgtctcctcagcctccaccaacgggcccatcggtccttccccctcggccaccctcctccaacgacgccacctcgtcggggcacgacgccggccctgggcctcgcctggcaacggactacttcctacgtcgtatctgacgcggctggcaggcgcg

SEQ ID NO: 285223 - DNA, 601 bp, Homo sapiens
  misc_feature: GYAE6OF01AVAUX.12.78.H01.1.454.CMB.1.raw
  modified_base (355)..(355): a, c, t, g, unknown or other
  misc_feature (355)..(355): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggancgactggttcgacccgtggggccagggaaccctggtccaccgtctcctcacgccctccaccgaacgggccccagtccggtccttcccccgtcggcccacccctccctacccaacgacgccacccgtcgtcgggggccacgacggccggcccgtggggcctcggcccgtggtaccaacgggaccttaccgttcccgttaccgttcggtacttccgtggacggtccgggctagggcaacgggcgtacg

SEQ ID NO: 285224 - DNA, 438 bp, Homo sapiens
  misc_feature: GYAE6OF01CSOWX.12.78.H01.1.454.CMB.1.raw
  modified_base (342)..(342): a, c, t, g, unknown or other
  misc_feature (342)..(342): n is a, c, g, or t
  modified_base (430)..(438): a, c, t, g, unknown or other
  misc_feature (430)..(438): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctggattattactgtgcagcatgggatgacagcctgaatggtccggtattcggcggagggaccaagcngaccgtcctaggtcagcccaagctcgcccctggtcactctcgtcccacctctctacgtcgtatctgagcggctcggcaggcgcatagnnnnnnnnn

SEQ ID NO: 285225 - DNA, 585 bp, Homo sapiens
  misc_feature: GYAE6OF01CUM7L.12.78.H01.1.454.CMB.1.raw
  modified_base (338)..(338): a, c, t, g, unknown or other
  misc_feature (338)..(338): n is a, c, g, or t
  modified_base (352)..(352): a, c, t, g, unknown or other
  misc_feature (352)..(352): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattccaagaacacgctgtattgcatatgaacagcctgagagccgagacacggccgtatatactgtgcgaagcttagcggttaccggntacgagttggggancgactggtcgacccgtgggaccagggaaccctggtccaccgtctctcacgcctaccaccgaacgggccctacgtccgtccttccccgtcggccaccctccctacaacgacgcaccgtcgtcggggacacgacgccgcccgtgggcctcgcctcggtaccgaaacgtaccgtaccttcccgtacggttacgtacgtccgtggtacggccggggactcgggacaacgggcgaccg

SEQ ID NO: 285226 - DNA, 624 bp, Homo sapiens
  misc_feature: GYAE6OF01BSPFA.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtcaccgtctcctcagcctccaccaacgggccccatccggtccttcccccgtcggccacccctccctcccaacgacgaccaccctcgtcgggggccacgacggccgggtcccgtcggggccgtcggcccgttcgggtaccgaaacgggtacccgttaccgtttacccgttaccggttcccggttacttccgttaggacgggtccggggccgttacgggaccgaagggccggtaccg

SEQ ID NO: 285227 - DNA, 327 bp, Homo sapiens
  misc_feature: GYAE6OF01D9POH.12.78.H01.1.454.CMB.1.raw
  modified_base (310)..(327): a, c, t, g, unknown or other
  misc_feature (310)..(327): n is a, c, g, or t
tcagatacgacgtacacgaccggtgctcgattttagtgtgagtagtttgggtttggggggtgggtggtggtctcccactccccgtccgttgaccggggctgtctattctgcctccctggccatcagtgggctccagtctgaggatgaggctgattattacttgtgcagcatgggatgacagcctgaatggtccgtattcggcggaggaccaaggctcgaccgtcctaggtcgacgcccaaggctcgcccctcggtcactctcgttcccacctcctctacgtcgtatctgagcggctggcaagcgcatagnnnnnnnnnnnnnnnnnn

SEQ ID NO: 285228 - DNA, 560 bp, Homo sapiens
  misc_feature: GYAE6OF01BYUF0.12.78.H01.1.454.CMB.1.raw
tcagatacgacgtacacgaccggtgctcgatttagtgtgagtagtttgggtttgggggaggcttggtacagcctggggggtccccgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggagcgactggttcgaccccgtggggccagggaaccctggtcaccgtctcctcagcctccaccaacggcccatccggtccttcccccgtcggccaccctccctccaacgacgcacctcgtcggggcacgacgcggcccgtgggctgcctcggtcaacggacctaccttccgtcgtcgtactctgaggcgggtctcggcacggcgcgtacg

SEQ ID NO: 285229 - DNA, 614 bp, Homo sapiens
  misc_feature: GYAE6OF01EN3VT.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggacacggccgtatatactgtgcgaagcttagcggttaccggctacgagttggggagcgactggttcgacccgtggggccagggaccctggtcaccgtctcctcacgccctccaccgaacgggccccacgtccggtcccttcccccgtcggccctacccctccctacccgaacgacgccaccctacggtcgggggaccaccgacggcccgggcccgtcggggcctcggcccgtgggtaccgaaggtaccttaccgtttcccgtacggttcgttactcgtaggacggtccggggcttagggccgaacgggcgtacg

SEQ ID NO: 285230 - DNA, 620 bp, Homo sapiens
  misc_feature: GYAE6OF01DA0IX.12.78.H01.1.454.CMB.1.raw
  modified_base (287)..(287): a, c, t, g, unknown or other
  misc_feature (287)..(287): n is a, c, g, or t
tcagatacgacgtacacgaccggtgctcgatttagtgtgagtagtttgggtttgggggaggcttggtacagccgtggggggtccctgagactctcctgtgcagcctctggattcacctttagcaactatgccatgagctgggtccgccaggctccagtggaaggggctggagtgggtctcaggtattagtggtagtggtggtaacagatactacgcagactccgtgaagggccggttcagcatctccagagacaattccaaagaacacgctgtatttgcatatgaanagcctgagagccgaggacacggcgtatattactgtgcgaagcttagcggttaccggctacgagttgggagcgactcggttccgaccccgtgggccacgggaccctcggcaccgtctcctcacgcctccaccgaacgggcccatccggtccttcccccgtcggccctacccctccctaccaacgacgccacccgtcgtcgggggccaccgacggcccgggtcccgtcgggtcctcggtccgttcgggtaccgaaacggtacccttaccgtaccccgttaccggtacgttacttccgtaggacggcggggtcgtcgggaccgaacggccgctaag

SEQ ID NO: 285231 - DNA, 587 bp, Homo sapiens
  misc_feature: GYAE6OF01E0TI0.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttccgacccgtggggccacgggaaccctggtcaccgtctcctcacgcctccaccgaacgggccccacgtccggtccttccccctcgggccctacccctccctcccaacgacgccacctcgtcggggccacgacgccggcccgtgggctcgccgttggtccgaacggaccttacgttccctacgttcgttacttccgtggacggcgggcgtaggcgaagggcgacg

SEQ ID NO: 285232 - DNA, 588 bp, Homo sapiens
  misc_feature: GYAE6OF01DPARJ.12.78.H01.1.454.CMB.1.raw
  modified_base (236)..(236): a, c, t, g, unknown or other
  misc_feature (236)..(236): n is a, c, g, or t
  modified_base (455)..(455): a, c, t, g, unknown or other
  misc_feature (455)..(455): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttnagcatctccagagacaattccaaagaacacgctgtatttgcatatgaacagcctgagagccgaggacacggccgtatattactgtgcgaagtcttagcggttaccggctacgagttggggagcgacgtcggttccgacccgtggggccgacgggtaacccgtggtccaccgtctcctcacgcctccaccgacgggcccctagtccggtcccttccccgnggcccaccctccctacaacgcgccaccgtcggtcgggccacgacgccgccgtggctcgcgtcgtacgacggtaccttacgttccgtacgtcttcgtccgtggacggtccgggtctaggaccgaaggcgtaacg

SEQ ID NO: 285233 - DNA, 300 bp, Homo sapiens
  misc_feature: GYAE6OF01CRA7E.12.78.H01.1.454.CMB.1.raw
  modified_base (297)..(300): a, c, t, g, unknown or other
  misc_feature (297)..(300): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctcgcccctggtcactctcgttcccacctcctctacgtcgtatctgagcgggctggcaaggcgcatagnnnn

SEQ ID NO: 285234 - DNA, 447 bp, Homo sapiens
  misc_feature: GYAE6OF01CLUVD.12.78.H01.1.454.CMB.1.raw
  modified_base (427)..(427): a, c, t, g, unknown or other
  misc_feature (427)..(427): n is a, c, g, or t
  modified_base (434)..(447): a, c, t, g, unknown or other
  misc_feature (434)..(447): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgcccctggtcactctcgttcccaccctcctctacgtcgtatctgagcgggctggcaaggcncatacgnnnnnnnnnnnnnn

SEQ ID NO: 285235 - DNA, 634 bp, Homo sapiens
  misc_feature: GYAE6OF01BKNES.12.78.H01.1.454.CMB.1.raw
  modified_base (356)..(356): a, c, t, g, unknown or other
  misc_feature (356)..(356): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgagttggggancgacgtggtcgacccgtgggccagggaaccctggtccaccgtctcctcacgcctccaccgaacgggccccacgtccggtcccttcccccgtcggccctacccctccctaccaacggacgtcccaacccgttcggtcgggggaccaccggaccggccggtacccccgtggggcccttcggccccgttgggtacccaaacgggtaccttacccgtttcccgtacggttaccggttactccgtaggacggtccgggccgttagggccgaagggccgtaacg

SEQ ID NO: 285236 - DNA, 595 bp, Homo sapiens
  misc_feature: GYAE6OF01AH0JP.12.78.H01.1.454.CMB.1.raw
  modified_base (354)..(354): a, c, t, g, unknown or other
  misc_feature (354)..(354): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgctacgattggggancgactggttcgaccctgggccagggaaccctggtccaccgtctcctcacgcctccaccaacgggccccactccggtccttcccccgtcggcctaccccgtccctcccaacgacgaccacccgtcgtcgggggccacgacggccggcccgtcggggcctcggcccgtcggtccgaaacggaccttaccgttcccttaccggtccgtactccgtgacggtcgggtcgtcggcgaagggcgacg

SEQ ID NO: 285237 - DNA, 563 bp, Homo sapiens
  misc_feature: GYAE6OF01AZVLS.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccgtggggccagggaaccctggtcaccgtctcctcacgcctccaccaacgggccccatcggtccttcccccgtcgggccacccctcctcccaagacgccaccctcgtcgggggcacgacgccggcccgtgggcctcgccgtggtccgaaggactaccgttcctacgtcgtctctgacgcgggctggcaggcgacg

SEQ ID NO: 285238 - DNA, 304 bp, Homo sapiens
  misc_feature: GYAE6OF01CRPOD.12.78.H01.1.454.CMB.1.raw
  modified_base (301)..(304): a, c, t, g, unknown or other
  misc_feature (301)..(304): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctcgccccctcggtcactctcgttcccaccctcctctacgtcgtatctgagcgggctggcaaggcgcatagnnnn

SEQ ID NO: 285239 - DNA, 173 bp, Homo sapiens
  misc_feature: GYAE6OF01B0Q6I.12.78.H01.1.454.CMB.1.raw
  modified_base (172)..(173): a, c, t, g, unknown or other
  misc_feature (172)..(173): n is a, c, g, or t
tcagatacgacgtacacgaccggtgctcgatttagtgtgagtagtttgggtttgggggaagaggaagactgacggtcccccaggagttcaggtgctgggcacagcggccctgggctgcctggtcaaggactacttcctacgtcgttctgagcgggctggcaaggcgcatagnn

SEQ ID NO: 285240 - DNA, 543 bp, Homo sapiens
  misc_feature: GYAE6OF01BOOB3.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggtcgacccctggggccagggaaccctggtcaccgtctcctcagcctccaccaagggcccatcggtcttccccctggccaccctcctccaacgagcacctcgtgggggccacacgccggccctgggcctgcctggtcaaggactacttcctacgtcgtatctgagcgggctggcaaggcgacg

SEQ ID NO: 285241 - DNA, 619 bp, Homo sapiens
  misc_feature: GYAE6OF01EN5EO.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattccaaagaacacgctgtatttgcatatgaacagcctgagagccgaggacacggccgtatatactgtgcgaagcttagcggttaccggctacgagttggggagcgacgtcggtcgaccccgtggggccacgggaaccctggtaccaccgtctcctcacgccctaccaccgaacgggcccctacgtccggttcccttcccccgtcgtaccctacccctccctacccgaacgacgacacccgtcgtccggggaccaccgacgtcccggcccgtgggtcctcggcccgtcggtaccgaaacggtacccttaccgttcccgttaccgttcgtacgtcgtcgacggtccgggactcgggacgacggcgtacg

SEQ ID NO: 285242 - DNA, 573 bp, Homo sapiens
  misc_feature: GYAE6OF01CJGRR.12.78.H01.1.454.CMB.1.raw
  modified_base (234)..(234): a, c, t, g, unknown or other
  misc_feature (234)..(234): n is a, c, g, or t
  modified_base (352)..(352): a, c, t, g, unknown or other
  misc_feature (352)..(352): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaaggccgttnagcatctcagagacaatccaagacacgctgtatttgcatatgaacagcctgagtagccgaggacacggccgtatattacgtgtgacgaagcttagcggttaccgctacgattggggancgactggtcacccgtgggccagggaaccctggtccacgtctctcacgcctccacacggcccagtcggtcttcccctgcctaccctcctccaagcgccaccgtcgtcggggaccacgacgtccggcccgtgggcctcggccgtggtacgtaacggaccttaccgttcccgtacgtcgttacgtccgtaggacggtccgggtctagggcctaagggccgtacg

SEQ ID NO: 285243 - DNA, 555 bp, Homo sapiens
  misc_feature: GYAE6OF01C8TDZ.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaagggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgctacgattggggagcgactggttcgacccctggggccagggaaccctggtcaccgtctcctcacgcctaccaccaagggccccatccggtcttccccctcggccaccctcctccaagacgcacctctgggggccacgacggccggccctgggcctgccctggtcaaggacctacgttcctacgtcgtatccgtgacgcgggctggcaggcgacg

SEQ ID NO: 285244 - DNA, 461 bp, Homo sapiens
  misc_feature: GYAE6OF01CBOUM.12.78.H01.1.454.CMB.1.raw
  modified_base (448)..(461): a, c, t, g, unknown or other
  misc_feature (448)..(461): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaaccggcccccaaactcctcatctatagtaataatcagcgaccctcaggggtcccctgaccgattctctggctccaagtctggcacctcagcctcctggccatcagtggctccagtctgaggatgaggctgattattactgtgcagcaagtgggatgacagcctagaatggtccggtatcgggcggagggaccaagctcgaccgtccgtaggtcacgacccgaaggctcgccccctcggtcactcctcgttccccgccctcctctaccgtcgtatctgacgcggctggacaggtcgcatagnnnnnnnnnnnnnn

SEQ ID NO: 285245 - DNA, 299 bp, Homo sapiens
  misc_feature: GYAE6OF01AMW60.12.78.H01.1.454.CMB.1.raw
  modified_base (298)..(299): a, c, t, g, unknown or other
  misc_feature (298)..(299): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtatctgagcgggctggcaaggcgcatagnn

SEQ ID NO: 285246 - DNA, 564 bp, Homo sapiens
  misc_feature: GYAE6OF01BFLF8.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggacacggccgtatattactgtgcgaagcttagcggttaccggctacgattggggagcgactggtcgaccctggggccagggaaccctggtccacccgtctccctcacgcctccaccaacgggccccagtccggtccttcccccgtcggccaccctccctccaacgacgccacctcgtcggggccacgacgccggccctgggcctgccctggtccaaacggaccttacttcctacgtcgtactctgacgtcggctggcaggcgac

SEQ ID NO: 285247 - DNA, 299 bp, Homo sapiens
  misc_feature: GYAE6OF01A74Q2.12.78.H01.1.454.CMB.1.raw
  modified_base (296)..(299): a, c, t, g, unknown or other
  misc_feature (296)..(299): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctgttcccacctcctctacgtcgtatctgagcgggctggcaaggcgcatagnnnn

SEQ ID NO: 285248 - DNA, 407 bp, Homo sapiens
  misc_feature: GYAE6OF01D4FTE.12.78.H01.1.454.CMB.1.raw
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (340)..(341): a, c, t, g, unknown or other
  misc_feature (340)..(341): n is a, c, g, or t
  modified_base (343)..(407): a, c, t, g, unknown or other
  misc_feature (343)..(407): n is a, c, g, or t
tcagatacgacgtacacgaccggtgctcgatttagtgtgagtagtttgggtttggggggtgtggtggtctccactcccgccttgacggggctgctatctgccctccctggccatcagtgggctccagtctgaggatgaggctgattattactgtgcatcatgggctgaccaccctgactggtccgggagtgttcggcggagggaccaagctgacccgtcctaggtcacgcccaaggccacgccccctggtcactctcgttccccaccctcctactacgtcgtatctggagccgggctggacgaaggcgacatagnancngctncgatcagctgcctgctnngnnnnnnnnnnnnnnnnnnnnnnnnnnnnnnnnnnnnnnnnnnnnnnnnnnnnnnnnnnnnnnnnn

SEQ ID NO: 285249 - DNA, 595 bp, Homo sapiens
  misc_feature: GYAE6OF01BU0L1.12.78.H01.1.454.CMB.1.raw
  modified_base (403)..(403): a, c, t, g, unknown or other
  misc_feature (403)..(403): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgctacgagttggggagcgactggtccgacccgtgggccagggaaccctggtcaccgtctcctcncgcctccaccgaacgggccccagtccggtaccttcccccgtgggcccacccctccctaccgaacgacgccacccgtcgtcggggccacgacggccggcccgtgggcctcggcccgttcgggtaccaacgggtaccttaccgttccgtacgttccgttatccgtggacggtcgggtctaggcaagggcgtacg

SEQ ID NO: 285250 - DNA, 181 bp, Homo sapiens
  misc_feature: GYAE6OF01BENYH.12.78.H01.1.454.CMB.1.raw
  modified_base (174)..(181): a, c, t, g, unknown or other
  misc_feature (174)..(181): n is a, c, g, or t
tcagatacgacgtacacgaccggtgctcgatttagtgtgagtagtttgggtttgggggaagaggaagactgacggtccccccaggagttcaggtgctgggcacagcggccctgggctgcctggtcaaggactacttcctacgtcgtatctgagcgggctggcaaggcgcatagnnnnnnnn

SEQ ID NO: 285251 - DNA, 702 bp, Homo sapiens
  misc_feature: GYAE6OF01C5H47.12.78.H01.1.454.CMB.1.raw
  modified_base (377)..(377): a, c, t, g, unknown or other
  misc_feature (377)..(377): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccgaggctccagtgagggctggagtgggtctcaggttattagtggtagtggtggtagcagatactacgcagacgtccggtagaacggggccgttcagcatcctaccagacgacaattccaagaacacgtctgttatttgacattatagaacagctgagacgccggaggacgacggtcgtatagttcgtagtgacgaagtcttagcgggttaccgcgtacggtagttggggancgtacgtcggtttaccgaccccggtggggacccacgggtaaccctggtccctaccgtcctcctaccgacgtccctaccgaccgaacgggcccctagttcccggtcccttcccccgtggaccctacccccttcctacccgaacggacgccctaacccggtcggtaccgggggacctaaccgacgggtccccgggacccggttacggggcccttcggacccgttacgggtaaccgaaccgggtacctttacccgttcccgttaaccggttacggttactccggttggacgggtccgggtacgttaggggaccgaagggtccgtaacg

SEQ ID NO: 285252 - DNA, 589 bp, Homo sapiens
  misc_feature: GYAE6OF01EG8S5.12.78.H01.1.454.CMB.1.raw
  modified_base (571)..(573): a, c, t, g, unknown or other
  misc_feature (571)..(573): n is a, c, g, or t
  modified_base (575)..(579): a, c, t, g, unknown or other
  misc_feature (575)..(579): n is a, c, g, or t
  modified_base (581)..(589): a, c, t, g, unknown or other
  misc_feature (581)..(589): n is a, c, g, or t
tcagatacgacgtacacgaccggtgctcgatttagtgtgagtagtttgggtttggggggaagaggaagactgacggtcccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttccgaccccgtggggccagggaaccctggtcaccgtctcctcacgcctaccaccgaacgggccccagtccggtccttccccccgtggcccacccctcctcccaagacgccacccgtcgtcgggggccacgacgccggccccgtgggcctcggcccgtggtaccgaacggtaccttacgttcccgtacgttccgtacttcgtggacggccggggcgttcgggacgtaaacgggccgaccgaagtacgcgnnngnnnnngnnnnnnnnn

SEQ ID NO: 285253 - DNA, 438 bp, Homo sapiens
  misc_feature: GYAE6OF01DJWSD.12.78.H01.1.454.CMB.1.raw
  modified_base (390)..(390): a, c, t, g, unknown or other
  misc_feature (390)..(390): n is a, c, g, or t
  modified_base (427)..(427): a, c, t, g, unknown or other
  misc_feature (427)..(427): n is a, c, g, or t
  modified_base (432)..(438): a, c, t, g, unknown or other
  misc_feature (432)..(438): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccgtattcggcggaggaccaagctgaccgtctaggtcagcccaaggctcgccccgtcggtcactctcgttccccnccctcctctacgtcgtatctgacgcggctggcaggcncatgnnnnnnn

SEQ ID NO: 285254 - DNA, 811 bp, Homo sapiens
  misc_feature: GYAE6OF01DV612.12.78.H01.1.454.CMB.1.raw
  modified_base (357)..(357): a, c, t, g, unknown or other
  misc_feature (357)..(357): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaacgggccgttcagcatctccagagacaattccaagaacacgctgtatttgactatatgaacagcctgagagccgagacacggccgtatatactgtgagaagcttagcggttaccgctacgagttgggggacncggtacgttcgggttaccgaccccggtggggaccgacgggtaaccccttgggtcctaacccggttccttccctcgtaaccgtcccgtacccgtaacccgaaaccggggcccctaacgttccggttccctttaccccccgtcgggtacccctacccccgttccccgttacccgaaacggtaccgtacccgtaaccccgttccgggtaccgggggggaccctaacccggtaaccgggtaccccggggtcccccggttacgggggtcccgttccgggtaaccccggttccggggttaacccgaaaaccggggttaaccccgtttaacccggttttacccccgttaacccgggtttaccccggtttaaccgtttacccggttacggggaaacccgggttccccgggggtacccgtttaccgggggaacccggtaaaccggggtcccggtaaacccggg

SEQ ID NO: 285255 - DNA, 594 bp, Homo sapiens
  misc_feature: GYAE6OF01B83F7.12.78.H01.1.454.CMB.1.raw
tcagatacgacgtacacgaccggtgctcgatttagtgtgagtagtttgggtttgggggaggcttggtacagcctggggggtccctgagactctcctgtacaacctctggattcatgtttagtagtcattggatgaactgggtccgccaggctccagggaaggggctgggagtgggtggccaaacataaaagcaagatggaagtgagaaatactatgtggactctgtgaagggccattcaacaatctccagagacaacgccaaagaactcactgtatctgacaaaataaacagcctagaaagccgaggacacggctgtgtatttctgtgcgaggacgtctacggtgaactaaatttatacaaaaccagaactaaaagttcgttcgccaaagccgtacacactactttgacagctgggccaggaaccctggtacaccgtctccctcacgcctaccaccaacggcccactcgtccttcccccgtggcctaccctcctaccaacgacgccacctcggtcggggaccacgaggcccggcccgtgggcctcgccgtggtcaaacggtaccttaccttccgtacgtacgtactcgtgacgg

SEQ ID NO: 285256 - DNA, 611 bp, Homo sapiens
  misc_feature: GYAE6OF01AQTHW.12.78.H01.1.454.CMB.1.raw
  modified_base (407)..(407): a, c, t, g, unknown or other
  misc_feature (407)..(407): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggacacggccgtatattactgtgcgaagcttagcggttaccggctacggagttggggagcgactgggttcgaccccgtggggccagggaccctggtccaccgtctccncacgccctccaccacgggccccagtccggtccttcccccgtggcccacccctccctaccgaacgacgccacccgtcgtcggggccaccgacggccggcccgtgggcctcggcccgtcgggtaccaaacgggtacccttaccgttcccgttacggtccgtacgttccgtacgacgggtcgggtcctgggccgaaagggccgtacg

SEQ ID NO: 285257 - DNA, 670 bp, Homo sapiens
  misc_feature: GYAE6OF01EQEHV.12.78.H01.1.454.CMB.1.raw
tcagatacgacgtacacgaccggtgctcgatttagtgtgagtagtttgggtttgggggaggcttggtacagcctggggggtcccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttaggcggttaccggctacggtagttggggagcgacgtggttccgaccccgtggggccacgggaaccctggtccaccgtctcctcacgccctaccaccgaacgggccccagtccggttcccttcccccgtcgggcccctacccctccctacccgaacgacgtacccacccgtcgtcggggggtacccaacggaccgggcccgggtcccgtcggggacctccggtccccgttagggttacccgaaacgggtaacccttaacccgtttcccgttaaccggttccgttacgttccgtacgggaaccggtccggggtccgtagggaccgaaaggggccgtaaaccg

SEQ ID NO: 285258 - DNA, 741 bp, Homo sapiens
  misc_feature: GYAE6OF01BE0TH.12.78.H01.1.454.CMB.1.raw
  modified_base (286)..(286): a, c, t, g, unknown or other
  misc_feature (286)..(286): n is a, c, g, or t
  modified_base (355)..(355): a, c, t, g, unknown or other
  misc_feature (355)..(355): n is a, c, g, or t
tcagatacgacgtacacgaccggtgctcgatttagtgtgagtagtttgggtttgggggaggcgttggtacagccgtgggggtcccgtgagactctcctgtgcagcctctggattcacctttagcaactatgccatgagctgggtccgccaggctccagtgaaggggctggagtgggtctcaggtattagtggtagtggtggtagcagatactacgcagactccgtgaaggccggttcagcatctccagagacaattccaagaacacgctgtattgcatatgaacancctagagagccgaggacacgccgtagtatactgtgcgaagctagcggttaccgcgtacgagttgggacncgtactggttccgacccgtggggaccgacgggtaacccctggtaccgaccgtccgtcctcgacgcccgtacccaaccgaaccgggacccgtaaccgtcccggttcccgtttcccccctcgggacccctacccccgtaccccgttacccgaaccgtaacggcccgtaaccccgtcccgggttaccgggggacccgtaaccgacccgggtacccgggcccccgttacggggtccccggttccggtaccccggttaccggggtacccgtaaaaccggggtaacccgtttaaccccggtttaccccgttaccgggttacccggtttaacgtccccggttaggaacggggtccgggtccgttaccggggccgtaaaccgggccggtaaccg

SEQ ID NO: 285259 - DNA, 626 bp, Homo sapiens
  misc_feature: GYAE6OF01C2R7I.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgagttggggagcgacgtggttccgaccccgtggggcccgagggaccctggtcaccgtctcctcacgccctccaccgaacgggccctacgtccggttcccttcccccgtcgggcccacccctccctacccaacgtacgaccacctcgtcggggccaccgacggcccggcccgtcggggcctcggcccgttcgggtaccgaaacggtaccgttaccgtttacccgtaccggttccggttacttccgtcggacggtccggggcttcggggacaagggccgtacg

SEQ ID NO: 285260 - DNA, 616 bp, Homo sapiens
  misc_feature: GYAE6OF01AMDSD.12.78.H01.1.454.CMB.1.raw
  modified_base (349)..(349): a, c, t, g, unknown or other
  misc_feature (349)..(349): n is a, c, g, or t
  modified_base (358)..(358): a, c, t, g, unknown or other
  misc_feature (358)..(358): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagtagacaattccaaagaacacgctgtatttgcatatgaacagcctgagacgaccgaggacacggccgtatattactgtgcgaagcttagccggttacgctacgngttggggancggacgttcggtccgacccgtggggcccagggtaacccctggtccaccgtctccctcacgcctccgaccgaacgggcccagtccggtccttccccgtcggcctaccctccctaccgaacgcgcctaccgtcgtcggggaccacgtacgccggtcccgtgggtccgtcggtcccgtgggtaccaacggtaccttaccgttaccgtacgttacggtcgttccgtggacggtccgggtacgtaggaccgtacggccgtacg

SEQ ID NO: 285261 - DNA, 298 bp, Homo sapiens
  misc_feature: GYAE6OF01BS03C.12.78.H01.1.454.CMB.1.raw
  modified_base (297)..(298): a, c, t, g, unknown or other
  misc_feature (297)..(298): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctgttcccaccctcctctacgtcgtatctgagcgggctggcaaggcgcatagnn

SEQ ID NO: 285262 - DNA, 628 bp, Homo sapiens
  misc_feature: GYAE6OF01DXBWK.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgcaatgagctgggtccgccaggctccagtgaaggggctggagtgggtctcaggtattagtggtagtggtggtagcagatactacgcagactccgtgaagggccgttcagcatctccagagacaattccaagaacacgctgtatttgcatatgaacagcctgagagccgaggacacggccgtatattactgtgcgaagcttagcggttaccggctacgagttggggagcgacgtggtcgaccccgtggggccagggaaccctggtccaccgtctcctcacgccctccaccgaacgggccccagtccggttcccttccccccgtcgggtcccacccccgtccctacccgaacggacgccacccgtcgtcgggggccacgacggccggcccgtggggcctcggcccgtggtaccgaacgggtacccttaccgtttccccttacgggttccgttacgtccgttagggacgggtccggggacgttgggaccgaacgggcgtacgg

SEQ ID NO: 285263 - DNA, 295 bp, Homo sapiens
  misc_feature: GYAE6OF01DCZWL.12.78.H01.1.454.CMB.1.raw
  modified_base (289)..(289): a, c, t, g, unknown or other
  misc_feature (289)..(289): n is a, c, g, or t
  modified_base (293)..(295): a, c, t, g, unknown or other
  misc_feature (293)..(295): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccgtatcggcggaggaccaagctgaccgtcctaggtcagcccaaggctcgccccctggtcactctcgttccccacctcctctacgtcgtatctgagcggctggcaaggcnatgnnn

SEQ ID NO: 285264 - DNA, 564 bp, Homo sapiens
  misc_feature: GYAE6OF01BBD38.12.78.H01.1.454.CMB.1.raw
  modified_base (551)..(564): a, c, t, g, unknown or other
  misc_feature (551)..(564): n is a, c, g, or t
tcagatacgacgtacacgaccggtgctcgatttagtgtgagtagtttgggtttggggggaagaggaagactgacggtcccccaggagttcaggtgctgggtccgccaggctccagtgaaggggctggagtgggtctcaggtattagtggtagtggtggtagcagatactacgcagactccgtgaagggccggttcagcatctccagagacaatccaagaacacgctgtatttgcatatgaacagcctgagagccgaggacacggccgtatattactgtgcgaagcttagcggttaccggctacgattggggagcgactggttcgaccccgtggggccagggaaccctggtcaccgtctcctcacgcctccaccgaacgggccccagtccggtccctttcccccgtggccctaccccctcctacccaaacgacgaccaccctcgtcgggggccacgacggccggccccgtgggcctgcccgtggtacgaacggacctaccgttacctacggtcgttatcgtgacggtcgggcgtggcgaaggcgacatacgnnnnnnnnnnnnnn

SEQ ID NO: 285265 - DNA, 608 bp, Homo sapiens
  misc_feature: GYAE6OF01EPG88.12.78.H01.1.454.CMB.1.raw
tcagatacgacgtacacgaccggtgctcgatttagtgtgagtagtttgggtttgggggaggcttggtacagcctgggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattccaagaacacgctgtatttgcatatgaacagcctgagagccgaggacacggccgtatattactgtgcgaagcttagcggttacggctacgagttggggagcgacgtggttcgaccccgtggggccacgggaaccctggtcaccgtctcctcacgccctccaccgaacggcccactcggtccttcccctcggccacccctcctaccaacgcgaccaccgtcgcggggcaccgacgccggtccccgtgggcctcggcccgtggtaccgaaacgggtaccttaaccgttcccttacggttacgttacgttccgtacggacggtccgggggcttagggaccgaagggccggtaaccg

SEQ ID NO: 285266 - DNA, 471 bp, Homo sapiens
  misc_feature: GYAE6OF01BBM9N.12.78.H01.1.454.CMB.1.raw
  modified_base (322)..(322): a, c, t, g, unknown or other
  misc_feature (322)..(322): n is a, c, g, or t
  modified_base (448)..(471): a, c, t, g, unknown or other
  misc_feature (448)..(471): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaaccggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtnttcgggcggacgggaccagcgtggaccgtccgtaggtcacgcccgaagctcgccccctggtcactctcgtccccacctcctctacgtcgtatcgtgacggtcggctggactacgggcgacatagcnnnnnnnnnnnnnnnnnnnnnnnn

SEQ ID NO: 285267 - DNA, 446 bp, Homo sapiens
  misc_feature: GYAE6OF01EBDM7.12.78.H01.1.454.CMB.1.raw
  modified_base (434)..(446): a, c, t, g, unknown or other
  misc_feature (434)..(446): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctcgccccctggtcactctcgttcccgcctcctctacgtctactctgacgcgggctggcaggcgcatagnnnnnnnnnnnnn

SEQ ID NO: 285268 - DNA, 633 bp, Homo sapiens
  misc_feature: GYAE6OF01EDRL6.12.78.H01.1.454.CMB.1.raw
  modified_base (602)..(602): a, c, t, g, unknown or other
  misc_feature (602)..(602): n is a, c, g, or t
  modified_base (604)..(608): a, c, t, g, unknown or other
  misc_feature (604)..(608): n is a, c, g, or t
  modified_base (610)..(633): a, c, t, g, unknown or other
  misc_feature (610)..(633): n is a, c, g, or t
tcagatacgacgtacacgaccggtgctcgatttagtgtgagtagtttgggtttggggacccccgggcaggagggtcaccatctcttgttctggaagcagcctccaacatcggaagtaatactgtaaactggtacccagcagctccccaggaaccggcccccaaactcctcatctatagtaataatcagccgaccctcgacggggtccctgacccgattctctggcctccaagtctggccacctcacgccctccctggccatcaggtgggcctccagtctgaggatggaggctgtattattactgtgcagcagtggggatagaccagtccgtagtaacgttcggggttacccggttagttccggggacgggaacgggacccaaggccgtacggaacccgttccgtaacggtcccgaacggaccccgtaagggtcccttaccggttccccccgtacgggtccctaaccgttcccgtttcccgttaccccccctacccccgttcccttaccggttacccggttacccgtaacgttcccgttacggggaccgggtcccggggtaccgttacggggaccgtaaaccggggcccgaacgttaagaggncnnnnncnnnnnnnnnnnnnnnnnnnnnnnn

SEQ ID NO: 285269 - DNA, 467 bp, Homo sapiens
  misc_feature: GYAE6OF01A8CUC.12.78.H01.1.454.CMB.1.raw
  modified_base (401)..(401): a, c, t, g, unknown or other
  misc_feature (401)..(401): n is a, c, g, or t
  modified_base (434)..(434): a, c, t, g, unknown or other
  misc_feature (434)..(434): n is a, c, g, or t
  modified_base (443)..(467): a, c, t, g, unknown or other
  misc_feature (443)..(467): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctcctgccatcagtgggctcagtctgaggatgagctgattattctgtgcatcagtggctgacacctgacgtggtccggagttgtcggcggaggacaagctgaccgtctaggtcacgcccgagccacgccctgtcactcgtcgttccccaccttcctcgtaccgtntactctcggacgcggtcgcggacgaacggccgntaacgtgcnnnnnnnnnnnnnnnnnnnnnnnnn

SEQ ID NO: 285270 - DNA, 592 bp, Homo sapiens
  misc_feature: GYAE6OF01EK4W9.12.78.H01.1.454.CMB.1.raw
  modified_base (145)..(145): a, c, t, g, unknown or other
  misc_feature (145)..(145): n is a, c, g, or t
  modified_base (353)..(353): a, c, t, g, unknown or other
  misc_feature (353)..(353): n is a, c, g, or t
  modified_base (398)..(398): a, c, t, g, unknown or other
  misc_feature (398)..(398): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccnccaggctccagtgaaggggctggagtgggtctcaggtattagtggtagtggtggtagcagatactacgcagactccgtgaagggccgttcagcatctccagagacaattccaagaacacgctgtatttgcatatgaacagcctgagagccgaggacacggccgtatactactgtgcgaagcttagcggtaccgctacgagttggggancgactggtcgacccgtgggccagggaccctggcaccgtctcctcncgcctccaccacgggccccagtccggtccttcccccgtgccctacccctcctaccaacgacgccaccgtcgtcggggccaccgacgcccggacccgtgggcctcggtcccgtcgggtaccgaaacggtaccttaccgttcccgtacggttacgtacgtcctggacggtccgggcgtcgggacgaaggcgtaccg

SEQ ID NO: 285271 - DNA, 460 bp, Homo sapiens
  misc_feature: GYAE6OF01ACMZ8.12.78.H01.1.454.CMB.1.raw
  modified_base (431)..(431): a, c, t, g, unknown or other
  misc_feature (431)..(431): n is a, c, g, or t
  modified_base (433)..(460): a, c, t, g, unknown or other
  misc_feature (433)..(460): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaaggggtccctgaccgattctctggctccaagtctggcacctcgagcctccctggccatcagtggctccagtctgagatgagctgattatactgtgcagcatggatgacagctgatggtccgtatcggcgagggaccagctgaccgtcaggtcagcccaaggctcgcccctgtcactcgtcgtcccaccctctctacgtctactcgtggacgtcgggactcgggcaaggcctcagtacgncnnnnnnnnnnnnnnnnnnnnnnnnnnnn

SEQ ID NO: 285272 - DNA, 452 bp, Homo sapiens
  misc_feature: GYAE6OF01AN7H2.12.78.H01.1.454.CMB.1.raw
  modified_base (439)..(452): a, c, t, g, unknown or other
  misc_feature (439)..(452): n is a, c, g, or t
tcagatacgacgtacacgaccggtgctcgatttagtgtgagtagtttgggtttggggacccccgggcagagggtcaccatctcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtccaggtcagcccaaggcacgcccctggtcactctcgttcccgccctcctctacgtcgtactcctgacgcggctggcaacggcgcatagnnnnnnnnnnnnnn

SEQ ID NO: 285273 - DNA, 643 bp, Homo sapiens
  misc_feature: GYAE6OF01AYNW6.12.78.H01.1.454.CMB.1.raw
tcagatacgacgtacacgaccggtgctcgatttagtgtgagtagtttgggtttggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgagacacggccgtatattactgtgacgaagtcgttaggccggttaaccggctacggagttggggacgcgacgttcggttccgacccgtggggacccacgggaaccctggccaccgtctcctcacgtccctaccaaccgacgggacccctacgtcccggtcccttcccccgtcggaccctaccccgtccctacccgaacgacgtaccctaccgtcggtcgggggaccaccgacggtcccgggtcccgtacggggcctacggtcccgttcgggtaccgacgggtaccttacgttcccgtacgttcgtacgttcgtggacggtacgggcgtaggaccgtaaggccgtaacg

SEQ ID NO: 285274 - DNA, 304 bp, Homo sapiens
  misc_feature: GYAE6OF01D3Z79.12.78.H01.1.454.CMB.1.raw
  modified_base (296)..(304): a, c, t, g, unknown or other
  misc_feature (296)..(304): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcagtgggatgacagcctgaatggtccgtattcggcggagggaccaagctgaccgtcctaggtcagcccaaggctcgcccctcggtcactctgtcccacctcctctacgtcgtatctgagcggctggcaaggcgcatagnnnnnnnnn

SEQ ID NO: 285275 - DNA, 612 bp, Homo sapiens
  misc_feature: GYAE6OF01A9J3F.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggacacggccgtatattactgtgcgaagcttagcggttaccggctacgagttggggagcgactggttccgaccccgtgggcccagggaaccctggtcaccgtctcctcacgcctaccaccgaacgggccccacgtccgtccttcccccgtcggcccaccctccctaccaacgacgccacccgtcgtcgggggccaccgacggcccggcccgtcgggccgtcgtcccgtggtaccgaaacggtaccttaacccgttcccgtaccgttccgttacgtccgtggacggtccgggcgtacggccgaagggccgtacg

SEQ ID NO: 285276 - DNA, 636 bp, Homo sapiens
  misc_feature: GYAE6OF01DUV2U.12.78.H01.1.454.CMB.1.raw
  modified_base (167)..(167): a, c, t, g, unknown or other
  misc_feature (167)..(167): n is a, c, g, or t
  modified_base (176)..(176): a, c, t, g, unknown or other
  misc_feature (176)..(176): n is a, c, g, or t
  modified_base (209)..(209): a, c, t, g, unknown or other
  misc_feature (209)..(209): n is a, c, g, or t
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (541)..(541): a, c, t, g, unknown or other
  misc_feature (541)..(541): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
  modified_base (578)..(578): a, c, t, g, unknown or other
  misc_feature (578)..(578): n is a, c, g, or t
tcagatacgacgtacacgaccggtgctcgatttagtgtgagtagtttgggtttgggaccccgggcaggagggtcaccgatctcttgttctggaagcagctccaacatcggatataagttctgtagtacttggtaccagcagcttccaggacgcggcccccgatcctnatctttaanaacagtcagccggcctgagggtccctgaccgtnttcnctggctcagtctggcacctnagtccctccgtggcctatcgagtggactcgagtctagaggtcttggacggtctagactttatactgtgcatcgagtggactgacctctgacgtgggtacggagtcggtccgggacggacggtaaccaggtcctacggtacccgtcgtaggtcctacgcccgtaaggccctacccggtcccccgtgggtacctaccttccgttacccgttcccctacccgttcctaccgtaccgttaccgtacgtacccggttaggaccggtcgggcgttacccgggacgtaacgggcccgtataacgttgactccgtncgaancggtnacgtagtccgttgtcgtacgttccggngtcgactcgtgtcgccgttagccgagtacgacggtccgtacgtcgaaccgtctcgtac

SEQ ID NO: 285277 - DNA, 642 bp, Homo sapiens
  misc_feature: GYAE6OF01B99QV.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattaccaagaacacgctgttatttgcatatgaacagcctgagagccgaggacacggcctatattactgtgacgaagtcttagcggttaccggctacgtagtggggacgcgtacgtcggttaccgacccggtggggccgaacgggtaaccctggtaccaccgtctcctcgacgccctaccgaccgaacggaccccacgttcccggtcccttcccccgtcggccctacccctccctacccgaacgacgtcccacccgttcggccgggggaccaccggacggtcccggcccggtcgggctcggtccgtacggtacgtaaccggtaccttaccgttcccgttacggttacgttctcgtacggacgggtccgggacggtaggaccgagggcgtacg

SEQ ID NO: 285278 - DNA, 689 bp, Homo sapiens
  misc_feature: GYAE6OF01BTGTB.12.78.H01.1.454.CMB.1.raw
tcagatacgacgtacacgaccggtgctcgatttagtgtgagtagtttgggtttgggggaggcttggtacagcctggggggtccctgagactcgcctgtgttgcctctggatttcccttcaatttctattccatgcactgggtccgccaggctccaggcaaggggctcgagtgggtggcacttattgcacatgatggcgtcaaacaaattctacgcaaattccgtgaggggccattcaccatctccagagacaattacaagaacaccctttatctgcaaatagacagcctgagaccagacgacacggctgtctattatgcgcgagagagacacacgaacctactcggaccaatactagtgggggtacttggttcgtcgggggccagggggtaccccttggtacacgtccgtctcccccgagtcccctcccaacccgaacgggccccaacgttccgggttcccctttacccccgtgggtcccgccccgttcgcccgttacccgaaggccgtcccacccgttcccggaacgtacggacccgacgaccggtccggccccgtaggggccttccggccggttaccggtcccgaaaacggtacccgttaacccgtttcccgttaacccgggttccgttacgtcccgttacgggtacgggcccggggtaccgtcggggacccgaaaggggtccccgg

SEQ ID NO: 285279 - DNA, 603 bp, Homo sapiens
  misc_feature: GYAE6OF01EP7RL.12.78.H01.1.454.CMB.1.raw
  modified_base (457)..(457): a, c, t, g, unknown or other
  misc_feature (457)..(457): n is a, c, g, or t
  modified_base (481)..(481): a, c, t, g, unknown or other
  misc_feature (481)..(481): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaatccaagacacgctgtatttgcatatgaacagcctgagacgccgaggacacgggccgtaatattactgtcgcgaagcgttaggtccggttacccggctacggtagttggggagcgtacgtggttccgacccgtgggccacgggaccctggtccaccgtctcctcacgccctccgaccgacgggtccccagtccggtccttcccccnggaccctacccgtccctccaagcnccgacctacggtcggggccaaccgcgcccggccgtcgggcctcgtaccgtggtaccgaacggtaccttaccgttccttacgtcgtactccgtggacggcggccgttaggacgtaggcgtacg

SEQ ID NO: 285280 - DNA, 724 bp, Homo sapiens
  misc_feature: GYAE6OF01CDW26.12.78.H01.1.454.CMB.1.raw
  modified_base (235)..(235): a, c, t, g, unknown or other
  misc_feature (235)..(235): n is a, c, g, or t
  modified_base (303)..(303): a, c, t, g, unknown or other
  misc_feature (303)..(303): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttnagcatctccagagacaattccaaagacacgctgtatttgcatatgaacagcctgagacgccgaggacncggccgtatattactgtgcgaagtcttaggccggttaccggctacggagttgggggagtcggacttcgggttccgaccccggtggggacccgacggggtaaccccttgggtccctacccggttcttccctaccgacgtccctacccgaacccgaacggggaccccctacgttcccggttaccccttccccccgtcgggacccctacccccgttccctacccaacggccgtacccgtaacccgttccggtcgggggaccctaaccggaccgggtcccgggtccccggttcggggcccgttacggtcccggttccgggtacccgtaaacgggttacccttaacccgtttcccgttaccggtttaccgttacgttccgttagggacgggtccggggtactaggggacccgaacgggccgtaacg

SEQ ID NO: 285281 - DNA, 587 bp, Homo sapiens
  misc_feature: GYAE6OF01BG6XN.12.78.H01.1.454.CMB.1.raw
  modified_base (568)..(568): a, c, t, g, unknown or other
  misc_feature (568)..(568): n is a, c, g, or t
  modified_base (572)..(572): a, c, t, g, unknown or other
  misc_feature (572)..(572): n is a, c, g, or t
  modified_base (576)..(579): a, c, t, g, unknown or other
  misc_feature (576)..(579): n is a, c, g, or t
  modified_base (581)..(587): a, c, t, g, unknown or other
  misc_feature (581)..(587): n is a, c, g, or t
tcagatacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccgtgggccagggaaccctggtcaccgtctcctcacgcctccaccacggcccacgtcgtccttccccctgccacccctcctccaacgacgccacctcgtggggcacgacgccggccccgtgggctcgtcccgtggtaccaacgggtaccttaccgtttccctaccggttccgttacttccgtggacgggtccggggcgttacgggaccgtaacggggcccgacgtaacgttacggctagncgancgtnnnncnnnnnnn

SEQ ID NO: 285282 - DNA, 299 bp, Homo sapiens
  misc_feature: GYAE6OF01EVKUY.12.78.H01.1.454.CMB.1.raw
  modified_base (297)..(299): a, c, t, g, unknown or other
  misc_feature (297)..(299): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacagcctgaatggtccggtattcggcggagggaccaagctgaccgtcctaggtcagcccaaggctcgccccctcggtcactctcgttcccaccctctctacgtcgtatctgagcggctggcaaggcgcatagnnn

SEQ ID NO: 285283 - DNA, 309 bp, Homo sapiens
  misc_feature: GYAE6OF01A1XQZ.12.78.H01.1.454.CMB.1.raw
  modified_base (303)..(309): a, c, t, g, unknown or other
  misc_feature (303)..(309): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcatcatgggctgaccaccctgactggtccgggagtgttcggcggagggaccaagctgaccgtcctaggtcagcccaaggcacgccccctggtcactctgttccccaccctcctctacgtcgtatctgagcgggctggcaaggcgcatagnnnnnnn

SEQ ID NO: 285284 - DNA, 532 bp, Homo sapiens
  misc_feature: GYAE6OF01A0IUA.12.78.H01.1.454.CMB.1.raw
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (509)..(532): a, c, t, g, unknown or other
  misc_feature (509)..(532): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctccccaggaacggcccccaaactcctcatctatagtaataatcagcgaccctcaggggtccctgaccgattctctggctccaagtctgcactcagcctcctgccatcagtggctcagtctgagntgnggntgattatactgtgcagcagtggatgacagcctagagtgggtccggtagttcgggcggacgggaccaagcttacggacccgtaccgttaggtccgacgtacccgaacgggcctaccggtccccccgtcggtaccctaccgtttccgttcccggttcccccaacccccttcccttaccgttaccggttccgtaacttcgtcgggacggcgggcgtacgggccgtaagggccgacgtatagcnnnnnnnnnnnnnnnnnnnnnnnn

SEQ ID NO: 285285 - DNA, 830 bp, Homo sapiens
  misc_feature: GYAE6OF01AS8UU.12.78.H01.1.454.CMB.1.raw
tcagatacgacgtacacgaccggtgctcgatttagtgtgagtagtttgggtttgggggaggcgttggtacagccgtggggggtccctgagactctcctgtgcagcctctggattccacctttagcaactatgccatggacgcgtggggtcccgccgaggcttccgaggttgggaagggggtctgggaggttgggtcctgtaggttattaggtgggtaggtgggtggtagcgagtacttaccgacgcgacggtaccgtccggtagggaacggggtccggttcaagtctaatcctacgagaacgtaactaacgttacaaacgaacgtcgtcttagttaacttgactaagttagacgaaacgcgtccgaggacgacggaccggtaacggactaccggtattaagttacgtacgtggtacgacggtacgtccggttacggtccgggtttaccggagttaccgggtaggttcggggacgtacccggttaccggttccgggttaccccggaccccgggtggggaacccgtaccgggtacccgtttcggaccctacccggttccctaccgtaccgaccgaccccgttaaccggaaccgggtacccggtaccccgttacggttccccggttcccccgttaccccgtaccgaccccgtaccccttacggaccgaacggtcccgaccgtaccggtcggggaccggaccgaccggcccggtcccgggtccggtaacggtccgtacggaccgttacgggaccgttaaccgttaccttccggttcggtaaccgttgacggttcggacggtacgggtccggtaacgtccggaagtccggcgtaa

SEQ ID NO: 285286 - DNA, 570 bp, Homo sapiens
  misc_feature: GYAE6OF01BNEM5.12.78.H01.1.454.CMB.1.raw
  modified_base (543)..(543): a, c, t, g, unknown or other
  misc_feature (543)..(543): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggtaccgctacgagttggggagcgactggtcgacccgtggggccagggaccctggtcaccgtctcctcacgcctccaccgaacgggccccacgtccggtcccttccccctcgggcccaccctccctccgaacgacgccaccctcgcggggaccacgacggccgcccgtcgggcctcgccgtggtcgaacggacttacttccgtacgtcgtntctggacgcgggctaggcgaggcgacg

SEQ ID NO: 285287 - DNA, 842 bp, Homo sapiens
  misc_feature: GYAE6OF01A9GQE.12.78.H01.1.454.CMB.1.raw
  modified_base (268)..(268): a, c, t, g, unknown or other
  misc_feature (268)..(268): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaacgggccgttcagcatctccagacgactaattaccaaagaacncgctgttatttgcatatgaacagcctgagagccgaggacacggccgtatacttactgtcgacgaagtcgttacggtacgggttaccggactaacggtaggtttagggggagccggtaacgttcggggtttacccggacccccggttcgggggacccaacggggtaaccccgttcggggtaccctacccggttcctcccgttaccgaccgtacccccgttacccgaaccccggtaaaccgggggtcccccctaacgggttttcccccgggtttacccccgtttttaccccccccggcggggtacccccctaacccccccgtttacccccgttaaccccggtaaaccgggtacccggttacccctaccccgggtttaccgggggtaccggggggtaccccaacccgggtaccgggggtcccccgggccccggttaccggggcccgtccgggtccgttacggggtacccgaaaccgggttacccttacccggtttacccgttaacgggttaccggttacttccgggtacggaccggggtccggggtacgtccgggaccgtaaacggggccgtaacgg

SEQ ID NO: 285288 - DNA, 675 bp, Homo sapiens
  misc_feature: GYAE6OF01CMDNN.12.78.H01.1.454.CMB.1.raw
  modified_base (254)..(254): a, c, t, g, unknown or other
  misc_feature (254)..(254): n is a, c, g, or t
  modified_base (315)..(315): a, c, t, g, unknown or other
  misc_feature (315)..(315): n is a, c, g, or t
  modified_base (388)..(388): a, c, t, g, unknown or other
  misc_feature (388)..(388): n is a, c, g, or t
tcagatacgacgtacacgaccggtgctcgatttagtgtgagtagtttgggtttggggaggcgttggtacagcctgggggtccctgagactctcctgtgcagcctctggattcacctttagcaactatgccatgagctgggtccgccaggcctccagtggaagggctggagtgggtctcaggtattacggtggtagtggtggtagccagactactacgcagacctccggtagaacggggtccgttcaggcatccnccagagactaatccaaagacacgctgtatttgcatatagaacagcctgagagccgaggacncggaccgtatacttactgtgacgaacgtcgtttaacggccggttacccgggctacggtagtttacgggggacncggtacgttcggttcccgaccccggtgggccgaacgggtacccgtggtacccacccggtcctacctcgacgtccctaccgacccgtacgggcccctacgttcccgtccgtttcccccgcgccctacccctacctccgaacgcgccgaccgtcggtcgggccacgacgggtccggccccgtgggcctacggcccgtagggtaccgaaacggtacccttaacccgtttcccgtaccggttacggttaccgtcgtaggtccgcgggtcctagggaccaacggggtccacg

SEQ ID NO: 285289 - DNA, 596 bp, Homo sapiens
  misc_feature: GYAE6OF01EBF8U.12.78.H01.1.454.CMB.1.raw
  modified_base (309)..(309): a, c, t, g, unknown or other
  misc_feature (309)..(309): n is a, c, g, or t
  modified_base (356)..(356): a, c, t, g, unknown or other
  misc_feature (356)..(356): n is a, c, g, or t
  modified_base (566)..(566): a, c, t, g, unknown or other
  misc_feature (566)..(566): n is a, c, g, or t
  modified_base (577)..(578): a, c, t, g, unknown or other
  misc_feature (577)..(578): n is a, c, g, or t
  modified_base (581)..(581): a, c, t, g, unknown or other
  misc_feature (581)..(581): n is a, c, g, or t
  modified_base (583)..(584): a, c, t, g, unknown or other
  misc_feature (583)..(584): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
tcagatacgacgtacacgaccggtgctcgatttagtgtgagtagtttgggtttgggggaagaggaagactgacggtcccccaggagttcaggtgctgggtccgccaggctccagtgaaggggctggagtgggtctcaggtattagtggtagtggtggtagcagatactacgcagactccgtgaaggcgttcagcatctccagagacaattccaagaacacgctgtatttgcatatgaacagcctgagagccgaggacacggccgtatattactgtgcgaagcttagcggttaccgctacgattggggancgactggttcgacccgtggggccagggaccctggtccacgtctcctnacgcctaccaccaagggcccagtccggtccttcccccgtggccctacccgtccctaccgaaagacgcctaccgtcgtcgggggccacgacgccggcccgtgggcctcggcccgttagggtaccgaaaggtaccttaccgttcccgttacgttcgttaacttcgtcgtaacggtccgggcgttcggacgaacgggcggacgtaagtacggntacgcgtgagnngcncnncgnanncngngn

SEQ ID NO: 285290 - DNA, 495 bp, Homo sapiens
  misc_feature: GYAE6OF01AZC0Z.12.78.H01.1.454.CMB.1.raw
  modified_base (478)..(495): a, c, t, g, unknown or other
  misc_feature (478)..(495): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaaccggcccccaaactcctcatctatagtaataatcagcgacctcacggggtccctgaccgattctctggctccaagtctggcacctcacgcctccctggccatcagtggctccagtctgaggatgaggctgtattattactgtgcagcagtggatgacagccgtagagtggtccggtagttcgggcgggtagggacagcgtacgtaccgtccgtaggtcacgacccgaacggtcctccgccccgtcggtccacgtcctccgttccccgccccttcctctaccgtcgttactcgtcggacggccggtcgtcgggacgaacggcgacagtagnnnnnnnnnnnnnnnnnn

SEQ ID NO: 285291 - DNA, 753 bp, Homo sapiens
  misc_feature: GYAE6OF01CPNX0.12.78.H01.1.454.CMB.1.raw
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtagagggccggttcagcatctccagagacaattcaaagaacaacgctgtatttgacatatnaacagcctagagacgccgaggaccacggacctaatatttactgtgacgaagtcttaggaccggttaccggctaccggagttggggancggacgttcggtaccggtaccccgtggggcccgtaacgggaacccgttcggtccaacccggttctcccgtcaccgcccttaccccgaaccgaaccggggccccctaacgttcccgggttacccctttccccccgacgggtcccctaacccccttccccgtaccgtaaccggacgtacccgtaacccgtccggggttacgggggaaccctacccggaaccgggcccgggttcccccgggtcggggtacccgttggaccccggtttagggtaccgaaaaccggggtaaccctttaacccggtttccccgttaacgggttacccgttacgttcccgtagggaccgggtccggggtacgtcgggaacccgtaacgggtcccgaacgg

SEQ ID NO: 285292 - DNA, 668 bp, Homo sapiens
  misc_feature: GYAE6OF01E01XJ.12.78.H01.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagatacgacgtacacgaccggtgctcgatttagtgtgagtagtttgggtttgggggaggcttggtacagcctgggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaaggccggttnagcatcnccagagacaattccaaagaacacgctgtatttgacatatgaacagcctgagagccgaggacacggcctatattactgtacgcgaagtcttaggtccgggttaccgctaacgtagttggggagcgtacgttcggtaccgaccccggtggggacccgaacggggaacccgtggtccaccgtcctcctccgacgtccctacccgaaccgaaccgggacccctaacgttcccggttacccttccccccgtcggaccctacccccgtcccgtacccgaacgacgaccctacccgtcggtcgggggacccaccgacggacccggtcccggtcgggcctcggtccgtcggtaccgaaacggtaccttaccgttcccgtaacgttccgttactccgtacggacggtccgggtagtacggcgaacggccgtacg

SEQ ID NO: 285293 - DNA, 800 bp, Homo sapiens
  misc_feature: GYAE6OF01DX2BV.12.78.H01.1.454.CMB.1.raw
  modified_base (280)..(280): a, c, t, g, unknown or other
  misc_feature (280)..(280): n is a, c, g, or t
  modified_base (313)..(313): a, c, t, g, unknown or other
  misc_feature (313)..(313): n is a, c, g, or t
  modified_base (441)..(441): a, c, t, g, unknown or other
  misc_feature (441)..(441): n is a, c, g, or t
tcagatacgacgtacacgaccggtgctcgatttagtgtgagtagtttgggtttgggggaggcttggtacagccgtggggggtccctgagactctcctgtgcagcctctggattctacctttagcaactatcgccatggagcgtcgggtcccgccaggtcctccgaggtagggaagggggtctgggaggttcgggtctacgtaggttattaggtgggtaggtgggtggtagcgaagtacttacgtacgcacgtaccgtcggtagggaacggggtccgttanagctatccacaggacaactaactacgaaagacncgtcgttagttattcgactaatatacgaactacgccgtagacggacgccggaggaccgaccggtcgtaattacgtagtgacgacgtacgtcgttacggtccgggtacgacgtacggtaggtggggacncggtagtccggtaccgacccgggtgggacccgtaacgggtacccgtcggtaccctaccgttctacccgtcgaccgtaccctaccgaaccggtaccggtcccgtaccgttcccggtccccttaccccggccggtacccctaccccgttacccgtaaccgaaccggacccgtacccgtacccgggtacgggtccgggaaccccgtacgggacccggggacccggttcccgggttcgggcccgttaccgggtaccgttacgggtaacccgttaaccggtacccgtttaacccgtttccgttaacggttaccgttcggccggtacggccgggtaccgggcggtaccggaccggtggccgtacg

SEQ ID NO: 285294 - DNA, 761 bp, Homo sapiens
  misc_feature: GYAE6OF01CBJ1C.12.78.H01.1.454.CMB.1.raw
  modified_base (234)..(234): a, c, t, g, unknown or other
  misc_feature (234)..(234): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactcgtgaagggccgttnagcatctcagagacaattccaagaacacgctgtatttgcatatgaacagcctgagagccgaggacaccggtccgtaatactttacgtgtgacgaagcgtttaaggccgggtttaaccggcctaacggtagtttagggggagaccggtaacgtttcgggtcccgtaaccccggtgggggacccgaacggggaaaccccttgggtacccaaccccggttccttcccgtaccacggtccccgttacccgaaccccggaacgggaccccctaacgttacccgggttcccctttaccccccgtcgggtacccctaccccccttacccgtacccgaaacggaccgtacccgtaacccgttccggtaccggggggacccaccggaaccggtacccgggtccccgtcggggtaccctcgggcccgttcggtacgtaaaccggtaacctttaacccgttacccgttaaccggttacggttaaccgtaccgtacggacggtaccgggtacgtacgggtaccgaagggccgtaaccgg

SEQ ID NO: 285295 - DNA, 305 bp, Homo sapiens
  misc_feature: GYAE6OF01A8K2R.12.78.H01.1.454.CMB.1.raw
  modified_base (303)..(305): a, c, t, g, unknown or other
  misc_feature (303)..(305): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctcgccccctggtcactctcgttcccaccctcctctacgtcgtatcctgagcgggctggcaaggccgcatagcnnn

SEQ ID NO: 285296 - DNA, 593 bp, Homo sapiens
  misc_feature: GYAE6OF01D7SQO.12.78.H01.1.454.CMB.1.raw
  modified_base (358)..(358): a, c, t, g, unknown or other
  misc_feature (358)..(358): n is a, c, g, or t
  modified_base (568)..(568): a, c, t, g, unknown or other
  misc_feature (568)..(568): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtaatatactgtgcgaagcttaacgcggttacggctacgtagttggggancgacgtggttcgaccccgtggggcccgagggaaccctggtccaccgttcctcctcacgccctaccaccaacgggccccaacgtccgtccttcccccccgtggcccaccccgtccctccgaacgacgccacccgtcgtgggggacctaccgacggccggcccgtcgggcctagccctggtaccgaaaggaccttaacgttcctacgtctanccgtgcggcgggctcggcaggcgag

SEQ ID NO: 285297 - DNA, 662 bp, Homo sapiens
  misc_feature: GYAE6OF01ASCU2.12.78.H01.1.454.CMB.1.raw
  modified_base (363)..(363): a, c, t, g, unknown or other
  misc_feature (363)..(363): n is a, c, g, or t
  modified_base (627)..(627): a, c, t, g, unknown or other
  misc_feature (627)..(627): n is a, c, g, or t
  modified_base (635)..(635): a, c, t, g, unknown or other
  misc_feature (635)..(635): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaagggctggagtgggtctcaggtattagtggtagtggtggtagcagatactacgcagactccgtgaagggccggttcagcatctccagagacaatccaagaacacgctgtatttgcatatgaacagcctgagacgccgagacacggccgtaatattacgtgtgacgaagtcgtttagccgggttaccggctacggagttggggancgacgttggttccgaccgtcgggtcgggaccggtaaccggtaccgtcgtacccgtaccgttccctccgtacgacccgtcccgtaaccccgaaccggaccccgggtacctccggtttccccggttacccccttccccggtaccgacccctacccccttccctaaccgaacgtccgtccctacggttccgggacgggcccacggcggcccggtccggcggtctcgtaccggtcgaaccgtaaccgtcttacccgttacttcggtcncgttccgnggtaccggcggcgacgacggcggtacg

SEQ ID NO: 285298 - DNA, 601 bp, Homo sapiens
  misc_feature: GYAE6OF01B9T0D.12.78.H01.1.454.CMB.1.raw
  modified_base (414)..(414): a, c, t, g, unknown or other
  misc_feature (414)..(414): n is a, c, g, or t
  modified_base (588)..(601): a, c, t, g, unknown or other
  misc_feature (588)..(601): n is a, c, g, or t
tcagatacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccggaggacacggccgtatattactgtgcgaagcttagcggttaccgcgtacgagttgggggagcgtacgtggtccgaccccgtggggaccacgggaccctggtccaccgtcctcctcacgccctaccaccgaacgggcccatccggtcccgttcccccnggcccacccctcctacccaacggcgcccacccgtcggcgggggcccaacgcggcccgggccccgtgggcctacggcccgtacgggtaccgaaggtcccttaacccttcccgtaaccggttcgtacgtcgtggtacgggccgggtccgtagggcgtaacgggctaccgatacggnnnnnnnnnnnnnn

SEQ ID NO: 285299 - DNA, 612 bp, Homo sapiens
  misc_feature: GYAE6OF01C7DHF.12.78.H01.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (298)..(298): a, c, t, g, unknown or other
  misc_feature (298)..(298): n is a, c, g, or t
  modified_base (408)..(408): a, c, t, g, unknown or other
  misc_feature (408)..(408): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
  modified_base (553)..(553): a, c, t, g, unknown or other
  misc_feature (553)..(553): n is a, c, g, or t
  modified_base (608)..(608): a, c, t, g, unknown or other
  misc_feature (608)..(608): n is a, c, g, or t
tcagatacgacgtacacgaccggtgctcgatttagtgtgagtagtttgggtttgggggaggcttggtacagccgtggggggtccctgagactctcctgtgcagcctctggattcacctttagcaactatgccatgagcgtgggtccgccaggcctccaggtggaaggggctggagtgggtctcgaggtattaggtggtagtggtggtagcagatactacgcagactccgtgaacgggccgttnagcatcncagagactaatcgaaagaacacgctgttattgnatatagaacacgccngagacgaccggagacgacggtcctattacttacgtggtagacgaagtcgttacggccggttaccgacgtacggaggttggggagcgtacggttggtcccggtaccccggnggggacccgacggggtaacccgtcggtaccgacccgtcgtaccctcgaccgccctacccgaaccgaacgggccctacgtccgttcccttccccgcgaccctaccctcccgtacacgacncaccgtcgngggcacgcgtccgccgnggctcgcgtgacacgcttacgtcctacgtctacgtctgacgtcggcgaggcgagngacg

SEQ ID NO: 285300 - DNA, 349 bp, Homo sapiens
  misc_feature: GYAE6OF01BYG9S.12.78.H01.1.454.CMB.1.raw
  modified_base (338)..(349): a, c, t, g, unknown or other
  misc_feature (338)..(349): n is a, c, g, or t
tcagatacgacgtacacgaccggtgctcgatttagtgtgagtagtttgggtttggggggtgtggtggtctccactcccgccttgacggggctgctatctgccctccctggccatcaggtgggctccagtctgaggatgaggctgattattactgtgcagcagtgggatgacagcctagaagtggtccggttagttcggcggaggaccaagcgtcgaccgtacctaagtcacgcccgaaggcctcgcccccgtcggtccaccttcctccgttaccccacccttcctccttaccgttcgtatcgtggaggcgggcgtggacgaacgggccactagtagcnnnnnnnnnnnn

SEQ ID NO: 285301 - DNA, 618 bp, Homo sapiens
  misc_feature: GYAE6OF01DS8VT.12.78.H01.1.454.CMB.1.raw
  modified_base (162)..(162): a, c, t, g, unknown or other
  misc_feature (162)..(162): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (550)..(550): a, c, t, g, unknown or other
  misc_feature (550)..(550): n is a, c, g, or t
  modified_base (558)..(558): a, c, t, g, unknown or other
  misc_feature (558)..(558): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaaactggtaccagcagctcccaggaacgccccaaatccncatctatagtaataatcagcgacctcaggggtccctgaccgattctctggctccaagtctggcacctcagccctcccgtggccatcgaggtggctccagtctgagatgaggctgatttattactgtgcatcagttgggcctggaccacccgtagaaccgtggggtaccgggtaggttggttaccgggcgggtaacgggaaccaaggcgtaggtaaccgttaccgttaacggccaaggaccccgaaaggtccaaccgtcccccgttaggtacctaaccttcccgtacgttcccccgacccttccctacgttaccggtccgtaatccgtagggacggtaccgggtacgtacgggtacgaaacgggccgtaccaagttaacgnanacgacngacgcganagactagacgtgacgactagtagacagagagtacganananagtanananananangnag

SEQ ID NO: 285302 - DNA, 230 bp, Homo sapiens
  misc_feature: GYAE6OF01CHL5H.12.78.H01.1.454.CMB.1.raw
  modified_base (220)..(220): a, c, t, g, unknown or other
  misc_feature (220)..(220): n is a, c, g, or t
  modified_base (226)..(230): a, c, t, g, unknown or other
  misc_feature (226)..(230): n is a, c, g, or t
tcagatacgacgtacacgaccggtgctcgatttagtgtgagtagtttgggtttggggaggatgaggctgattattactgtgcagcatgggatgacagcctgaatggtccggtattcgacggaggaccaagctgaccgtctaggtcagcccaaggctcgccccctggtcactctcgttcccaccctcctctacgtcgtatctgacgcgggctggcaaggcncatagnnnnn

SEQ ID NO: 285303 - DNA, 642 bp, Homo sapiens
  misc_feature: GYAE6OF01BAH2Q.12.78.H01.1.454.CMB.1.raw
  modified_base (311)..(311): a, c, t, g, unknown or other
  misc_feature (311)..(311): n is a, c, g, or t
  modified_base (605)..(605): a, c, t, g, unknown or other
  misc_feature (605)..(605): n is a, c, g, or t
  modified_base (612)..(642): a, c, t, g, unknown or other
  misc_feature (612)..(642): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaaccggcccccaaactcctcatctatagtaataatcagcgaccctcgaggggtccctgaccgtattctctggctccaagtctggcacctcacgtccctcctggccatcgaggtcgggcctccagtctgaggatggaggtctgtaatttagttactggtagcacgngaggtgggatgaccgacgtccgtagaagttcgggtaccggttacgtcggggaaccgggtaagggacccaaacggtccgtccggtaacccgttccgttacgggtaccacgggaccccgtaaggcccttccccggtcccccgttcggtaaccctcccgtttccggttaccccgttcccccgtccccgtttaccccgtttaccgttacccggtttacccgttaaccgttcccggtagggtaccgggtcccggggtaccgttacgggacccgtaaacggggtcccgtaagtacgtggntccaagnnnnnnnnnnnnnnnnnnnnnnnnnnnnnnn

SEQ ID NO: 285304 - DNA, 706 bp, Homo sapiens
  misc_feature: GYAE6OF01DB9U1.12.78.H01.1.454.CMB.1.raw
  modified_base (329)..(329): a, c, t, g, unknown or other
  misc_feature (329)..(329): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagacctccgtggaacgggccgttcagcatctccgagacgacaattccaagacacgctgtattgcatatgaacagcctggagacgccggaggaccgacggtcgtatacttactggngcgaagtcttaggcggttaccggngtacgagttggggacncgtactggttccgacccgtggggacccgacgggtaacccgtggtccaccgtcctccgtcaacgcccctaccgaccgaaccggggcccctacgttccggttaccccttccccccggtcggtcccctacccccttcccgtacccgaaccggtaccgtacccgaaccccgttcgggtccgggggacctaaccggacccgggcccgggtaccccgggtcggggtacccgttcgggtcccggttacggtaacgaaacccggtccgttacccgtttcccgtacggtttccgtacgttccgtggaccgggtccgggtcgttagggaccgtaacgggcgtaccgg

SEQ ID NO: 285305 - DNA, 685 bp, Homo sapiens
  misc_feature: GYAE6OF01BQQLI.12.78.H01.1.454.CMB.1.raw
  modified_base (486)..(486): a, c, t, g, unknown or other
  misc_feature (486)..(486): n is a, c, g, or t
tcagatacgacgtacacgaccggtgctcgatttagtgtgagtagtttgggtttgggggctttgcctgggctctgctgctcctcactctcctcactcaggacacagggtcctgggcccagtctgccctgactcagcctgcctccgtgtctgggtctcctggacagtcgatcacatctctgcacgtggaccagcagtgatggtggacttataaccttgtatcctaggtaaccaacaaccacccgaggacctaaacgcccccaaatcaatgtactttagtggaaggcaacgtaacgccggtcctcggtagggttttctacgtcgtacttctcgtcgctccggtatcgtacggaccaacgtaccggtccctaccgtagaacctaactcgtacgtcgggtcctaccgaggcgtaggaacggacggagggtacgtaatttagttactgttcgcttacagtagtggtacgggttatacgcgttactttacggnttacgttcgttaacggtccgggacgggacggaaccgtaagtccgtacgtaccccggttcggtacgggtaccaccggttaccgacgggtcctcccggaccccgttcggtaacctccttccggtacccgttaccccaacccgtttccgtaccttaacccggttcgttacctcccggtaggccgggtccggtcggtaccggg

SEQ ID NO: 285306 - DNA, 769 bp, Homo sapiens
  misc_feature: GYAE6OF01AHD1U.12.78.H01.1.454.CMB.1.raw
  modified_base (141)..(141): a, c, t, g, unknown or other
  misc_feature (141)..(141): n is a, c, g, or t
  modified_base (150)..(150): a, c, t, g, unknown or other
  misc_feature (150)..(150): n is a, c, g, or t
tcagatacgacgtacacgaccggtgctcgatttagtgtgagtagtttgggtttgggggaggtcgttggtacagccctggggggtccctgagactctcctgtgcagccgtctggattcacctttagcaacgtatgccatganctgggtccnccaggctccaggtgaaggggctggagtgggtctcaggtattaggtggtagtgggtggtagcagtatactacgcagacgtccgtggaagggtccgttcagcagtcctccagagacaacttcaagaaccacgtctgttattcgactaattatagaacacgccgtagaagacggaccgacggaccgaacggtaccgtattacgttacgtcgtacggacggtaagtcgttacggtaccgggtaccggtacgtaacggtacggttcgggacgcggtacgttccggtttcccggaccccggttggggacccgtaccgggaccgttcggtccctaccggttcctacccgtcgtaccgtccccgtaccgaaccccggcgtaccccgtacgttcccggttaccccgttaccccgccggtaccccttaccccgaccctaccggaaacgtccgacccgttacccggtcgggacgggtaccaccgttaccgggcccggtccggttacggttcccgtccggtacgttaccggaccgttaaccggtacctttaacccgttaccgttaacggtcggttaaccgttcgggtacccggacggggtcccggtcggtaccgggaccagggcctaacgg

SEQ ID NO: 285307 - DNA, 666 bp, Homo sapiens
  misc_feature: GYAE6OF01AFI39.12.78.H01.1.454.CMB.1.raw
  modified_base (242)..(242): a, c, t, g, unknown or other
  misc_feature (242)..(242): n is a, c, g, or t
  modified_base (336)..(336): a, c, t, g, unknown or other
  misc_feature (336)..(336): n is a, c, g, or t
  modified_base (379)..(379): a, c, t, g, unknown or other
  misc_feature (379)..(379): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (510)..(510): a, c, t, g, unknown or other
  misc_feature (510)..(510): n is a, c, g, or t
tcagatacgacgtacacgaccggtgctcgatttagtgtgagtagtttgggtttgggggaggcttggtacagccgtggggggtccccgagactctcctgtgcagcctctggattcacctttagcaactatgccatgagctgggtccgccaggctccagtggaaggggctggagtgggtctcaggtattaggtggtagtgggtgtagcagattacacgcagactccgtaggaacggggccgttnagcatcctccagagacaacttccaaagacacgctgttatttgcaatatacgaacagcctggagcgaccgaggacacggccgtaattagttacgngtgagaagtcttagggcggttaccggctaacggtgtggggacncgacgttcggttccggaccccggtggggacccgacggtacccgtgggtacccnccgttccncctcacgtcctaccacgaccggtcccacgttccgtcccgtcccctcggaccctcccttacccacgacgcnccctacgtccgggacgggccacgtaccgggccggcccggtcgggtcgtccgtaccggtaccggtacgaaacgttacccgtttaaccgtttccgttaacccggttcgttagtccgggttagggccggacgggttcgcgggacggcggtacggctaag

SEQ ID NO: 285308 - DNA, 660 bp, Homo sapiens
  misc_feature: GYAE6OF01D09VF.12.78.H01.1.454.CMB.1.raw
  modified_base (248)..(248): a, c, t, g, unknown or other
  misc_feature (248)..(248): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (359)..(359): a, c, t, g, unknown or other
  misc_feature (359)..(359): n is a, c, g, or t
  modified_base (475)..(475): a, c, t, g, unknown or other
  misc_feature (475)..(475): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccaganacaattccaagaacacgctgttatttgcatatagaacagcctgagagccgaggacacggccgtatattactgtgcgaagtcttaggcggttaccggntacgngttggggancgacgtcggttccgaccccgtggggaccacgggtaaccctggtaccctaccgtccttcctccacgccctccccgaaccgaaccggggcccctacgtcccggtccctttccccccgnggtccctacccctccctaccaacggacgcccaccgtcggtcggggaccacgacgggcccggcccgtgggtcctcggccgtacgggtacctaaccggtacccgttacccgttaccccggttacggttccgttacgttccgtagggtaccggtccgggtacgtagggacccgaagggccgtaaccgg

SEQ ID NO: 285309 - DNA, 304 bp, Homo sapiens
  misc_feature: GYAE6OF01BO0TY.12.78.H01.1.454.CMB.1.raw
  modified_base (301)..(304): a, c, t, g, unknown or other
  misc_feature (301)..(304): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctcgccccctcggtcactctcgttcccgccctcctctacgtcgtatctgagcgggctggcaaggcgcatagnnnn

SEQ ID NO: 285310 - DNA, 592 bp, Homo sapiens
  misc_feature: GYAE6OF01EJNBU.12.78.H01.1.454.CMB.1.raw
  modified_base (235)..(235): a, c, t, g, unknown or other
  misc_feature (235)..(235): n is a, c, g, or t
  modified_base (354)..(354): a, c, t, g, unknown or other
  misc_feature (354)..(354): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactcgtgaagggccggttnagcatctccagagacaattccaaagacacgctgtatttgcatatgaacagcctgagagccgaggacacggccgtatatacgtgtgcgaagcttagcggttaccggctacgattggggancgacgtggtccgacccgtggggccacgggaaccctggtccaccgtctcctcacgcctccgaccgaacgggccccacgtccggtccttcccccgtcggcccgtacccctccctaccaacgacgaccaccgtcgtcgggggaccacgcgaccggcccgtcgggctcgccgtggtacgacggtactaccgtttccgtacgttcgtacgtcgtgacggtcgggctaggctaaggcgtaaccg

SEQ ID NO: 285311 - DNA, 806 bp, Homo sapiens
  misc_feature: GYAE6OF01AXYH0.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaacgggccgttcagcatctccagagactaatccaagacacgctgtattgcatatagaacagccgtagagacggccggaggaccacgggtccgtaatattacgtggtacgacgtaagtcgttaggaccgggtttaccggcttaaccggtaggttcgggggacgaccggtacgttccgggttaccccggacccccggtggggggaccccgtaacgggggtaaccccgttcgggtacccgtaaccccggtttccgtcccgttacgaccggtcccccttacccgaaacccgggtaaccggggtccccctaacggttccccggttccccctttcccccccgtacgggtaccccctaacccccgttccccgtaacccgaacggtacccgtacccgtaaccccgggtttcgggaccgggggtacccaaaccgggtcccggggccccgggtacccggttcggggcccttccggaccccggttgggtaacccgaaacgggttaccccttaacccgtttcccgttaaccggtaccgttacgtccggttaggacgggtcccgggtacggtaggaccggtaagggccgtaacgg

SEQ ID NO: 285312 - DNA, 588 bp, Homo sapiens
  misc_feature: GYAE6OF01B48AH.12.78.H01.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (288)..(288): a, c, t, g, unknown or other
  misc_feature (288)..(288): n is a, c, g, or t
  modified_base (329)..(329): a, c, t, g, unknown or other
  misc_feature (329)..(329): n is a, c, g, or t
  modified_base (423)..(423): a, c, t, g, unknown or other
  misc_feature (423)..(423): n is a, c, g, or t
  modified_base (476)..(476): a, c, t, g, unknown or other
  misc_feature (476)..(476): n is a, c, g, or t
tcagatacgacgtacacgaccggtgctcgatttagtgtgagtagtttggggtttgggggaggcttggtacagcctggggggtccctgagactctcctgtgcagcctctggtattcacctttagcaactatgccatgagctgggtccgccaggctccagtgaaggggctggagtgggtctcaggtattagtggtagtggtggtagcagatactacgcaagactcgtgaagggccgttnagcatcnccagagacaaattccaaagaacacgctgtaatttgacataactnaacagcctgagagccggaagaccaggccgtaatattactgngcgaagtcttagcggttaccgctacgagttggggagcgactggttcgacccgtgggaccaagggaaccctggtccaccgtctcctcgacgcccnccaccgaaggccccaagtccgtccttccccgcggcctacccgtcctacccaanacgcaacctcgtaggggtccacgaggcccgccgtcggctacgccgtggtacaaacggacttaccgttacctacgtacgttatccgtaggacgtcggactaggcaagggcacg

SEQ ID NO: 285313 - DNA, 833 bp, Homo sapiens
  misc_feature: GYAE6OF01ES9FT.12.78.H01.1.454.CMB.1.raw
  modified_base (152)..(152): a, c, t, g, unknown or other
  misc_feature (152)..(152): n is a, c, g, or t
  modified_base (642)..(642): a, c, t, g, unknown or other
  misc_feature (642)..(642): n is a, c, g, or t
  modified_base (649)..(649): a, c, t, g, unknown or other
  misc_feature (649)..(649): n is a, c, g, or t
  modified_base (699)..(699): a, c, t, g, unknown or other
  misc_feature (699)..(699): n is a, c, g, or t
  modified_base (734)..(734): a, c, t, g, unknown or other
  misc_feature (734)..(734): n is a, c, g, or t
  modified_base (810)..(810): a, c, t, g, unknown or other
  misc_feature (810)..(810): n is a, c, g, or t
  modified_base (816)..(816): a, c, t, g, unknown or other
  misc_feature (816)..(816): n is a, c, g, or t
  modified_base (826)..(826): a, c, t, g, unknown or other
  misc_feature (826)..(826): n is a, c, g, or t
  modified_base (830)..(830): a, c, t, g, unknown or other
  misc_feature (830)..(830): n is a, c, g, or t
tcagatacgacgtacacgaccggtgctcgatttagtgtgagtagtttgggtttgggggagcttggtacagccgtggggggtccctgagactctcctgtgcagcctctggattccacctttagctaactatcgcctatgagccgtcgggtccnccgaggtcctccgaggtggaagggtctagggaggttcgggttctacgtaggtttagtttggtgggttagtgggttaggtacgacgaaggtaacttaaccgtaccggacgtacggtaacccgttccgggtaaggggtaaccggggtcccggtttacaaggtacctaaccgttcccgtaaccgaaaggtaaccgtaaccgttaaacttaaccccgaaaaggtaaccgtaccgtcgtttagtttaacgtttacgacctaagttaacgtacgaaacgtcggtccgaaggaaccggtaaccggccccgggtaaggaacccggtaccgggttaaccttaagtttaaccgtttacggtcggtaccggtaacgaacgtttcgggtttacccgggtacccggttaaccggtacgtaacggtaggttcggggaccgcggttaccggtacgggttcccgcccgggtagggacccacgggtaccctggtacccctcgttccnccgtacncccgtaccctaccggcgtaaccggtccctacggttcccctaccgtccccncgacccctaccgtacccgacgtacctcggtacccncggttacggacggcctaccggcgggtccgaccgtcgggtcctcgcggtaagtcgaccgtacttccgtgtacgcggncgggtncgtacgcgangtangac

SEQ ID NO: 285314 - DNA, 711 bp, Homo sapiens
  misc_feature: GYAE6OF01A5BWZ.12.78.H01.1.454.CMB.1.raw
  modified_base (429)..(429): a, c, t, g, unknown or other
  misc_feature (429)..(429): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaacgggccgttcagcatctccagagacaatccaagaacacgctgtattgcatatgaacagcctgagagccgaaggacgacggcgtatattactgtagacgaagtcttaggtaccggttaccggctacgaggttggggacgtcgacgttcggtcccgacccgtcggggccgaacgggtaacccgtggtaccgacccgtctcctacncgtccctacccgaccgtaacgggcccctaacgtccggttccccttccccccggtgggtccccgtccccgtcgtacccgtacccgtacgggacgtaccccgacccgtaccggaaccggaccgtaaccgacccggaccgggccccgggtaccccggtggggtcccctcggtacccggttcgggtaaaccgtaaccgggtaccctttaaccccgttcccgttaccggttaccgttcgttaccggtaggacccgggtccgggtaccgtagggacccggtaaccggg

SEQ ID NO: 285315 - DNA, 1067 bp, Homo sapiens
  misc_feature: GYAE6OF01DAQJN.12.78.H01.1.454.CMB.1.raw
  modified_base (293)..(293): a, c, t, g, unknown or other
  misc_feature (293)..(293): n is a, c, g, or t
tcagatacgacgtacacgaccggtgctcgatttagtgtgagtagtttgggtttgggggaggcgttggtacagccgtggggggtccctgagactctcctgtgcacgcctcgtggtacttctacctttagacaactagtcgccagtgacgtcgtcgggtaccgccgaggtcctaccgaggtagggaacgggggtctgggaggttgggtacctagtaaggttagttagggtggtaggtgggtaggtacgtagagtactacgtcgacgaggtacctcggtaggaacgggtccgttanagtctatccgacgaagaacgtaacctaacgttaaccgaaacgtaacgtaccgttacgtttaacgttacgttacgtaaccgttaacgttaacgtaaaccggtaaccgtacggttaccggtaagggtaaccggggtaaccgggaaccgggtaaaccggaacccggttaaccggttaaccgttaaacgtttaacgttaccggtacgggtaaccggtaacggttaaccggttaacgggtttaccgggtaaccggttaaccgggtaacgggtacggttaacggggttacgggaacggtaccgggttaccgggtttacccggggtaccccgggtaacccgggggtacgggtaacccgggtacccgggttacccggtaccggttaccccgttaacccgttcccgtaacccggtacccgtaacccgtacccggaaaccccgggtaaccggtacccggttaccccgttacccggttaccccggtttaccccgtaccccggtaaccgtaacccccgttacccggtaaaccgaacccggtaaccggttacccgtaaccggttacccggggtacgggtaaccgggtacccgtaacccggggtacccgggtaccccgggtcggttaccggttaccggtaccggttaccgggtaaccgggtaacccggttaacccggttaacccttaccccgggtttaaccggttacggttaccggttaaccgggtaacccgggtcgggtaaccgggtacccggggtaagaaccgggtaaccggtaccggtctaacgg

SEQ ID NO: 285316 - DNA, 578 bp, Homo sapiens
  misc_feature: GYAE6OF01D5KUG.12.78.H01.1.454.CMB.1.raw
  modified_base (274)..(274): a, c, t, g, unknown or other
  misc_feature (274)..(274): n is a, c, g, or t
  modified_base (560)..(560): a, c, t, g, unknown or other
  misc_feature (560)..(560): n is a, c, g, or t
  modified_base (565)..(565): a, c, t, g, unknown or other
  misc_feature (565)..(565): n is a, c, g, or t
  modified_base (568)..(568): a, c, t, g, unknown or other
  misc_feature (568)..(568): n is a, c, g, or t
  modified_base (570)..(574): a, c, t, g, unknown or other
  misc_feature (570)..(574): n is a, c, g, or t
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
tcagatacgacgtacacgaccggtgctcgatttagtgtgagtagtttgggtttgggggaagaggaagactgacggtcccccaggagttcaggtgctgggtccgccaggctccagtgaaggggctggagtgggtctcaggtattagtggtagtggtggtagcagatactacgcagactccgtgaaggccggttcagcatctccagagacaattccaagaacacgctgtatttgcatatgaacagcctgagagccgaggacacggcgtatattacngtgcgaagcttaggcggttaccgctacgagttggggagcgacgttcggtcgacccgtcgggccgacgggaaccctggtccaccgtctcctcgacgcctccaccgaacgggccacgtcgtccttccccgtggccctaccctcctaccaagtacgacctaccgtcggtcggggtaccacgacgtccggacccgtcggctcgccgtgtacgaacgtcctacgttccgtacgtacgtactctggacgcggacgtacgtacgaacggtcgacgtaacgtgctacgctcgangctcncgncnnnnngngn

SEQ ID NO: 285317 - DNA, 392 bp, Homo sapiens
  misc_feature: GYAE6OF01BDAOW.12.78.H01.1.454.CMB.1.raw
  modified_base (156)..(156): a, c, t, g, unknown or other
  misc_feature (156)..(156): n is a, c, g, or t
  modified_base (163)..(163): a, c, t, g, unknown or other
  misc_feature (163)..(163): n is a, c, g, or t
  modified_base (355)..(392): a, c, t, g, unknown or other
  misc_feature (355)..(392): n is a, c, g, or t
tcagatacgacgtacacgaccggtgctcgatttagtgtgagtagtttggggtttggggggtgtggtggtctccactcccgccttgacgggctgctatctgccctcctggccatcaggtgggctccagtctgaggatggaggctgtatttattacgngagcagntagtagggatgacagcctagaacgtcgggtcgttagtcgggacggacggacagctacgaccgtcgtaggtcaccgaccgacgtccgtcccgtcccccgtgtacctccgttccgttccctacccctcccctccgttactcggttactacgtcgtcggagggccggtacgtacgacggtaacggctacaggtcnnnnnnnnnnnnnnnnnnnnnnnnnnnnnnnnnnnnnn

SEQ ID NO: 285318 - DNA, 361 bp, Homo sapiens
  misc_feature: GYAE6OF01E0SYM.12.78.H01.1.454.CMB.1.raw
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (279)..(279): a, c, t, g, unknown or other
  misc_feature (279)..(279): n is a, c, g, or t
  modified_base (296)..(296): a, c, t, g, unknown or other
  misc_feature (296)..(296): n is a, c, g, or t
  modified_base (304)..(361): a, c, t, g, unknown or other
  misc_feature (304)..(361): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccgtattcggnggaggaccaagctgaccgtcctaaggtcancccgaaagctgccccctggtcactctcgttcccaccctcctctacgtcgtatctgagngggcctggcaaagggcnaactagcnnnnnnnnnnnnnnnnnnnnnnnnnnnnnnnnnnnnnnnnnnnnnnnnnnnnnnnnnn

SEQ ID NO: 285319 - DNA, 684 bp, Homo sapiens
  misc_feature: GYAE6OF01B2K9Z.12.78.H01.1.454.CMB.1.raw
  modified_base (677)..(677): a, c, t, g, unknown or other
  misc_feature (677)..(677): n is a, c, g, or t
tcagatacgacgtacacgaccggtgctcgatttagtgtgagtagtttgggtttgggggaggcttggtacagcctggggggtccctgagactctcctgtgcagcctctggattccacctttagcaactatgccatgagcgtagggtccgccgaggcctccagtgaaggggctggagtgggtctacgaggtattagtggtagtggtggtagcagatactacgcagactcgtagaagggtccgttacagcatctccagagacaagttaccaagacacgtctagttattgactatagtacgaacacgtcgtagacgacgacggacggacgtacgtaccgtatacgtagtcgtacgacgtacgtacgttacggtaccggtacgtacgtacggtaggtacgggtacgtacggtacgtccggtacccggtaccggtacgggaccgtaccgggtaccgtcgtaccgtaccgttccgtccgtacgtaccgacccgtaccgaaccgaccggtcccgtacggttcccgtccccgtacccgtaccgtacccctacccgtaccgaccgacgaccgtaccgtaccgtcggcggaccacggcgtccggtccgtcggccgtcggaccgtacgtacgtaccgtaccttaccgtaccgttacgtcgtacgtcggtgacggtccgacgacggacgngcgtacg

SEQ ID NO: 285320 - DNA, 878 bp, Homo sapiens
  misc_feature: GYAE6OF01ACCYE.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtggaaggggctggagtggggtctcaggtattaggtggtagtgggtggtagcagatactacgcagctccgtggaagggccggttcagcatcctccgagacgacaattccaagaaccacgctgtactttgctatatgaacacgcctgagacggaccggacggaccgacggtccgtaattacgtttaacgtgtggacgtaacggtcgtttacgggaccggtttaaccgggccgtttaaccgggtaaggtttacggggggaacggccggttaaccggttcggggtttaccccggaccccgggttacgggggacccggtaacccggggtaaccccggttcggggtccctaccccgggttcccgtcccgttaccgacccgtaccccgttaccccgaacccggaacccggggtaccccccgtacgtttccccggggttcccccgtttttacccccccggtaccgggtacccccgttcccccccgtaccccgtacccggaacggacccggtacccgtaccccggtccgggtaccggggggtacccaaccggacccgggtcccggggtccccgggtacggggtcccgtccgggtaccggttccgggaccgggttaaaccggtaacccgtttacccgtttaccccggtttaaccgggttacccggttcttacccggtgggtaaccggggtcccggggtcggtacccgggaacggtaccggggcgtaacccgg

SEQ ID NO: 285321 - DNA, 771 bp, Homo sapiens
  misc_feature: GYAE6OF01BJMZ2.12.78.H01.1.454.CMB.1.raw
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
tcagatacgacgtacacgaccggtgctcgatttagtgtgagtagtttgggtttgggggaggcttggtacagcctggggggtccccagactctcctgtgcagcctctggattctaccctttagctaaactatcgccagtgagcgtgggtcccgccaggcctccgagtgaaggggctggagtgggtctgaggtattaggtggtagtggtggtagcagatactacgcagacgttccgnggaacgggtccgttcagctatcctcgaaganactaagtaccaanaacncgtctgtattgctatatagaaacngcctagacgacggccggaagaccgaccggtccgtaattacttacgtgtgacgtaacgtcgttacggtaccggtttaccggacttaggacggttggggacgcggtacggttccggtacccgtaccccggtgggggtacccaaccggggtacccgttcgggtccgtaccccgtccttcccgtacgtacccgtccctacccgtaacccgggacccgggtccccgtaaccgttccccggttccccgttacccccggtcccgtacccccgttacccccgttacccgtaacccgaaaccggtacccgacccgtacccggttaccgggacggggaacccaccggaccggtcccggtacccgggtcggtcccgtacgtacccggtacgtacggtacccgtacgttacccgttaccgtccgttacgtacgtccgtacggcggtaccgggtacgtggaccgacggcgtcgtacg

SEQ ID NO: 285322 - DNA, 300 bp, Homo sapiens
  misc_feature: GYAE6OF02GBRS9.12.78.H01.1.454.CMB.1.raw
  modified_base (297)..(300): a, c, t, g, unknown or other
  misc_feature (297)..(300): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccgcctcctctacgtcgtatctgagcgggctggcaaggcgcatagnnnn

SEQ ID NO: 285323 - DNA, 529 bp, Homo sapiens
  misc_feature: GYAE6OF02GCYCF.12.78.H01.1.454.CMB.1.raw
tcagatacgacgtacacgaccggtgctcgatttagtgtgagtagtttgggtttggggaggcttggtacagcctgggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaatcttagcggttaccggctacgattggggagcgactggttcgaccctggggccagggaaccctggtcaccgtctcctcagcctccaccaagggcccatcggtcttcccctggcaccctcctccaacgagcacctctggggcacagcggcctgggctgcctggtcaggactacttcctacgtcgtatctgacgcgggctggcaggcgc

SEQ ID NO: 285324 - DNA, 174 bp, Homo sapiens; identical to SEQ ID NO: 285199
  misc_feature: GYAE6OF02HMVEF.12.78.H01.1.454.CMB.1.raw
  modified_base (173)..(174): a, c, t, g, unknown or other
  misc_feature (173)..(174): n is a, c, g, or t

SEQ ID NO: 285325 - DNA, 306 bp, Homo sapiens
  misc_feature: GYAE6OF02GJAXB.12.78.H01.1.454.CMB.1.raw
  modified_base (293)..(293): a, c, t, g, unknown or other
  misc_feature (293)..(293): n is a, c, g, or t
  modified_base (301)..(306): a, c, t, g, unknown or other
  misc_feature (301)..(306): n is a, c, g, or t
tcagatacgacgtacacgaccggtgctcgatttagtgtgagtagtttgggtttggggtggtgggtggtctccactcccgcttgacgggctgctatctgcctccctggccatcagtgggcctccagtctgaggatgaggctgattattactgtgcagcatgggatgacagcctgaatggtccggtattcggcggagggaccaagctgaccgtcctaggtcagcccaaggctgccccctgggtcactctagttcccgcctcctctaacgtcgtaatctgagcgggctggcaaggngtcatagnnnnnn

SEQ ID NO: 285326 - DNA, 303 bp, Homo sapiens
  misc_feature: GYAE6OF02GI3OY.12.78.H01.1.454.CMB.1.raw
  modified_base (298)..(303): a, c, t, g, unknown or other
  misc_feature (298)..(303): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtatctgagcgggctggcaaggcgcatagnnnnnn

SEQ ID NO: 285327 - DNA, 443 bp, Homo sapiens
  misc_feature: GYAE6OF02HNSMP.12.78.H01.1.454.CMB.1.raw
  modified_base (425)..(425): a, c, t, g, unknown or other
  misc_feature (425)..(425): n is a, c, g, or t
  modified_base (430)..(443): a, c, t, g, unknown or other
  misc_feature (430)..(443): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggccccaaactcctcatctatagtaataatcagcgaccctcaggggtccctgaccgattctctggctccaagtctggcacctcagcctccctggccatcagtgggctccagtctgaggatgaggctgaattaattactgtgcagcatgggatgacagcctgaatggtccggtattcggcggagggaccaagctgaccgtctaggcagcccaaggctgcccctggtcactctcgttcccacctctctacgtcgtatctgagcgggctggcaaggcgnatagnnnnnnnnnnnnnn

SEQ ID NO: 285328 - DNA, 173 bp, Homo sapiens
  misc_feature: GYAE6OF02JGXZ2.12.78.H01.1.454.CMB.1.raw
  modified_base (171)..(173): a, c, t, g, unknown or other
  misc_feature (171)..(173): n is a, c, g, or t
tcagatacgacgtacacgaccggtgctcgatttagtgtgagtagtttgggtttggggaagaggaagactgacggtccccaggagttcaggtgctgggcacagcggccctgggctgcctggtcaaggactacttcctacgtcgtatctgagcgggctggcaaggcgcatagnnn

SEQ ID NO: 285329 - DNA, 300 bp, Homo sapiens
  misc_feature: GYAE6OF02HVWQD.12.78.H01.1.454.CMB.1.raw
  modified_base (298)..(300): a, c, t, g, unknown or other
  misc_feature (298)..(300): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccgccctcctctacgtcgtatctgagcgggctggcaaggcgcatagnnn

SEQ ID NO: 285330 - DNA, 298 bp, Homo sapiens
  misc_feature: GYAE6OF02HNW7Z.12.78.H01.1.454.CMB.1.raw
  modified_base (298)..(298): a, c, t, g, unknown or other
  misc_feature (298)..(298): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtatctgagcgggctggcaaggcgcatagn

SEQ ID NO: 285331 - DNA, 173 bp, Homo sapiens; identical to SEQ ID NO: 285195
  misc_feature: GYAE6OF02GYALN.12.78.H01.1.454.CMB.1.raw
  modified_base (173)..(173): a, c, t, g, unknown or other
  misc_feature (173)..(173): n is a, c, g, or t

SEQ ID NO: 285332 - DNA, 303 bp, Homo sapiens
  misc_feature: GYAE6OF02JE4BK.12.78.H01.1.454.CMB.1.raw
  modified_base (297)..(303): a, c, t, g, unknown or other
  misc_feature (297)..(303): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctgttcccgcctcctctacgtcgtaatctgagccgggctggcaaggcgcatagnnnnnnn

SEQ ID NO: 285333 - DNA, 543 bp, Homo sapiens
  misc_feature: GYAE6OF02IHP63.12.78.H01.1.454.CMB.1.raw
tcagatacgacgtacacgaccggtgctcgatttagtgtgagtagtttgggtttggggaggcttggtacagcctgggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttacggctacgattggggagcgactggttcgaccctggggccagggaaccctggtcaccgtctcctcagcctccaccaacgggcccatccggtcttccccctggccaccctccctccaacgacgccacctctcgggggcacgagccggccctgggcctgcctgtcaggactacgttcctacgtcgtactctgacgcgggctggcaggcgac

SEQ ID NO: 285334 - DNA, 301 bp, Homo sapiens
  misc_feature: GYAE6OF02HQ6AF.12.78.H01.1.454.CMB.1.raw
  modified_base (298)..(301): a, c, t, g, unknown or other
  misc_feature (298)..(301): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtatctgagcgggctggcaaggcgcatagnnnn

SEQ ID NO: 285335 - DNA, 302 bp, Homo sapiens
  misc_feature: GYAE6OF02FPP0S.12.78.H01.1.454.CMB.1.raw
  modified_base (298)..(302): a, c, t, g, unknown or other
  misc_feature (298)..(302): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcattggatgacagcctgaatggtccggtattcggcggagggaccaagctgaccgtcctaggtcagcccaaggctgccccctcggtcactctgttccccacctcctctacgtcgtatctgagcgggctggcaaggcgcatagnnnnn

SEQ ID NO: 285336 - DNA, 441 bp, Homo sapiens
  misc_feature: GYAE6OF02G12S6.12.78.H01.1.454.CMB.1.raw
  modified_base (432)..(441): a, c, t, g, unknown or other
  misc_feature (432)..(441): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctcctggccatcagtgggctccagtctgaggatgaggctgattattactgtgcagcatgggatgacagcctgaatggtccggtattcggcggagggaccaagctgaccgtcctaggtcagcccaaggctgcccctggtccactctgttcccgccctcctctacgtctatctgagcgggctggcaagggcgcatagnnnnnnnnnn

SEQ ID NO: 285337 - DNA, 482 bp, Homo sapiens
  misc_feature: GYAE6OF02GHFHV.12.78.H01.1.454.CMB.1.raw
  modified_base (459)..(460): a, c, t, g, unknown or other
  misc_feature (459)..(460): n is a, c, g, or t
  modified_base (462)..(482): a, c, t, g, unknown or other
  misc_feature (462)..(482): n is a, c, g, or t
tcagatacgacgtacacgaccggtgctcgatttagtgtgagtagtttgggtttggggacccccgggtcgagagggtcaccatcctccttgttctggaagcagctccaacatcggaagtaatactgtaaactggtaccagcagctcccaggaaccggcccccaaactcctcatctatagtaataatcagcgaccctcaggggtccctgaccgattctctggctccaagtctggcacctcagcctccctgggcccatcagtggctccagtctgaggatgaggctgattattactgtgcagcatgggatgacagcctaggaatggtccggtatttcgggcggacgggacctaagtctagaccgtcctaggtccagcccaaggcctcgccccgtcggtccacgtctcgttcccacccttcctactacgtctatcgtgacgcggctaggccaacggcacatagnncnnnnnnnnnnnnnnnnnnnnn

SEQ ID NO: 285338 - DNA, 309 bp, Homo sapiens
  misc_feature: GYAE6OF02I7O5N.12.78.H01.1.454.CMB.1.raw
  modified_base (299)..(309): a, c, t, g, unknown or other
  misc_feature (299)..(309): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggaggaccaagctgaccgtcctaggtcagcccaaggctcgccccctcggtcactctcgttcccaccctcctctacgtcgtatctgagcgggctggcaaggcgcatagnnnnnnnnnnn

SEQ ID NO: 285339 - DNA, 307 bp, Homo sapiens
  misc_feature: GYAE6OF02IOLI0.12.78.H01.1.454.CMB.1.raw
  modified_base (294)..(307): a, c, t, g, unknown or other
  misc_feature (294)..(307): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctgttcccgcctcctctacgtcgtatctgagcggctggcaaggcgcatagnnnnnnnnnnnnnn

SEQ ID NO: 285340 - DNA, 301 bp, Homo sapiens
  misc_feature: GYAE6OF02H3Z1I.12.78.H01.1.454.CMB.1.raw
  modified_base (296)..(301): a, c, t, g, unknown or other
  misc_feature (296)..(301): n is a, c, g, or t
tcagatacgacgtacacgaccggtgctcgatttagtgtgagtagtttgggtttgggggtgtggtggtctccactcccgccttgacgggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctcgttcccaccctctctacgtcgtatctgagcgggctggcaaggcgcatagnnnnnn

SEQ ID NO: 285341 - DNA, 562 bp, Homo sapiens
  misc_feature: GYAE6OF02I47EZ.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaagggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtccaccgtctcctcacgcctccaccaacgggcccatccggtccttccccctcgggcctaccctcctcccaagacgccacctcgtcgggggcacgagccggccctcgggctggccctggtcaggactaccgttcctacgtcgtactcgtgacggcgggctggacgaggcgacg

SEQ ID NO: 285342 - DNA, 442 bp, Homo sapiens
  misc_feature: GYAE6OF02I4KTB.12.78.H01.1.454.CMB.1.raw
  modified_base (433)..(442): a, c, t, g, unknown or other
  misc_feature (433)..(442): n is a, c, g, or t
tcagatacgacgtacacgaccggtgctcgatttagtgtgagtagtttgggtttggggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtctaggtcagcccaaggcagcccctcggtcactctgttcccgcctcctctacgtcgtatctgagcgggctggcaaggcgcatagnnnnnnnnnn

SEQ ID NO: 285343 - DNA, 301 bp, Homo sapiens
  misc_feature: GYAE6OF02HUGAE.12.78.H01.1.454.CMB.1.raw
  modified_base (296)..(301): a, c, t, g, unknown or other
  misc_feature (296)..(301): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgcccctggtcactctgttcccgccctctctacgtccgtatctgagcgggctggcaaggcgcatagnnnnnn

SEQ ID NO: 285344 - DNA, 444 bp, Homo sapiens
  misc_feature: GYAE6OF02GFB9W.12.78.H01.1.454.CMB.1.raw
  modified_base (434)..(444): a, c, t, g, unknown or other
  misc_feature (434)..(444): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtctaggtcagcccaaggctgcccctcggtcactctgttccccgccctcctctacgtcgtatctgagcgggctgggcaaggcgcatagnnnnnnnnnnn

SEQ ID NO: 285345 - DNA, 574 bp, Homo sapiens
  misc_feature: GYAE6OF02JT9PU.12.78.H01.1.454.CMB.1.raw
  modified_base (353)..(353): a, c, t, g, unknown or other
  misc_feature (353)..(353): n is a, c, g, or t
tcagatacgacgtacacgaccggtgctcgatttagtgtgagtagtttgggtttgggggaggcttggtacagcctgggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattccaaagaacacgctgtatttgcatatgaacagcctgagagccgaggacacggccgtatattactgtgcgaagcttagcggttaccgctacgattggggancgactggttcgaccctggggccagggaaccctggtcaccgtctcctcagcctccaccaacgggcccacgtccggtcttcccccgtcggccaccctcctcccaacgacgccacctcgtcggggtaccacgacgccggcccttcggactcggccgtcggtaccacggtaccttaccgtcccgtacgtcgtacgtctagacgcgggctcggacgacggcgtacg

SEQ ID NO: 285346 - DNA, 579 bp, Homo sapiens
  misc_feature: GYAE6OF02IID0S.12.78.H01.1.454.CMB.1.raw
  modified_base (356)..(356): a, c, t, g, unknown or other
  misc_feature (356)..(356): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgcaatgagctgggtccgccaggctccagtgaagggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggangactggttcgacccgtggggccagggaaccctggtcaccgtctcctcacgcctccaccaacgggcccatccggtccttcccccgtcggccaccctccctccaacgacgccacctcgtcgggggccaccgacgccggcccgtcgggctcggccgtcgggtccaacggtacctacgttccctaccggttccgtattctggacggcgggcgtacggcacggcgacg

SEQ ID NO: 285347 - DNA, 675 bp, Homo sapiens
  misc_feature: GYAE6OF02JQHKE.12.78.H01.1.454.CMB.1.raw
tcagatacgacgtacacgaccggtgctcgatttagtgtgagtagtttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtcgtccccaggacagacagtcacaatctcatgctctggagatgcagttagggggaaaagtttgtctttctggtatcagcagaacgccaggcctacgtcccctgtcttggtcatctataaggatagcgaggccgccctacgagggtacttccgtaggacgccgtattccgtccggtctacccgtaacgtcccggaccaacacacgccctactctacgaccactccgacgccgggaacccaggtcctcgtaccgagtcggacggtcctagtaaccttagttaccgcggacccgaagggtccgttacggggaactaccggtccgtacccgtaaccgtttccccgtttagtccgttaccggttacggggacgggttaccgggaccgtaacggttccgggttaaccctaacccgggttccgtaacggttccgaacccggttaccccgaaacggtaaccccccgtaaaccccgtccgttaccggtacccctacccg

SEQ ID NO: 285348 - DNA, 435 bp, Homo sapiens
  misc_feature: GYAE6OF02ILUYQ.12.78.H01.1.454.CMB.1.raw
  modified_base (428)..(435): a, c, t, g, unknown or other
  misc_feature (428)..(435): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcaccgtcagcctccctggccatcagtgggctccagtctgaggatgaggctgattattactgtgcagcatgggatgacagcctgaatggtccggtattcggcggagggaccaagctgaccgtctaggtcagcccaaggctgcccctcggtcactctgtcccacctcctctactcgtatctgacgcggctggcaggcgcatgnnnnnnnn

SEQ ID NO: 285349 - DNA, 457 bp, Homo sapiens
  misc_feature: GYAE6OF02GPS5E.12.78.H01.1.454.CMB.1.raw
  modified_base (447)..(457): a, c, t, g, unknown or other
  misc_feature (447)..(457): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggccccaaactcctcatctatagtaataatcagcgaccctcaggggtccctgaccgattctctggctccaagtctggcacctcagccctccctggccatcagtgggctccagtctgaggatgaggctgatttattactgtgcagcagtgggatgacagcctgaagtggtccggtagttcgggcggagggaccaagctgaccgtcctaggtcagcccaaggctcgcccctcggtcactctcgttcccaccctcctctacgtctatctgacggcggctcgggacaagggcactagtacgnnnnnnnnnnn

SEQ ID NO: 285350 - DNA, 580 bp, Homo sapiens
  misc_feature: GYAE6OF02FGTDS.12.78.H01.1.454.CMB.1.raw
  modified_base (289)..(289): a, c, t, g, unknown or other
  misc_feature (289)..(289): n is a, c, g, or t
tcagatacgacgtacacgaccggtgctcgatttagtgtgagtagtttgggtttgggggaggcttggtacagcctgggggtccctgagactctcctgtgcagcctctggattcacctttagcaactatgccatgagctggtccgccaggctccagtgaagggctggagtgggtctcaggtattagtggtagtggtggtagcagatactacgcagactccgtgaagggccggttcagcatctccagagacaattccaagaacacgctgtatttgcatatgaacagcctganagccgaggacacggccgtatattactgtgcgaagcttagcggttaccgctacgattggggagcgactggttcgacccctggggccagggaacccctggtccaccgtctccctcacgcctccaccaacgggcccactccggtccttccccctggtccaccctccctccaacgacgccaccctcgtgggggccaccgacgccggcccgtcgggcctcgcccgttgggtaccacgggacctaccgtttccctacgttccgtactcctggacgccgggccgtggcgtaggcgacg

SEQ ID NO: 285351 - DNA, 450 bp, Homo sapiens
  misc_feature: GYAE6OF02IHNJV.12.78.H01.1.454.CMB.1.raw
  modified_base (435)..(435): a, c, t, g, unknown or other
  misc_feature (435)..(435): n is a, c, g, or t
  modified_base (442)..(450): a, c, t, g, unknown or other
  misc_feature (442)..(450): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtggctccagtctgaggatgaggctgattattactgtgcagcagtgggatgacagcctgaagtggtccggtagttcgggcggagggaccaagctgaccgtcgtagtcagcccaaggctcgcccctcggtcactctcgttcccacctcctctacgtcgtactcgtgacggcgggctggacagggcncgatagnnnnnnnnn

SEQ ID NO: 285352 - DNA, 304 bp, Homo sapiens
  misc_feature: GYAE6OF02JCABD.12.78.H01.1.454.CMB.1.raw
  modified_base (298)..(304): a, c, t, g, unknown or other
  misc_feature (298)..(304): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccgccctcctctacgtcgtatctgagcgggctggcaaggcgcatagnnnnnnn

SEQ ID NO: 285353 - DNA, 572 bp, Homo sapiens
  misc_feature: GYAE6OF02H042G.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtcaccgtctcctcacgcctccaccaacgggcccatccggtccttcccccgtggccaccccttcctcccaaacgacgccaacccgtcgtcgggggccaccgacgccggccccgtgggcctcgcctgggtccacggtacctaccgttcctacgttcgtatctgacgcgggctcgggcacggcacg

SEQ ID NO: 285354 - DNA, 568 bp, Homo sapiens
  misc_feature: GYAE6OF02HXJ90.12.78.H01.1.454.CMB.1.raw
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
  modified_base (406)..(406): a, c, t, g, unknown or other
  misc_feature (406)..(406): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattacngtgcgaagcttagcggttaccggctacgattgggggancgatggttcgacccgtggggccaggggaaccctgggtcaccgtctcctcncgcctccaccaacgggcccatccggtcttcccccgtggccaccctccctccaagacgccacctcgtcgggggccacgacggccggcccgtgggcctcgccgtggtccgaaggacctaccgttcctaccgtcgtactctggacgcgggctgggcacggcgacg

SEQ ID NO: 285355 - DNA, 570 bp, Homo sapiens
  misc_feature: GYAE6OF02FSWUW.12.78.H01.1.454.CMB.1.raw
  modified_base (355)..(355): a, c, t, g, unknown or other
  misc_feature (355)..(355): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggancgactggttcgaccctggggccagggaccctggtcaccgtctcctcagccctccaccaacgggcccatccggtccttccccctcggccaccctcctcccaacgacgccacctcgtcgggggcaccgagccggcccgtgggcctcggccgtggtccaaggacctacgttccctacggttccgtacttcgtgacggcgggccgttggcgaggcgacg

SEQ ID NO: 285356 - DNA, 536 bp, Homo sapiens
  misc_feature: GYAE6OF02IO7T6.12.78.H01.1.454.CMB.1.raw
  modified_base (354)..(354): a, c, t, g, unknown or other
  misc_feature (354)..(354): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattccaagaacacgctgtatttgcatatgaacagcctgagagccgaggacacggccgtatattactgtgcgaagcttagcggttaccggctacgattggggancgactggttcgacccctggggccagggaaccctggtcaccgtctcctcagcctccacaaggcccatcgtctcccctgcaccctcctccaagacgccacctcgcgggggccacgacgcggcccgtgggctcgcctggtcaggactacttcctacgtcgtatctgagcgggctggcaggcgacg

SEQ ID NO: 285357 - DNA, 562 bp, Homo sapiens
  misc_feature: GYAE6OF02GZ3QU.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgaccctggggccagggaaccctggtcaccgtctcctcacgcctccaccaacggcccatcggtccttccccctcggccaccctccctccaacgacgccacctctcgggggcacgacgcggcccgtcgggcctcgccctgggtccaacgggactaccgttcctaccgtcgtactctgacgcgggctcgggcaggcgacg

SEQ ID NO: 285358 - DNA, 591 bp, Homo sapiens
  misc_feature: GYAE6OF02GTCLD.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattgggggagcgactggtttcgacccgtggggccaggggaaccctggtcaccgtctcctcacgccctccaccaacgggcccagtccggtccttccccctcggccaccctccctaccaacgacgccaccctcgtcggggccacgacgccggccctggggcctcggccgtcggtccgaaggtacctaccgttccgtaccgttcggtacttcgtggacggccggggtcgtcgggacgacgggcgtacg

SEQ ID NO: 285359 - DNA, 537 bp, Homo sapiens
  misc_feature: GYAE6OF02FM8UK.12.78.H01.1.454.CMB.1.raw
  modified_base (289)..(289): a, c, t, g, unknown or other
  misc_feature (289)..(289): n is a, c, g, or t
tcagatacgacgtacacgaccggtgctcgattagtgtgagtagtttgggtttggggtaggcttggtacagcctggggttccctgagactctcctgtgcagcctctggattcacctttagcaactatgccatgagctgggtccgccaggctccagtgaagggctggagtgggtctcaggtattagtggtagtggtggtagcagatactacgcagactccgtgaagggccggttcagcatctccagagacaattccaagaacacgctgtatttgcatatgaacagcctganagccgagacacgcgtatattactgtgcgaagcttagcggttaccggctacgattgggagcgactggttcgacccctggggccagggaacccctggtcaccgtctcctcagcctccaccaacgggcccatccggtcttccccctggccaccctccctccaagcgcacccgtctggggcacacgcggccctgggcctgcctggtcaggactacgttcctacgtcgtatctgacgcgggctggcaggcgac

SEQ ID NO: 285360 - DNA, 553 bp, Homo sapiens
  misc_feature: GYAE6OF02I3CZC.12.78.H01.1.454.CMB.1.raw
  modified_base (438)..(438): a, c, t, g, unknown or other
  misc_feature (438)..(438): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggtcgaccctggggccagggaaccctggtcaccgtctcctcagcctccacaagggcccatcggtccttcccctggccnccctcctccaacgacgcacctcgtggggccacgacgccggccctggggcctcggccctgggtccaggacctaccgttcctacgtcgtactcgtgagcgggctcggcacggcgacg

SEQ ID NO: 285361 - DNA, 571 bp, Homo sapiens
  misc_feature: GYAE6OF02FWM1I.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccgctacgattggggagcgactggtcgacccctggggccagggaaccctggtccaccgtctcctcacgcctccaccaacgggcccatcggtccttccccctggcccaccctccctccaacgcgccaccctcgtcgggggccacgacggccggcccgttcggggcctcggcctgggtaccaaggacctaccttcctaccggtcgtattctgacggcgggcctggcgaggcgtacg

SEQ ID NO: 285362 - DNA, 565 bp, Homo sapiens
  misc_feature: GYAE6OF02F9SBI.12.78.H01.1.454.CMB.1.raw
  modified_base (438)..(438): a, c, t, g, unknown or other
  misc_feature (438)..(438): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccgttcagcatctccagagacaattccaagaacacgctgtatttgcatatgaacagcctgagagccgaggacacggccgtatattactgtgcgaagcttagcggttaccggctacgattggggagcgactggttcgacccgtggggccagggaaccctggtcaccgtctcctcacgcctccaccaacgggcccagtcgtccttcccccnggccaccctccctccaacgacgccacctcgtcggggacaccgacgccggcccgtcggggcctcggccgtcggtacacggactaccgttccctacgtccgtatcgtgacggcgggctggcaggcgacg

SEQ ID NO: 285363 - DNA, 553 bp, Homo sapiens
  misc_feature: GYAE6OF02GFD2H.12.78.H01.1.454.CMB.1.raw
  modified_base (312)..(312): a, c, t, g, unknown or other
  misc_feature (312)..(312): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtanattactgtgcgaagcttagcggttaccgctacgattggggagcgactggttcgaccctggggccagggaaccctggtccaccggtctcctcacgcctccaccaagggcccatcggtcttccccctggcaccctcctccagacgcaccgtctgggggccacgacgccggcccgtgggctcgccgtcggtcgaaggactacgttcctacgtcgtactctgacggcgggcgtggcgaggcgacg

SEQ ID NO: 285364 - DNA, 561 bp, Homo sapiens
  misc_feature: GYAE6OF02GKV6M.12.78.H01.1.454.CMB.1.raw
  modified_base (356)..(356): a, c, t, g, unknown or other
  misc_feature (356)..(356): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggaccacggccgtatattactgtgcgaagcttagcggttaccgctacgattggggancgactggttcgacccgtggggccagggaaccctggtccaccgtctcctcagccctccaccgaacgggcccatccggtccttcccccgtcgccaccctcctccaagacgccaccgtcgtcggggccacgacgccggcccgtgggcctcgccgtggcacggactacgttcctacgtcgtatcgtggacgcgggctgggcacggcacg

SEQ ID NO: 285365 - DNA, 549 bp, Homo sapiens
  misc_feature: GYAE6OF02HQE7Y.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcaccttttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggacacggccgtatattactgtgcgaagcttagcggttaccggctacgattggggagcgactggttcgaccctggggccaggaaccctggtcaccgtctcctcagcctccaccaacgggcccatcggtccttcccctggccaccctccctaccaacgacgccaacctcgtcgggggccacagccggcccgtgggcctgcctgtcaggactacgttcctacgtcgtatctgagcgggcgtggcaggcgac

SEQ ID NO: 285366 - DNA, 569 bp, Homo sapiens
  misc_feature: GYAE6OF02FKSAD.12.78.H01.1.454.CMB.1.raw
  modified_base (400)..(400): a, c, t, g, unknown or other
  misc_feature (400)..(400): n is a, c, g, or t
  modified_base (552)..(569): a, c, t, g, unknown or other
  misc_feature (552)..(569): n is a, c, g, or t
tcagatacgacgtacacgaccggtgctcgattagtgtgagtagtttgggtttggggaagaggaagactgacggtccccccaggagttcaggtgctgggtccgccaggctccagtgaaggggctggagtgggtctcaggtattagtggtagtggtggtagcagatactacgcagactccgtgaagggccgttcagcatctccagagacaattccaagaacacgctgtattgcatatgaacagcctgagagcccgagggaccacggccgtatatactgtgcgaagctagcggttaccggctacgattgggagcgactgttcgacccgtgggccagggaacccctggtccacccgtctccctcacgccctcccaccaacgggcccatccggtccttcccccgnggccacccctcctccaacgacgccaccctcgtcggggcaccgacgcccggcccgtcgggccttcggcccgtggtccgaacggaccttaccttccctacgttccgtactcgttggacgccgggtcgtcggaccgaacggccgacgaagtacgnnnnnnnnnnnnnnnnnn

SEQ ID NO: 285367 - DNA, 300 bp, Homo sapiens
  misc_feature: GYAE6OF02FVW5T.12.78.H01.1.454.CMB.1.raw
  modified_base (298)..(300): a, c, t, g, unknown or other
  misc_feature (298)..(300): n is a, c, g, or t
tcagatacgacgtacacgaccggtgctcgatttagtgtgagtagtttgggtttgggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctgttccccaccctcctctacgtcgtatctgagcgggctggcaaggcgcatagnnn

SEQ ID NO: 285368 - DNA, 173 bp, Homo sapiens
  misc_feature: GYAE6OF02F4PWK.12.78.H01.1.454.CMB.1.raw
  modified_base (170)..(173): a, c, t, g, unknown or other
  misc_feature (170)..(173): n is a, c, g, or t
tcagatacgacgtacacgaccggtgctcgattagtgtgagtagtttgggtttggggaagaggaagactgacggtcccccaggagttcaggtgctgggcacagcggccctggctgcctggtcaaggactacttcctacgtcgtatctgagcgggctggcaaggcgcatagnnnn

SEQ ID NO: 285369 - DNA, 586 bp, Homo sapiens
  misc_feature: GYAE6OF02G3JQT.12.78.H01.1.454.CMB.1.raw
  modified_base (281)..(281): a, c, t, g, unknown or other
  misc_feature (281)..(281): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatnaacagcctgagagccgaggacacggccgtatatactgtgcgaagcttagcggttaccggctacgagttggggagcgactggttcgacccgtgggccagggaaccctggtcaccgtctcctcacgccctccacccgaacgggacccacgtccggtccttcccccgtcggcctacccctccctcccaacgacgccacccgtcgtcgggggccacgacggccggcccgtcgggcctcggccgtcggtacacggactaccgttcctacgttcgtactcgtggacggcgggcgtcggacgacggcgtacg

SEQ ID NO: 285370 - DNA, 648 bp, Homo sapiens
  misc_feature: GYAE6OF02IIJND.12.78.H01.1.454.CMB.1.raw
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaagggctggagtgggtctcaggtattagtggtagtggtggtagcagatactacgcagactccgtgaagggccgttcagcatctccagagacaattccaagaacacgctgtattgcatatgaacagcctgagagccgaggacacggccgtatattactgtgcgaagcttagcggttaccggctacgagttggggancgacgtcggtccgacccgtgggccgacgggaaccctggtccaccggtctcctcncgcctcccgacgaacggccagtccggtccttccccgtcggccctacccctccctacccgaacgacgacccacccgtcggttccgggggacctaccgaaccggccgggtcccggtcgggaccgttcggtcccggttacgggtaccgtaaacggtaccctttaaccggttcccgtttaacccggttacggttaccttccgtacggacgggtccgggtacgttcgggacgacgggtcgtaccgg

SEQ ID NO: 285371 - DNA, 612 bp, Homo sapiens
  misc_feature: GYAE6OF02FUCWT.12.78.H01.1.454.CMB.1.raw
  modified_base (291)..(291): a, c, t, g, unknown or other
  misc_feature (291)..(291): n is a, c, g, or t
tcagatacgacgtacacgaccggtgctcgatttagtgtgagtagtttgggtttgggggaggcttggtacagcctgggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctganagccgaggacacggccgtatattactgtgcgaagcttagcggttaccggctacgagttggggagcgactggttcgacccgtggggccagggaacccctggtcacccgtctccctcacgccctccacccgaacgggcccactccgggtaccttccccccgtcggtccacccctccctacccaacgacgccaacccttcgcgggggtaccaccgagccggcccgtcgggcctcgccgtcggtccgaacggtacctaccgttccgttaaccgttccgtacgttccgtcggacggtccgggtcgtcggaccgacggccgtaaccg

SEQ ID NO: 285372 - DNA, 583 bp, Homo sapiens
  misc_feature: GYAE6OF02GMT1Q.12.78.H01.1.454.CMB.1.raw
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtanattactgtgcgaagcttagcgggttaccggntacgattggggancgactggttcgacccgtggggccaggggaaccctggccaccgtctcctcacgcctccaccgaacggcccatccgtccttcccccgtcggccaccctccctccgaacgacgaccaccgtcgtcggggaccacgacgccggccctcgggctcggtccgtcggtacgaacggtacctaccgttcccgtacgttccgtacttcgtggacgcgggcgtcggcgtaggcgacg

SEQ ID NO: 285373 - DNA, 307 bp, Homo sapiens
  misc_feature: GYAE6OF02HZQJS.12.78.H01.1.454.CMB.1.raw
  modified_base (303)..(307): a, c, t, g, unknown or other
  misc_feature (303)..(307): n is a, c, g, or t
tcagatacgacgtacacgaccggtgctcgatttagtgtgagtagtttgggtttggggggtggtggtggtctccactcccgccttgacggggctgctatctgcctccctggccatcagtggctccagtctgaggatgaggctgattattactgtgcagcatgggatgacagcctgaatggtccgtattcggcggagggaccaagctgaccgtcctaagtcacgcccgaaggcctcgccccctcggtcactctcgtcccaccctcctctacgttcgtatctgagtcggctggcaaggcgcatagnnnnn

SEQ ID NO: 285374 - DNA, 602 bp, Homo sapiens
  misc_feature: GYAE6OF02JE64J.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcaatatgaacagcctgagagccgaggacacggccgtatattactgtgcgaacgcttagcggttaccggctacggagttggggagcgacgtggttcgaccccgtggggccacgggaccctggtccaccgtctcctcacgccctccaccgacgggccctatccggtccttcccccgtggccctaccctcctcccgaacgcgccaccgtcgtggggcctacgacggcccggcccgtcgggcgtcgcccgtggtaccgacggacctacgttcccgtaccggttaccgttacgtctcgggtacggccgggcgttacgggccgacggcgtacg

SEQ ID NO: 285375 - DNA, 316 bp, Homo sapiens
  misc_feature: GYAE6OF02GMC2P.12.78.H01.1.454.CMB.1.raw
  modified_base (306)..(316): a, c, t, g, unknown or other
  misc_feature (306)..(316): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcatcatgggctgacaccctgactggtccgggagtgttcggcggagggaccaagctgaccgtcctaggtcagcccaaggcacgccccctcggtcactctcgttccccgccctcctctacgtcgtatcgtgagcgggctggcaaggcgcatagnnnnnnnnnnn

SEQ ID NO: 285376 - DNA, 597 bp, Homo sapiens
  misc_feature: GYAE6OF02HI25L.12.78.H01.1.454.CMB.1.raw
  modified_base (356)..(356): a, c, t, g, unknown or other
  misc_feature (356)..(356): n is a, c, g, or t
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaagggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtaatattactgtgcgaagcttagcggttaccgctacgattggggancgactggtccgacccgtggggccagggaaccctggtcaccgtctcctcacgccnccaccgaacggcccagtcgtccttccccgtcgccaccctcccnccaacgacgccaccgtcgtcggggccacgacgtctcgcccgtcgggctcgccgtcggtacgaacggacccttaccgttccctaacggttccgttacttccgtacggtaccgggccgggtccgtcgggtaccgaagggtacccgg

SEQ ID NO: 285377 - DNA, 584 bp, Homo sapiens
  misc_feature: GYAE6OF02HBKSL.12.78.H01.1.454.CMB.1.raw
  modified_base (355)..(355): a, c, t, g, unknown or other
  misc_feature (355)..(355): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggagtcagatactacgcagactccgtgaagggccggttcagcatctccagagacaattccaagaacacgctgtatttgcatatgaacagcctgagagccgaggacacggccgtatattactgtgcgaagcttagcggttaccgctacgagttggggancgacgtggttccgaccccgtggggccaggggaaccctggtccgaccgtcctcctcacgcctcccaaccgaacgggcccacgtcgtccttcccccgtcggcctacccctccctacccaacggacaccaccgtcgtcggggaccacgacgccggcccgtcgggctgccgtgtaccgagtacctaccgttcctacgtcgtactcgtgacggcgggctcgggctacggcgacg

SEQ ID NO: 285378 - DNA, 555 bp, Homo sapiens
  misc_feature: GYAE6OF02G6EDQ.12.78.H01.1.454.CMB.1.raw
  modified_base (344)..(344): a, c, t, g, unknown or other
  misc_feature (344)..(344): n is a, c, g, or t
  modified_base (441)..(441): a, c, t, g, unknown or other
  misc_feature (441)..(441): n is a, c, g, or t
  modified_base (448)..(448): a, c, t, g, unknown or other
  misc_feature (448)..(448): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacaccctttatctgcaaatagacagcctgagaccagacgacacggctgtctattattgcgcgagagagacacacgaacctacnggaccaatactagtggggcttgttcgtggggccaggggaccctggtcacgtcgtcctccccagccctccaccagggcccagtccggtccttcccccngggcccncccgtcgcctccgaggtacgccacctccgagcgcacacgccggacctcgggctcgcctggcgaacggccttacttcctacgtcgtactcgtgacggcggctggaccg

SEQ ID NO: 285379 - DNA, 305 bp, Homo sapiens
  misc_feature: GYAE6OF02HLMGA.12.78.H01.1.454.CMB.1.raw
  modified_base (302)..(305): a, c, t, g, unknown or other
  misc_feature (302)..(305): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagcccaaggctcgccccctcggtcactctcgttccccgccctcctctacgtcgtatctgagcgggctggcaaggcgcatagnnnn

SEQ ID NO: 285380 - DNA, 305 bp, Homo sapiens
  misc_feature: GYAE6OF02INANG.12.78.H01.1.454.CMB.1.raw
  modified_base (301)..(305): a, c, t, g, unknown or other
  misc_feature (301)..(305): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcggcggagggaccaagctgaccgtcctaggtcagccccaaggctcgccccctcggtcactctcgttcccgccctcctctagtcgtatctgagcgggctggcaaggcgcatagnnnnn

SEQ ID NO: 285381 - DNA, 446 bp, Homo sapiens
  misc_feature: GYAE6OF02FYAQ9.12.78.H01.1.454.CMB.1.raw
  modified_base (435)..(435): a, c, t, g, unknown or other
  misc_feature (435)..(435): n is a, c, g, or t
  modified_base (440)..(446): a, c, t, g, unknown or other
  misc_feature (440)..(446): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagctgaagtggtccggtattcggcggagggaccaagctgaccgtcctaggtcagcccaaggctcgcccctcggtcactcctcgttccccaccctcctctacgtcgtactctgacgcgggctgggcaagggcncatgnnnnnnn

SEQ ID NO: 285382 - DNA, 445 bp, Homo sapiens
  misc_feature: GYAE6OF02IPEVK.12.78.H01.1.454.CMB.1.raw
  modified_base (426)..(426): a, c, t, g, unknown or other
  misc_feature (426)..(426): n is a, c, g, or t
  modified_base (431)..(445): a, c, t, g, unknown or other
  misc_feature (431)..(445): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgacgtcctaggtcagcccaaggctgcccctggtcactctgttcctaccctctctacgtcgtatctgagcgggctggcaagggcnatagnnnnnnnnnnnnnnn

SEQ ID NO: 285383 - DNA, 553 bp, Homo sapiens
  misc_feature: GYAE6OF02JS4QO.12.78.H01.1.454.CMB.1.raw
  modified_base (286)..(286): a, c, t, g, unknown or other
  misc_feature (286)..(286): n is a, c, g, or t
  modified_base (523)..(524): a, c, t, g, unknown or other
  misc_feature (523)..(524): n is a, c, g, or t
  modified_base (527)..(553): a, c, t, g, unknown or other
  misc_feature (527)..(553): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggccccaaactcctcatctatagtaataatcagcgaccctcacggggtccctgaccgattctctggctccaagtctggcacctcagcctcctggccatcagtggctccagtctgagatgaggctgattattactgtncagcatggggatgacagcctagaagtcggtaccggtagttcgggcgggagggaccaaggctcggaccgtcgtaggtcgacgtcccgaagggcctcccggacccccgtcggtactaccgttcccgttccggttaccccctaccccttcccttccgtttaaccgttcccggtactttcccgtacgggacgggtcccggggtacgttcgggaccgtaaccgggccgtaccgtagtaccgnnacnnnnnnnnnnnnnnnnnnnnnnnnnnn

SEQ ID NO: 285384 - DNA, 650 bp, Homo sapiens
  misc_feature: GYAE6OF02JWU8P.12.78.H01.1.454.CMB.1.raw
  modified_base (236)..(236): a, c, t, g, unknown or other
  misc_feature (236)..(236): n is a, c, g, or t
  modified_base (280)..(280): a, c, t, g, unknown or other
  misc_feature (280)..(280): n is a, c, g, or t
  modified_base (518)..(518): a, c, t, g, unknown or other
  misc_feature (518)..(518): n is a, c, g, or t
  modified_base (555)..(555): a, c, t, g, unknown or other
  misc_feature (555)..(555): n is a, c, g, or t
  modified_base (618)..(618): a, c, t, g, unknown or other
  misc_feature (618)..(618): n is a, c, g, or t
tcagatacgacgtacacgaccggtgctcgatttagtgtgagtagtttgggtttgggggaggcttggtacagcctgggggtccccgagactctcctgtgcagcctctggattcacctttagcaactatgccatgagctgggtccgccaggctccagtgaaggggctggagtgggtctcaggtattagtggtagtggtggtagcagatactacgcagactcgtgaaggccgttcagcntctcagagacaattccaagactacgctgtatttgcatatgaacngcctgagagccgaggacgacggccgtatattactgtcgcgaagtcttaggccggttaccggctaacgacgttggggacgccggacgtcggttccgaccccgtcggggccgtaacgggaacccgtcggtccacccggttctcccgtcgactcctacccgacgtaaccgggcccacgttccggttccccgttacccccgtcggtacccctaaccccttcccgtacctaacgaccgtaccncccgtcgggtacggggcctaacggcgcccgtcccggnggtccgtcgccgtacggccaaaccggccttaccttccgtccgtacgttaccgtcgtaccgggngtaccgggcgtggaccgacgggtcgaccgtag

SEQ ID NO: 285385 - DNA, 452 bp, Homo sapiens
  misc_feature: GYAE6OF02FYFZY.12.78.H01.1.454.CMB.1.raw
  modified_base (270)..(270): a, c, t, g, unknown or other
  misc_feature (270)..(270): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (444)..(452): a, c, t, g, unknown or other
  misc_feature (444)..(452): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaaccggcccccaaactcctcatctatagtaataatcagcgaccctcaggggtccctgaccgattctctggctccaagtctggcacctcacgccctccctggccatcagtggctccagtctgagntgaggctgattattactgtgcatcagtgggctgaccaccctgacgtgggtccgggagttcggttcgggcggacgggaccaagcgtgaccgtctaggtcacgccaaggccacgccccgtgtcactctcgtcccaccctctctacgtctactcgngcgcggctggcgaggcnatannnnnnnnn

SEQ ID NO: 285386 - DNA, 603 bp, Homo sapiens
  misc_feature: GYAE6OF02F7UEH.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgacgaagcttagcggttaccgctacgagttggggagcgacgtggttcgacccgtgggccagggaccctggtcaccgtctcctcagccctccaccgaacgggcccacgtccggttccttcccccgtcggcctaccccgtccctccgaacgacgccgtaccctccgtcgggggccaccgacggccggcccgtgggccttcggccgtcgggtcaacggtacctaccgtttcccgtaccgtcgttatccgttaggacggtcgggacgtcgggacgtacggccgtacg

SEQ ID NO: 285387 - DNA, 558 bp, Homo sapiens
  misc_feature: GYAE6OF02FHR4X.12.78.H01.1.454.CMB.1.raw
  modified_base (353)..(353): a, c, t, g, unknown or other
  misc_feature (353)..(353): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtggggtctcaggtattagtggtagtggtggtagcagatactacgcagactccgtgaagggccggttcagcatctccagagacaattccaagaacacgctgtatttgcatatgaacagcctgagagccgagacacggccgtatatactgtgcgaagcttagcggttaccgctacgattggggancgactggttcgacccctggggccagggaaccctgggtcaccgtctcctcacgcctccaccgaacgggcccatccggtccttcccccgtcggccaccctcctccaacgacgccaccgtcgtcgggggcacgacggcggcccgtgggcctggccgtggtcacgactacttccctacgtcgtatctgagcgggcgtggcaggcgtacg

SEQ ID NO: 285388 - DNA, 605 bp, Homo sapiens
  misc_feature: GYAE6OF02GRDSG.12.78.H01.1.454.CMB.1.raw
  modified_base (287)..(287): a, c, t, g, unknown or other
  misc_feature (287)..(287): n is a, c, g, or t
  modified_base (358)..(358): a, c, t, g, unknown or other
  misc_feature (358)..(358): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaagggctggagtgggtctcaggtattagtggtagtggtggtagcagatactacgcagactccgtgaacgggccgttcagcatctccagagacaattccaaagaacacgctagtatttgctatatgaacngcctgagagccgtaggacacggccgtatatactgtgcgaagtcttagcggttaccgctacgagttggggancgactggttccgacccgtgggcacgggacctggtcaccgtctcctcgacgcctcccacgtaccggcccacgtccggttcccttcccccgtggccctaccccgtccctaccaacgacgccaccgtaccgtcgggggacctacgacgccggcccgttcgggcctacggcccgtgggtacctaagggtccttaaccgttccctaccgttcgtactcgtacgacggcggtccgtcgggacacgggtcgacg

SEQ ID NO: 285389 - DNA, 740 bp, Homo sapiens
  misc_feature: GYAE6OF02H8FQ8.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtggaagggctggagtgggtctcgaggttattagtggtagtgggtggtagcagatactacgcagactccggtgaagggtccggttcagcatctaccgaagagaactaattccaaagaacacgacttgttatttgctaatatagaacagcctaggacgacgcccggaaggaccgaccggtcctaattacttacgtggtgtacgaagtcgttacggtaccggttaccggacgtacggtaggttcgggggacgtacgtacgttcgggtttacccgaccccgggtcggggacccgtacgggaacccgttcgggtacccaccgttcctccgtccgacgtacccctaccgaacccgaacgggccctacgtcccggttacccgttccccgtcggaccccttccccgtaccctaccgaacgaccgccctacccggtcgggtaccgggggaccaccggaccgggcccgggtcccggtacgggtcccgtcggcccgttacgggaccgtaacgtacccgtttacccgtttccgtaccggtttacgtcgttaccggtcggcggtccgggtaccgtccgggacgaccgggtcgtaacg

SEQ ID NO: 285390 - DNA, 306 bp, Homo sapiens
  misc_feature: GYAE6OF02FRCAZ.12.78.H01.1.454.CMB.1.raw
  modified_base (300)..(306): a, c, t, g, unknown or other
  misc_feature (300)..(306): n is a, c, g, or t
tcagatacgacgtacacgaccggtgctcgatttagtgtgagtagtttgggtttggggggtgtggtggtctccactcccgccttgacggggctgctatctgccctccctggccatcagtgggctccagtctgaggatgaggctgattattactgtgcagcatgggatgacagcctgaatggtccggtattcggcggagggaccaagctgaccgtctaagtcagcccaaggctcgccccctcggtcactctcgttccccacctcctctacgtcgtatctgagcgggctggcaggcgcatagnnnnnnn

SEQ ID NO: 285391 - DNA, 630 bp, Homo sapiens
  misc_feature: GYAE6OF02G4A4U.12.78.H01.1.454.CMB.1.raw
  modified_base (585)..(585): a, c, t, g, unknown or other
  misc_feature (585)..(585): n is a, c, g, or t
  modified_base (590)..(591): a, c, t, g, unknown or other
  misc_feature (590)..(591): n is a, c, g, or t
  modified_base (594)..(596): a, c, t, g, unknown or other
  misc_feature (594)..(596): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
  modified_base (614)..(630): a, c, t, g, unknown or other
  misc_feature (614)..(630): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagccgaccctgacggggtccctgaccgattctctggctccaagtctggcacctcacgcctcccgtggccatcgaggtggcctccgagtctgaggatggaggctgatttattactggtcgcatcagtcgggactcgacctaccctggtaccggtcggggtcggggagttcgggttccgggacgggtacgggaaccacggtcgtaccggacccggtaccgttaggacccaccggaccaacgggccacccggccccccgttacggtaccctaccgtttccgtccccggttaccccctacccctttccccggttaccgtttaccggtacccgtttacttcgtacggggtaccgggtccggggtaccgtcggggaaccgggtaaccgggccgtaccgtaaggtcgacgngtacnnacnnncncgngngngngnngnannnnnnnnnnnnnnnnn

SEQ ID NO: 285392 - DNA, 691 bp, Homo sapiens
  misc_feature: GYAE6OF02F4656.12.78.H01.1.454.CMB.1.raw
  modified_base (138)..(138): a, c, t, g, unknown or other
  misc_feature (138)..(138): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
tcagatacgacgtacacgaccggtgctcgatttagtgtgagtagtttgggtttgggggaggcttggtacgagccgtggggggtccctgagactctcctgtgcagcctctggattcacctttagcaactatgccatganctggtccgccagctccagtgaaggggctggagtgggtctcaggtattagtggtagtggtggtagcagatactacgcagactccgtgaacgggccggttcagcatctaccagagacaattccgaaagaacacgctgtattgcataatgaacagcctagagagccgaggacacggccgtatattactgtgcgaagcttagcggttacgctacgngttaggggcncgacttcggttccgaccccgtggggacccaacgggtaacccgttggtccgacccgttctacccgtcacgtccctccaacccgtaacgggcccctagtccgggtttcccttcccccgtcggtcccaaccccttcccgtacccaaacggtaccaccctaccttacggtccgggggaccaccgaacgcccgggtaccccgtcggggtccctcgggtcccgttacggtacggaacggtacccgttacccgtttaacccgtaccgggtttaaccgttacgttacgttaccggaacggcccggggtccgttaccgggacccggaacgggaccctccg

SEQ ID NO: 285393 - DNA, 629 bp, Homo sapiens
  misc_feature: GYAE6OF02IQYMR.12.78.H01.1.454.CMB.1.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (414)..(414): a, c, t, g, unknown or other
  misc_feature (414)..(414): n is a, c, g, or t
tcagatacgacgtacacgaccggtgctcgattttagtgtgagtagtttgggtttggggggaggcttggtacagcctgggggggtccctgagactctcctgtgcagcctctggattcacctttagcaactatgccaatgagctgggtccgccaggctccagtgaagggggctggagtgggtactcaggtattagtggtagtggtggtagcagatactacgcagacnccgtgaagggccggttcagcatctcagagacaatcaaanaacacgctagtattgnatatgaanagctgagagccgagacacggccgtatatactgtgcgaagcttagcggttaccgactacgatggggacgcgactggttcggaccccgtggggaccaagggaaccctggtccaaccgtcctcctacancccaccgaccgaaacggccctaatccggttccctttcccccgtaggcccacccgtaccctaccgaaacgacgtccaccttcggtacggggacctacgacgtccgggacccttgggaccgttgacccgttggtacccaaggtacccttaacccgttaccggttaaccgttcgtaacttccgttagacggccgggatgggaccgtagggaccgtacg

SEQ ID NO: 285394 - DNA, 511 bp, Homo sapiens
  misc_feature: GYAE6OF02IJGOV.12.78.H01.1.454.CMB.1.raw
  modified_base (315)..(315): a, c, t, g, unknown or other
  misc_feature (315)..(315): n is a, c, g, or t
  modified_base (476)..(476): a, c, t, g, unknown or other
  misc_feature (476)..(476): n is a, c, g, or t
  modified_base (482)..(511): a, c, t, g, unknown or other
  misc_feature (482)..(511): n is a, c, g, or t
tcagatacgacgtacacgaccggtgctcgatttagtgtgagtagtttgggtttgggggacccccgggcagagggtcaccatctcttgttctggaagcagctccaacatcggaagtaatactgtaaactggtaccagcagctcccagggaaccggccccaaactcctcatctatagtaataatcagcgaccctcgacggggtccctgaccgattcctctggctccaagtctggcacctcacgcctcctggccatcaggtggctccagtctggaggatggaggctgtaattacttatgtgcagcagtgggatgaacngcctagaagtcggtccggtagtcgggcggaggaccaagctaggaccgtcgaggtcacgcccgaaggtcctcggtcccctcgggtcaacctcgtccgttccccgccctccttcgtaccgtcgtactcgtggacggtcgggcttacgggactaacgggccganagtagnnnnnnnnnnnnnnnnnnnnnnnnnnnnnn

SEQ ID NO: 285395 - DNA, 633 bp, Homo sapiens
  misc_feature: GYAE6OF02F6308.12.78.H01.1.454.CMB.1.raw
  modified_base (321)..(321): a, c, t, g, unknown or other
  misc_feature (321)..(321): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaacacgctgtatttgcatatgaacagcctgagagccgaggacacggcgtatagttactgngacgagcttagcggttaccgctacgagttggggagcgacgtggtccgacccgtggggaccacgggaaccctggtaccgacccgtctcctccgacgccctaccgaccaacgggcccacgtccggtacccttccccgtcgcccgtaccctcctaccgaacgacgccgacccgtccgtcggggtaccacgacggccggccccgtacgggccctcggtcctccgggtaacgacggtacccttaaccgtttcccgtaccgttccgtacgttacgtacggtacggcggggtaccgtggaccggtaaggccggtaaccg

SEQ ID NO: 285396 - DNA, 627 bp, Homo sapiens
  misc_feature: GYAE6OF02IEK4U.12.78.H01.1.454.CMB.1.raw
  modified_base (245)..(245): a, c, t, g, unknown or other
  misc_feature (245)..(245): n is a, c, g, or t
  modified_base (266)..(266): a, c, t, g, unknown or other
  misc_feature (266)..(266): n is a, c, g, or t
  modified_base (351)..(351): a, c, t, g, unknown or other
  misc_feature (351)..(351): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (462)..(462): a, c, t, g, unknown or other
  misc_feature (462)..(462): n is a, c, g, or t
tcagatacgacgtacacgaccggtgctcgatttagtgtgagtagtttgggtttgggggaggcttggtacagccctggggggtccctgagactctcctgtgcagcctctggattcacctttagcaactatgccatgagctgggtccgccaggctccagtgaaggggctggagtgggtctcaggttattagtggtagtggtggtagcagatactacgcagactccgtgaagggccggttcagcatcnccagagacaattccaagaacncgctgtatttgcatatgaacagcctgagagccgaggacacggccgtatattactgtgacgaagcttagccggttaccggctacgngttggggncgatgtccgacccgtgggccacggacctggtcaccgtctcctcncgcctccaccaacggccagtccggtcccttccccgtggacccaccccgtcctacgaacncgccacctcggtcgggccacgacgccgggccctcggggtcctacggtcccgttacggtaccgtaaacggtacccgttaacccgtttccccggtaaccggttccgttaccttaccgtggacgggtccggggtacccgttaggggacccgtaacggggccctaacgg

SEQ ID NO: 285397 - DNA, 594 bp, Homo sapiens
  misc_feature: GYAE6OF02GTIUZ.12.78.H01.1.454.CMB.1.raw
  modified_base (285)..(285): a, c, t, g, unknown or other
  misc_feature (285)..(285): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (582)..(582): a, c, t, g, unknown or other
  misc_feature (582)..(582): n is a, c, g, or t
  modified_base (584)..(585): a, c, t, g, unknown or other
  misc_feature (584)..(585): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
  modified_base (593)..(594): a, c, t, g, unknown or other
  misc_feature (593)..(594): n is a, c, g, or t
tcagatacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggcctatattactgtgcgaancttagcggttaccggctacgattggggagcgactggttcgacccctggggccagggaaccctgtcaccgtctcctcagcctccaccaagggcccatcggtccttcccctggcacccctcctccaacgacgctaccctcgtcgggggccacgtacgccgggaccccgttggggccctggcccttacgggcaaacgggtaccttaaccgtttcccttaacggttaccgttatccttggaggtccggggcttgggaccaacgggaccgaccaacgttagagcgtagcgnacganacncanannanancngnn

SEQ ID NO: 285398 - DNA, 679 bp, Homo sapiens
  misc_feature: GYAE6OF02HWLCP.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtaggtggtggtagcagatactacgcagactccgtgaagggtccggttcagcatcctaccagagactaattaccaagaacacgctagtaatttgcatatagaacacggcctaggagagcccggaaggaccgaccggccgttaatactttaactgtcgacgaagtcttaggaccggttaccgactacggagttggggagcgtacgtcggttaccgacccggtcggggaccacgggtaaccctcgggtcccaccgttcctcctcgaccgtccctacccgaaccgaaccggtccctacgttcccggtccccttacccccgtccggaccctacccctaccctaccgaacgaccgccctacccgtcggtacggggaccaccgacggcccggtcccgtcgggtccgtcgtccgtaggtaccgtacgtaccttaccgttacccgtacgttaccgtacgtcgtcggacggccgggtccgtcggaccgagggccgtacg

SEQ ID NO: 285399 - DNA, 598 bp, Homo sapiens
  misc_feature: GYAE6OF02GDGTG.12.78.H01.1.454.CMB.1.raw
  modified_base (355)..(355): a, c, t, g, unknown or other
  misc_feature (355)..(355): n is a, c, g, or t
tcagatacgacgtacacgaccggtgctcgatttagtgtgagtagtttgggtttgggggaggcttggtacagcctggggggtccctgagactctcctgtgcgagcctctggattcacctttagcaactatgccatgagctgggtccgccaggctccagtgaaggggctggagtgggtctcaggtattagtggtagtggtggtagcagatactacgcagactccgtgaagggccggttcagcatctcagagacaattccaagaacacgctgtatttgcatatgaacagcctgagagccgaggacacggccgtatattactgtgcgaagcttagcggttaccgctacgagttggggancgtactggttccgacccgtggggccaggggaaccctggtccacccgtctccgtcacgcctaccaccaacgggcccagtccggtccttcccccgtggcccaccctccctccaacgacgccaccctcgtcggggaccacgacgccggcccgtgggcctcggcctcgggtccgaacggtaccttaccgttccgtaaccgttcgttacgttcgtggacgcgggccgttcgggacgacgggcgtaccg

SEQ ID NO: 285400 - DNA, 548 bp, Homo sapiens
  misc_feature: GYAE6OF02GQP72.12.78.H01.1.454.CMB.1.raw
  modified_base (270)..(270): a, c, t, g, unknown or other
  misc_feature (270)..(270): n is a, c, g, or t
  modified_base (516)..(516): a, c, t, g, unknown or other
  misc_feature (516)..(516): n is a, c, g, or t
  modified_base (520)..(548): a, c, t, g, unknown or other
  misc_feature (520)..(548): n is a, c, g, or t
tcagatacgacgtacacgaccggtgctcgatttagtgtgagtagtttgggtttggggacccccgggcagagggtcaccatttcttgttctggaacccactccaacatcggatataattctgtagactggtaccagcagcttccaggagcggccccccgatcctcatctttaataacaatcagcggcctcaggggtccctgaccgattctctggctccaagtctggcacctcagcctccctggccactcaggtgggcctccagtctggagntgaggctgatttattacgtgtgcatcagtgggctagacccacctgtacgttcgggaccgggtaggttcggttcggggcgggtaacgggaccaacggtcttacggacccgttaccgtagggtacccaggaccccgtaaggccaaccggtccccccgtagggccctaccgttccgttcgtaccccctacccgtcctccgttaccgtcgtactcgtagacggcgggctggacgtaaggtccgactgagntgannnnnnnnnnnnnnnnnnnnnnnnnnnnn

SEQ ID NO: 285401 - DNA, 737 bp, Homo sapiens
  misc_feature: GYAE6OF02IDJ09.12.78.H01.1.454.CMB.1.raw
  modified_base (288)..(288): a, c, t, g, unknown or other
  misc_feature (288)..(288): n is a, c, g, or t
tcagatacgacgtacacgaccggtgctcgatttagtgtgagtagtttgggtttgggggaggcttggtacagcctggggggtccccgagactctcctgtgcagcctctggattcacctttagcaactatgccatgagctgggtccgccaggctccagtggaaggggctggagtgggtctcaggtattagtggtagtggtggtagcagatacctacgcagactccgtggaagggccgttcagcatctccagacacaacttccaaagaacacgctagttatttgctatatnaacagcctgagacgccgaggacgacggccgtatacttactgtgacgtaagtcttaggcggttaccggctaacggagttagggacgcgacgttcggttccgaccccggtggggacccgaacgggtacccgtcggtcctacccgtccgtccctcgaccgcccttaccccgaacccggaaccgggtcccctaacgttcccggttcccgtttaccccccgtgggtacccctaccccgttaccccgttaacccgaacgaccggtacccgacccgttccgggtaccgggggacctaaccggcggtaccccgggtcccggtccggggtcccgttccgggtacccgtcggggtaaccgaacggtacccgtttacccgttacccgttaaccggtttccgttaacgttccgttcgggaaccggtcgggtaccggtacgggtaccgaacgggccagtacg

SEQ ID NO: 285402 - DNA, 731 bp, Homo sapiens
  misc_feature: GYAE6OF02IN9KY.12.78.H01.1.454.CMB.1.raw
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
tcagatacgacgtacacgaccggtgctcgatttagtgtgagtagtttggggtttggggggaggcttggtacagcctggggggtccccgagactctcctgtacaacctctggattcatgtttagtagtcattggatgaactgggtccgccagggctccgaggggaaggggtcttgggagtggggtggaccaaacgagtaaaaggcaaaggattgggaagtggaagtaatactagtggtaggtactcggtggtaggaagggcccgtattcgaactaacttctccgaagacgacaaccgccaagtacncacttgtatctgacaaataacagacctagaacgcgagacncggctgtagtattctggtcgaggacggtacggtccgtagggtagaacgtaatttattacaaaccgagtactaaacggttcgttaccgtacgtaacgtccgtacgactaactttacgtttacgaacgtaaggccgttacggggaccgtacgggtaaccgtcggtaccgaacccgttcgtacccgtcacggtaccctacccgaaaccggtaacgggccctacgtacccgggtttcccttcccccggtagcccccgtaccctacccgtaccgaacgtaaccgccgtaaccgtcggtagggggaccacggaccggccgggtaccgtcggcgtaccggtccggttacggacgaacgtacgtaccttcggtacgttctagactgacggtcgg

SEQ ID NO: 285403 - DNA, 635 bp, Homo sapiens
  misc_feature: GYAE6OF02FZFCP.12.78.H01.1.454.CMB.1.raw
  modified_base (325)..(325): a, c, t, g, unknown or other
  misc_feature (325)..(325): n is a, c, g, or t
  modified_base (360)..(360): a, c, t, g, unknown or other
  misc_feature (360)..(360): n is a, c, g, or t
tcagatacgacgtacacgaccggtgctcgatttagtgtgagtagtttgggtttggggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaacgggtccgttcagcatcctccagagactaattccaaagacacgctgtattgcatatgaacagcctgagagccgaggaccacggccgtatatactgtgngaagcttagcggttaccggctacgacgttggggancgacgtggttccgacccgtggggccaacgggaccctcggtccaccgtctcctcacgccctccaccgaacgggccctacgtcccgttcccgttccccgtcggccctacccctccctacccgaacgacgccacccgttcggtccggggacaccgaccggtccgggtcccgtcggggtcctcggtcccgtacggtaccgaacggtaccttaccgtttcccgtaccgttacgtacgttcgtaggaccgggtcgggtcgttcgggacgtacgggcgtacg

SEQ ID NO: 285404 - DNA, 656 bp, Homo sapiens
  misc_feature: GYAE6OF02G5W7Y.12.78.H01.1.454.CMB.1.raw
  modified_base (595)..(595): a, c, t, g, unknown or other
  misc_feature (595)..(595): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (616)..(616): a, c, t, g, unknown or other
  misc_feature (616)..(616): n is a, c, g, or t
  modified_base (655)..(655): a, c, t, g, unknown or other
  misc_feature (655)..(655): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggccccaaactcctcatctatagtaataatcagcgaccctcgaggggtccctgaccgattctctggctccaagtctggcacctcagccctcctggccatcagtcggctccagtctgagatgaggctagtacttattacgtgtgcagcagtgggatcgacagtaccgtagaagtcgggtaccggttaagttccgggacgggaacggggtaaccgaacggcgtacggacccggttaccgtacggttaccaaccggtacccgtaaacgggcctttacccggccccccgtttcgggtaccctaaccgttccgttcccggtttccccccgtcccctttcccgtaccgtttaacccggtccgttaagtcccgttacggaacggggtcccgggtcgttaccggggaacgtaaaccgggccgaacgtaacgttaacggcacgcgattcagtacncgtgngntnantagagtatcncgtcgagcgactacgcgtcgagacacgatagacgtcagng

SEQ ID NO: 285405 - DNA, 638 bp, Homo sapiens
  misc_feature: GYAE6OF02HROSR.12.78.H01.1.454.CMB.1.raw
  modified_base (191)..(191): a, c, t, g, unknown or other
  misc_feature (191)..(191): n is a, c, g, or t
  modified_base (608)..(611): a, c, t, g, unknown or other
  misc_feature (608)..(611): n is a, c, g, or t
  modified_base (614)..(638): a, c, t, g, unknown or other
  misc_feature (614)..(638): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctnaggggtccctgacccgattctctggctccaagtctggcacctcacgcctccctggcccatcaggtcggctaccagtctgaggtatgaggctgatttattactgtgctagctagtgggatgaacacggcctggacgttcgggtccggggagttcgggtttacgggacggggtagggaaccgaacggtcgtacggacccggttaccggtacgggtacctaacggtacccgaacgggacccacccggtaccccccgttcgggtacccctaacgttcccgtttaccgggttttcccccgtccccctttcccgttaccgtttaccccgggttacccgttacgttacccggtgggtaacccgggtccggggtacggttccgggaacggttaaacgggccgggaaccttagaggtcgatcgcgnnnncgnnnnnnnnnnnnnnnnnnnnnnnnn

SEQ ID NO: 285406 - DNA, 185 bp, Homo sapiens
  misc_feature: GYAE6OF02GBX9E.12.78.H01.1.454.CMB.1.raw
  modified_base (175)..(185): a, c, t, g, unknown or other
  misc_feature (175)..(185): n is a, c, g, or t
tcagatacgacgtacacgaccggtgctcgatttagtgtgagtagtttgggtttggggggaagaggaagactgacggtccccccaggagttcaggtgctgggcacagcggccctgggctgcctggtcaaggactacttcctacgtcgtatctgagcgggctggcaaggcgcatagnnnnnnnnnnn

SEQ ID NO: 285407 - DNA, 719 bp, Homo sapiens
  misc_feature: GYAE6OF02G06MP.12.78.H01.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaaagaccacgctgtatttgcatangaacagcctganagcgaggacacggcctatattactgtgcgaagtcttaggcggtttactggtctaacggtagttgggggagtaccggtacttcgggttccgacccccgttaggggggacccgtaacggggaaacccccgttgggtacccgtacccgttcccgtacccttaccgaccgtaccccggtacccccgtaaccgaaaccggggtccctaacgttcccgggtttacccccgttccccccgttacggacccctaacccccgttccccttaccgaaaccgacgccctaacccgtccgggtacgggggccaaacgcggtcccggaccccgtgggtaccctcggaccgttcgggacgaaccggtaccgttaccttcccgtaacgttcgttaacgtccgtacggacgggtaccgggtcgtacgggaccgagggtaccg

SEQ ID NO: 285408 - DNA, 684 bp, Homo sapiens
  misc_feature: GYAE6OF02F2YST.12.78.H01.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (295)..(295): a, c, t, g, unknown or other
  misc_feature (295)..(295): n is a, c, g, or t
tcagatacgacgtacacgaccggtgctcgatttagtgtgagtagtttgggtttggggggtagggcttggtacagcctggggggtccctgagactctcctgtgcagcctctggattcacctttagcaactatgccatgagctgggtccgccaggctccagtgaaggggctggagtgggtctcaggtattagtgtagtggtggtagcagatctacgcagactccgtnaagggccggttcagcatctccagngacaacttcaaganacgcngtatttgcattatgtaanagcttcgancgaccgaggaccacggccgtattattactagtgcgtaaagcttagtcggttaccggctaccgtagttggggacgcggtacgtcgggtacgtacccgtcggggccgacgggtaaccctgggtaccacccggtctccctccgacgccctacccgaccctaaaccgggcccaactcggtacccttccccccgtacgtcccgaacccctcccgttaccaaccgacgtaccctacccgtaccggtccgggggcaacccggtacggcccgggccccgtacgggcccgttacggtcccgtacggggtacctaacgggacccttaccgtttcccgtaccttacccggtacgttacgtcggtaacgggccggtccggttacgccggacggtgaacccg

SEQ ID NO: 285409 - DNA, 932 bp, Homo sapiens
  misc_feature: GYAE6OF02IY7W1.12.78.H01.1.454.CMB.1.raw
tcagatacgacgtacacgaccggtgctcgattttagtgtgagtagtttgggtttgggggaggcttggtacagcctggggggtccctgagactctcctgtgcagcctctggattcacctttagcaactatgccatgagctgggtccgccaggctccagtgaagggctggagtggtctcaggtattagtggtagtggtaggtagcagatactacgcagactcgtgaacgggccgttacagctatcctccagagacaataccaacgaacacgtctagtagtttgactaattagtacgaacgaccgtaccgtaggacggaacggacccgaacgggacccggaacccgggtaccgttaaacgtttaacgtttaccgtaagggtcggtaaaccgggaacgttaccgtttacgggttaacccggggtttacccgggtaacgttaccggttaaggggttacgggggacccgggtacgggtaccgtttaccggggttaacccccggtaacccccggggtaccggggggtaacccgtaacccggggtaaacccccggttcggttaccccgtaaccccggttttccccgtacccgttcccggtaccccggtacccccgttaaccccggaaaccccgggtaaccccgggacccccgttaacggtttcccccggtttccccctttcccccccggggaccggttacccccgtacccccgtttccccgaaccccggtaaacgaccccgtacccggtaaccccggttcccggggttaccgggggaaccctacccggtaaccgggccccgggttcgggacccgggttccgtaccgggtcccgttacgggtaaaccgacggttacccgtttaccgttccgttaaccgttacgggttccctacgttaccgggacgggtccgggtacgtacggtaccggacgttaccgaacg

SEQ ID NO: 285410 - DNA, 343 bp, Homo sapiens
  misc_feature: GYAE6OF02I75GV.12.78.H01.1.454.CMB.1.raw
  modified_base (93)..(93): a, c, t, g, unknown or other
  misc_feature (93)..(93): n is a, c, g, or t
  modified_base (314)..(314): a, c, t, g, unknown or other
  misc_feature (314)..(314): n is a, c, g, or t
  modified_base (319)..(343): a, c, t, g, unknown or other
  misc_feature (319)..(343): n is a, c, g, or t
tcagatacgacgtacacgaccggtgctcgatttagtgtgagtagtttgggtttggggggtgtggtggtctccactcccgccgggggggggttnacggggctgctatctgcctccctggccatcagtgggctccagtctgaggatgaggctgattattactgtgcagcatgggatgacagcctgaatggtccggtattcggcggagggacccaagctaggaccgtcctaggtccagcccaaggcctcgccccctcggtcactctcgttccccgccctcctctacgtctactcgtgagcgggctggccaaagggcnatagnnnnnnnnnnnnnnnnnnnnnnnnn

SEQ ID NO: 285411 - DNA, 533 bp, Homo sapiens
  misc_feature: GYAE6OF02HIKBS.12.78.H01.1.454.CMB.1.raw
  modified_base (496)..(496): a, c, t, g, unknown or other
  misc_feature (496)..(496): n is a, c, g, or t
  modified_base (502)..(533): a, c, t, g, unknown or other
  misc_feature (502)..(533): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcacggggtccctgaccgattctctggctccaagtctggcacctcagcctccctggccatcaggtgggcctccagtctgagatgaggctagtattattactgtgcatcagtggctgacctacccgtgacgtgggtccgggagtcggttcgggcgggaagggaccagtccgtcggaccgtccgtacggtcacgcccgaagccgaccgtccccgtcggtccacgttcctccgttccccacccttcctcgttaccgtctacgttcgtacgcgggtccgggcgtacgaccggaacggccgactaatacggnactagnnnnnnnnnnnnnnnnnnnnnnnnnnnnnnnn

SEQ ID NO: 285412 - DNA, 729 bp, Homo sapiens
  misc_feature: GYAE6OF02JRXT5.12.78.H01.1.454.CMB.1.raw
  modified_base (402)..(402): a, c, t, g, unknown or other
  misc_feature (402)..(402): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccacggctccagtggaaggggctggagtgggtctcgaggtattagtggtagtcggtggtagcagatacgtacgcagactccgtggaacgggccgttcagcatcctacagagacatcaagacacgctgtattgactatatagaacacggcctggagacggaccggaacggaccgaaccggtccgtaagttacgttacgtggtacgacgtaacggtcttacgggtaccggttaccggactaacggtggttagggggacncgtaacgttcggttacccgaccccggtgggacccgtacggggtaacccctcgggtacccgtacccgtcgtaccgtcgaccggtaccctcccgaacccggtacggaccctacggtcccggttacccgtccccgtcgacccgtaccctcccacgtacgacgacccgccgttccggacgggtccaccgtacggccccgggtccgtcgggtcccgtcggtcccgtcggtaccgtaccggacccgtttaccgttacccgttcggttaaccgtaccgtaccggttacggaaccggggcggttcccggacggtaccggaccggttcgtaaccgg

SEQ ID NO: 285413 - DNA, 308 bp, Homo sapiens
  misc_feature: GYAE6OF02GOF2M.12.78.H01.1.454.CMB.1.raw
  modified_base (304)..(308): a, c, t, g, unknown or other
  misc_feature (304)..(308): n is a, c, g, or t
tcagatacgacgtacacgaccggtgctcgatttagtgtgagtagtttgggtttggggggtgtggtggtctccactcccgccttgacggggctgctatctgcctccctggccatcagtgggctccagtctgaggatgaggctgattattactgtgcagcatgggatgacagcctgaatggtccggtattcgggcggagggaccaagctgaccgtcctaggtcagcccaaggctcgccccctcggtcactctcgttccccgcctcctctacgtcgtatctgagcgggctggacaaggcgtcatagnnnnn

SEQ ID NO: 285414 - DNA, 200 bp, Homo sapiens
  misc_feature: GYAE6OF02H2T6M.12.78.H01.1.454.CMB.1.raw
  modified_base (177)..(200): a, c, t, g, unknown or other
  misc_feature (177)..(200): n is a, c, g, or t
tcagatacgacgtacacgaccggtgctcgatttagtgtgagtagtttgggtttggggggaagaggaagacgtgacggtccccccaggagttcaggtgctgggcacagcggccctgggctgcctggtcaaggacctacttcctacgtcgtatctgagcgggctggcaaggcgcatagnnnnnnnnnnnnnnnnnnnnnnnn

SEQ ID NO: 285415 - DNA, 696 bp, Homo sapiens
  misc_feature: GYAE6OF02GSVWS.12.78.H01.1.454.CMB.1.raw
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgagggctggagtgggtctcgaggtattgtggtagtggtggtagcagatacacgcagactccgtgaacgggccgttcagcatctcagacacataccaagacacgctagtatttgactatatgaacagccgtagagacgccggacggacacggtccgtaatacttacgtgtggacgaacgtcgttacgggtaccggttaccggcgtacgtaggttacgggacgtcgtacgttcgggtccgaccccggtggggaccgacggggtaccccgtcgggttaccacccgtttcgtaccctcgaccgtaccctacccgaccggaaccggcccctacgttcccggttcccttcccccgtcggacccctcccctaccgtaccaacgcgtacctcccgtcgggccgggaccaccgggacgcccgggtcccggtacggtccgtccggtacccgttgggaaccctaacgggtaccttacccggttcccttaccggtaccgtcgttccgtacgggtacggtcccggggtcgtagggaccggtacggcgtacgg

SEQ ID NO: 285416 - DNA, 536 bp, Homo sapiens
  misc_feature: GYAE6OF02HNMOR.12.78.H01.1.454.CMB.1.raw
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (502)..(502): a, c, t, g, unknown or other
  misc_feature (502)..(502): n is a, c, g, or t
  modified_base (505)..(536): a, c, t, g, unknown or other
  misc_feature (505)..(536): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcacggggtccctgaccgatttctctggctccaagtctggcacctcagcctccctggccatcagtggctccagtctggaggntggnggctgatttattactgtgnagcagttgggatgacagccgtagaagttgggtccggtagtttccgggacgggaagggaccgtaaggcctaggtacccgtcgtaggtcgacgcccgaaggcctcccgccccgttggtccaccttccgtccgttccccacccttcccttacgtaccgtccttactcgtggacgggtccggcggtacgggcgaacgggtccacgtagtagnctnnnnnnnnnnnnnnnnnnnnnnnnnnnnnnnn

SEQ ID NO: 285417 - DNA, 813 bp, Homo sapiens
  misc_feature: GYAE6OF02H6I0T.12.78.H01.1.454.CMB.1.raw
  modified_base (314)..(314): a, c, t, g, unknown or other
  misc_feature (314)..(314): n is a, c, g, or t
tcagatacgacgtacacgaccggtgctcgatttagtgtgagtagtttgggtttgggggaggcttggtacagcctgggggggtccctgagactctcctgtgcagcctctggattcacctttagcaactatgccatgagcttgggtccgccaggctccaggtgaaggggctggaggttgggtctcgaggttattagtgggtaggtggtaggtagcgagaactaccgtacgcacgacctccggtaggaacggggtcccgttcgagctatcctaccaaggagactaacttaccgaaagaaccacgcttagttactttnactaatatagaacagtcctaggacaggaccgtagaaccgacggctattatacgtggtacgacggtaacgcgttacggtcggttaaccggctacggtaggttacggggaacgtcgtaccggttcggttccccggacccggttggggaacccgtaacgggaccccggttcggtacccggacccgttccgttacccgtaccgtacccgacccgttacccccgaaacggtaacccggggtaccctaacggttccccgggttcccctttacccccggtaggtaccccttacccccgtaccctaacccggttaaacgaccgtccccgtaacccggttcccggggtacggggtacccgacgtaacccggggtccccggcccgggttacgggtcccgtggtacccggttacggtaaccggtaaccgtaccgtttacccgttacccgttaaccgttaccgtacgttaccgcggtacggaccgggtcggacggtaacgacggagtaccg

SEQ ID NO: 285418 - DNA, 627 bp, Homo sapiens
  misc_feature: GYAE6OF02GOLE2.12.78.H01.1.454.CMB.1.raw
  modified_base (592)..(592): a, c, t, g, unknown or other
  misc_feature (592)..(592): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
tcagatacgacgtacacgaccggtgctcgatttagtgtgagtagtttgggtttgggggaagaggaagactgacggtccccccaggagttcaggtgctgggtccgccaggctccagtgaaggggctggagtgggtctcaggtattagtggtagtggtggtagcagatactacgcagactccgtgaaggccggttcagcatctccagagaccaattccaaagaacacgctagtatttgcatatagaacagccctagagtacgccgaggaccacggaccgtatattactgtgacgaagtcttagtacggttaccggcgtaacgagttggggagtacgacgtcggttccgacccgtcggggaccacggaaccctggtcaccgtctcctcacgcctaccacaacggccagtccgtcttcccctggcctacctccctaccgaaacgacgctaccgtacgtcggggacaacgacgaccggtcccgtcgggtctcgaccgtcgggtaacgtaaacggacttaaccgtacccgttacgttacgttacgttacgtacgggtaccggacgggtacgtcggtacgaacggtcgtacaagtacgngagcgtgctancgtancaggcacgatgacacagac

SEQ ID NO: 285419 - DNA, 544 bp, Homo sapiens
  misc_feature: GYAE6OF02F0EAF.12.78.H01.1.454.CMB.1.raw
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (529)..(529): a, c, t, g, unknown or other
  misc_feature (529)..(529): n is a, c, g, or t
  modified_base (532)..(532): a, c, t, g, unknown or other
  misc_feature (532)..(532): n is a, c, g, or t
  modified_base (536)..(539): a, c, t, g, unknown or other
  misc_feature (536)..(539): n is a, c, g, or t
  modified_base (541)..(543): a, c, t, g, unknown or other
  misc_feature (541)..(543): n is a, c, g, or t
tcagatacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtggtagcagatactacgcagactccgtgaagggccggttcagcatctccagagacaattccaagaacacgctgtatttgctatatgaaacagcctgagagccgaggacacggccgtatattactgtgacgaagcttagcggttacggctacgattggggagcgactggtcgacccgtgggccagggaccctggtcaccgtctcctcagccncaccaacggccatcggtccttccccgnggcacccgtcctaccaagacgcacctcgtcggggcacgagccggccgtgggctcgcgtgtcgaaacgtactacgttcctacgtcgtactctaggacgcggtcgcggacaacgggcgacgagtagtgannancganacnagcnnnncnnnc

SEQ ID NO: 285420 - DNA, 242 bp, Homo sapiens
  misc_feature: GYAE6OF02JS07O.12.78.H01.1.454.CMB.1.raw
  modified_base (221)..(221): a, c, t, g, unknown or other
  misc_feature (221)..(221): n is a, c, g, or t
  modified_base (226)..(242): a, c, t, g, unknown or other
  misc_feature (226)..(242): n is a, c, g, or t
tcagatacgacgtacacgaccggtgctcgatttagtgtgagtagtttgggtttggggaggatgaggctgattattactgtgcagcatgggatgacagcctgaatggtccggtattcggcggagggaccaagctgaccgtctaggtcagcccaaggctgccccctcggtcactctcgttcccgccctcctctacgtcgtatctgagcggctggacaaggcgnatagnnnnnnnnnnnnnnnnn

SEQ ID NO: 285421 - DNA, 640 bp, Homo sapiens
  misc_feature: GYAE6OF02IPCYL.12.78.H01.1.454.CMB.1.raw
  modified_base (223)..(223): a, c, t, g, unknown or other
  misc_feature (223)..(223): n is a, c, g, or t
  modified_base (413)..(413): a, c, t, g, unknown or other
  misc_feature (413)..(413): n is a, c, g, or t
tcagatacgacgtacacgaccggtgctcgatttagtgtgagtagtttgggtttgggggaggcttggtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgngaagggccgttcagcatctccagagacaattccaaagaacacgctgtatttgcatatgaacagcctgagagccgaggacacggccgtaatattactgtgcgaagcttagcggttaccggctacggagttggggagcgacgtggttacgaccccgtgggggcccaaggggaaccctgggtaccacccgtcncctacgacgccctaccgaaccgaacgggcccacgtccggttcccttccccgtcggcccaccctccctaccgaacgacgccacccttcggcggggaccaccgacggcccggcccgtacgggccgtcgccgttcgggtaccgaacgggtacccttaccgttcccttaccggttaccgtacgttaccgtacggacggtccggggcgttacgggccgtacgggccgtaacg

SEQ ID NO: 285422 - DNA, 816 bp, Homo sapiens
  misc_feature: GYAE6OF02GWMHI.12.78.H01.1.454.CMB.1.raw
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (276)..(276): a, c, t, g, unknown or other
  misc_feature (276)..(276): n is a, c, g, or t
tcagatacgacgtacacgaccggtgctcgatttagtgtgagtagtttgggtttgggggaggcttggtacagccgtgggggtccctgagactctcctgtgcagcctctggattcacctttagcaactatcgccatgagctgggtccgccaggctccagtgaaggggctggagtgggtcngaggtnttagtggtagtggtggtagcgagactacgtcgcgagacctccgtgaacgggtcccggttcagcatctccagagacaagttccaaaggacacncgtgtatttgcaattagtagtaacgacgccttgacggacggacccgacggggaacctaccgggaccgtagttaactttacgtaggtaggtaccggaaacgtcgttaacggtaccggttaacccggtcgttaaccggtaaggtttagggggaaggtaccgacgttcgggttttacccggacccccggttagggggaaccccgtaacggggtaaaccccgttcgggtcccgtaacccgggttcccttcccgttacgaacccggtcccctaaccccggaacccggtaaacccggggtccccgtaacgttcccgggttccccgttttaccccccgcggggtcccccttacccgtacccgttaacccgtaacgacgtccctccggtccgggtaccggggaccgtacccggacggcccgcccggttccgggtaccgtccggtaccgtccggtacgtaaccgggttaccgttaccgtttacccggttaccggttacgtggttaccgtagtacgggccgggtgttaccgggacaccgggtctaaccgg

SEQ ID NO: 285423 - DNA, 801 bp, Homo sapiens
  misc_feature: GYAE6OF02G8XTT.12.78.H01.1.454.CMB.1.raw
  modified_base (218)..(218): a, c, t, g, unknown or other
  misc_feature (218)..(218): n is a, c, g, or t
  modified_base (708)..(708): a, c, t, g, unknown or other
  misc_feature (708)..(708): n is a, c, g, or t
  modified_base (737)..(737): a, c, t, g, unknown or other
  misc_feature (737)..(737): n is a, c, g, or t
  modified_base (740)..(740): a, c, t, g, unknown or other
  misc_feature (740)..(740): n is a, c, g, or t
  modified_base (754)..(754): a, c, t, g, unknown or other
  misc_feature (754)..(754): n is a, c, g, or t
  modified_base (759)..(759): a, c, t, g, unknown or other
  misc_feature (759)..(759): n is a, c, g, or t
  modified_base (787)..(787): a, c, t, g, unknown or other
  misc_feature (787)..(787): n is a, c, g, or t
tcagatacgacgtacacgaccggtgctcgatttagtgtgagtagtttgggtttggggacccccgggcagagggtcaccatctcttgttctggaagcagctccaacatcggaagtaatactgtaaactggtaaccagcagctacccaggaaccggccccaaactcctcatctataagtaataatcacgcgaccctcgacgggtccctcgaccgtattcncgtcggtactacctaacgtcgtcgaccaccctcgacgtcccttccgcggcctactccgtagggtccggtacctcctacgtcgttaaggaggtttttgacggacggtaccgtaggtatttaacttacgttggacgtaccgacgtaccgtaggttacgggtagtacggtaacctaccggtaacctaacgggtaaccgttcgggttaacccggttacgggttacccggggacgggtaaacccgggtaacgtaacggtacgttaccgggaaccgttacccggtacggtacccaaccggacccggtaacgggtcccggtaacccggtcccccggttacgggtaacctcccgttaacccgttcccggtttaaacccccccgtcccgttcccgttaaaccggttcccgggtttacttaccgggtccggttacgggtacccgggtcggttccggacgggttaacccggaccggtaaccgttaccggaaagttccgtancgccgaatccgaagggcttaagggtaacncgngacgtacgtcgacncgcgnagcgcgtacgtacgctagtactcgcgcncgactctacgacta

SEQ ID NO: 285424 - DNA, 789 bp, Homo sapiens
  misc_feature: GYAE6OF02GHB7X.12.78.H01.1.454.CMB.1.raw
  modified_base (175)..(175): a, c, t, g, unknown or other
  misc_feature (175)..(175): n is a, c, g, or t
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (292)..(292): a, c, t, g, unknown or other
  misc_feature (292)..(292): n is a, c, g, or t
tcagatacgacgtacacgaccggtgctcgatttagtgtgagtagtttgggtttgggggaggcttggtacagcctgggggtccctgagactctcctgtgcagcctctggattcacctttagcaactatgccatgagctgggtccgccaggctccagtgaagggctggagtgggtcncaggtattagtggtagtggtggtancgtagatactacgcagactccgngagggccgttacagcgtatcgcagacgacaattccaagacacgctcgtattgcatatgaacagctaganacgccgaaggacgacggaccgtatattctagtcgcgtaagcttagcggttaccgcgtacgtagttaggggctacgacgttcgggttccgaacccggttggggacccgaagggtaacccgtcgggtacgtacccggtttctaccccgtacgtaccggtaccctaccccgaaaacggtaacccggggtccctaaccggtttaccccgggtttccccgtttaacccccccggttcggggtcccccttaaaaccccccttccccggtttaacccggtaaaccgtaaccccgggtaccctaacccccgggtttacgggttaacccggggggaacccgaccggtaaacccggggtccccgggtaccccggttaacgggggttccctacggttccccgttaacggggttacccgaacggtttaaccgtaccgttttacccggtaccgttacgttaacgtacgttcggaagggtccggtcgtccggtaacggacggttcaaccgg

SEQ ID NO: 285425 - DNA, 999 bp, Homo sapiens
  misc_feature: GYAE6OF02JWMWP.12.78.H01.1.454.CMB.1.raw
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
tcagatacgacgtacacgaccggtgctcgatttagtgtgagtagtttgggtttggggggaggcttggtacagcctggggggtccccagactcgtcctgtacaacctctggattcatgtttagtagtcattggatgaactgggtccgcaggctcgagggagggctggagtgggtgccaanataagcaagngtggaagtganaaatctatgtaggacttgtgtaggacgggcctattcaacgaacgttcctccgaagtacgaacctaaccggacctaaagtaacctcgtacgttcggttaactcgtacgaaacctaaaagtaaccgacgttacctaaggaaaccggccggtaaacggacccgtaacgggttccgttaggtttaccggttaaccgttttaccggtagggtacgggtaaccgggttaccggggtaacccgtttacccggggttaacgggttaacgtaaaccgtttttaaaacgtttttacccggtaaacccgtaaaaccggttaaaaccggttaaccgttaaaacggggtttttcccggttaaaccggtaacccggttaaaccgggtttacccgttaaccgtaaacccggtttacgttttaaaccggtttacgggaaaccgttaccggggttacccggtaaccgggggggtaaaccccgtaaccgggggttaccccctttacggggtaaacccccgttcccggttaaccccgttccccgtaaaccggtacccgtaacccggttacccgaaaccccggggtaacccggttcccgtaaccggttttccccggtacccccgtttccccggaacgttcccccgttaaacccttcccgggaaacgtacccgtcccggtaacccggttacggaccgggtcgggaaccctacggtaccgggccgttcccgagggttcctaacccgggtcggttccgtaacggtaaccgtaccgtttcccgtaacggttcgtaccgtttaggccgttaggccggttaccgg

SEQ ID NO: 285426 - DNA, 191 bp, Homo sapiens
  misc_feature: GYAE6OF02I8717.12.78.H01.1.454.CMB.1.raw
  modified_base (176)..(191): a, c, t, g, unknown or other
  misc_feature (176)..(191): n is a, c, g, or t
tcagatacgacgtacacgaccggtgctcgatttagtgtgagtagtttgggtttggggggaagaggaagactgacggtccccccaggagttcaggtgctggggcacagcggccctgggctgcctggtcaaggactacttcctacgtcgtatctgagcgggctggcaaggcgcatagnnnnnnnnnnnnnnnn

SEQ ID NO: 285427 - DNA, 590 bp, Homo sapiens
  misc_feature: GYAE6OF02GXJJK.12.78.H01.1.454.CMB.1.raw
  modified_base (265)..(265): a, c, t, g, unknown or other
  misc_feature (265)..(265): n is a, c, g, or t
  modified_base (518)..(518): a, c, t, g, unknown or other
  misc_feature (518)..(518): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (554)..(554): a, c, t, g, unknown or other
  misc_feature (554)..(554): n is a, c, g, or t
  modified_base (564)..(564): a, c, t, g, unknown or other
  misc_feature (564)..(564): n is a, c, g, or t
tcagatacgacgtacacgaccggtgctcgatttagtgtgagtagtttgggtttgggacccccgggcagagggtcaccatctcttgttctggaagcagctccaacatcggaagtaatactgtaaactggtaccagcagctcccaggaacggcccccaaactcctcatctatagtaataatcagcgaccctcgaggggtccctgaccgattctctggctccaagtctggcacctcacgcctccctggccatcagtcggctccagtcngagatgagctgattatactgactatcagtggtctcgacctaccgtgaccgtgggtccggagttcggttcggacggacgggaccaaggtccgtacgtacccgtccgtaggtccgaacgacccgaagccgaccggtcccccgtcggtaccacgttccgtccgttacccccacccgttccctcgttaccgtcgttacgtccgtaggtaccggtccgggtctacgggacgaacggccgaacgtagtacgcgtcgacncgacngcgtcgngcgancgcncgcgcacgcgcgacncgtcgcgtcncgcgtctacgcgcgcacacgtcgtgc

SEQ ID NO: 285428 - DNA, 656 bp, Homo sapiens
  misc_feature: GYAE6OF02I8RDO.12.78.H01.1.454.CMB.1.raw
  modified_base (629)..(629): a, c, t, g, unknown or other
  misc_feature (629)..(629): n is a, c, g, or t
  modified_base (640)..(640): a, c, t, g, unknown or other
  misc_feature (640)..(640): n is a, c, g, or t
  modified_base (650)..(650): a, c, t, g, unknown or other
  misc_feature (650)..(650): n is a, c, g, or t
  modified_base (652)..(652): a, c, t, g, unknown or other
  misc_feature (652)..(652): n is a, c, g, or t
  modified_base (655)..(655): a, c, t, g, unknown or other
  misc_feature (655)..(655): n is a, c, g, or t
tcagatacgacgtacacgaccggtgctcgatttagtgtgagtagtttgggtttggggggaagaggaagactgacggtccccccaggagttcaggtgctgggtccgccaggctccagtgaaggggctggagtgggtctcaggtattagtggtagtggtgggtagcagatactacgcagactccgtgaagggccggttcagcatctccagagacaattccaaagacacgctagtatttgcatatgaacagcctgacgacgccggaggacacggccgttatattactgtgcgaagcttaggcggttaccggcgtaacgaggttggggacgcgacgttgggttccgaccccggtggggcccgaacggggtaacccgtggtaccacccgtcctccctaccgacgccctaccacccgaacgggccctacgttaccggtcccttccccgtggccctaccccgttcccacccgaacgaccgacctaccgtcggtcggggaccacgacggcccggcccggtcgggctccgtccgtcggtaccgaacggaccttacccgttacccgtccgttaccgtaccgttcggtacggccggtccgggtcgtcgggaccgaacgggcggaccgtaagtacgtcagnacgtgcagtcntcgcgcacgncncgnc

SEQ ID NO: 285429 - DNA, 498 bp, Homo sapiens
  misc_feature: GYAE6OF01BWCT2.43.73.G07.1.454.CMB.1.raw
  modified_base (125)..(125): a, c, t, g, unknown or other
  misc_feature (125)..(125): n is a, c, g, or t
  modified_base (129)..(129): a, c, t, g, unknown or other
  misc_feature (129)..(129): n is a, c, g, or t
  modified_base (135)..(135): a, c, t, g, unknown or other
  misc_feature (135)..(135): n is a, c, g, or t
  modified_base (185)..(185): a, c, t, g, unknown or other
  misc_feature (185)..(185): n is a, c, g, or t
  modified_base (356)..(356): a, c, t, g, unknown or other
  misc_feature (356)..(356): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
tcagtgtgagtagtcacgaccggtgctcgatttagctctacgctcagggggagactgaagaacccagcattgcagcagctccaccatggcctgggctcctctgctcctcaccctcctcatctccncacnggtccncgtccagctagtgctgactcagccaccttctgcatcagcctccctgggancctcggtcacactcacctgcaccctgagcagcggctacaatgaatataaggtggactggtaccaacagagaccaggggagtgcccccgatttgtgatgcgagtgggcccggatgggatggcgggatccgaagggggatggcatccctgactcggtctcagtcttgggctcnggcctgactcggtccctagaccatcaacaacatccaggaagaggaatgacagtgaactactaactgtggacgaattatggcagtaggaataccgtanatgtagtgtnttggagtgggacaggtcacgtacaagtcngacccg

SEQ ID NO: 285430 - DNA, 495 bp, Homo sapiens
  misc_feature: GYAE6OF01EYZ02.43.73.G07.1.454.CMB.1.raw
  modified_base (459)..(459): a, c, t, g, unknown or other
  misc_feature (459)..(459): n is a, c, g, or t
  modified_base (489)..(489): a, c, t, g, unknown or other
  misc_feature (489)..(489): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatgggcgggatccaagggggatggcagtccctgatcggttctcagtcttgggctcaggcctgactcggtccctgaccatcaacaacatccaggaagaggatgacagtgactatactgtggacgaattatggcagtgggaatactacatgtatgtntttggagtggagaggtcacgtacaaggtcngacccg

SEQ ID NO: 285431 - DNA, 654 bp, Homo sapiens
  misc_feature: GYAE6OF01C7JVX.43.73.G07.1.454.CMB.1.raw
  modified_base (282)..(282): a, c, t, g, unknown or other
  misc_feature (282)..(282): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctaggtcacactcacctgcacctgagcagcgctacaatgaatataaggtggactggtaaccaacagagaccgaggggagtcgccccgatttgngatgcgagtggccggatgggatggcgggatcgaaggggatgggcagtcccgtgactcgggttctcgagttcgtttgggcttcgaggtcctgaccgtcgggtccctggacccatcaaacaaacataccgaagggaaacgagggaatggaactaggtgaacttaacgtacgttgggtacgggaacgtaaattagtacgggacgaaggttaggggtaaacttacccgtaacgtaagttaggttaagttacgggtttaccgttttaagggggaaacgggtttacggggggtaaaaccggttaaaacggggttacccggtaaaccccgggttaaccgtaaaacgggggttcccgaaacggggtaaaacccccccggg

SEQ ID NO: 285432 - DNA, 554 bp, Homo sapiens
  misc_feature: GYAE6OF01C0TVT.43.73.G07.1.454.CMB.1.raw
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagccctccctgggagcctcggtcacactcacctgccaccctgagcagcggctacatgaatataaggtggactggtaccaacagaagaccgaggggagtgcccccggatttgtgatgcgagtgggcccggatgggatgggcgggagtccgaagggggntggcagtccctgattcggtctcgagtcgtgggctcgaggcctgacgtcggtccctgaccatcaacaacataccaggaagaggatagacagtanactacgtatggtaggacgtaagttagtaggctaagggtagggaacttaaccgtactagttagttagtggttacgtttagggaaggttggggaacgtaggtaccgtaccgtaccaaagtgtcgtaacccgg

SEQ ID NO: 285433 - DNA, 620 bp, Homo sapiens
  misc_feature: GYAE6OF01EEPVF.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagccctcccgtgggacgccgtcggtcacacctccacctgccaccctgacgcagcggctacaatgaatataaggtggactggtaccaacagagaccgaggggagtcgcccccgtatttgtgatgcggaggtcggggcccggagtgggatgggcgggagtccggaagggggatggctagtcccgtggagtcggttctcgagttcgttcgggctcgaggtcctgacgtccggtccctcgaccatacaacaacactccgaaggaagaggatagacaggtataactacgtacgtggtacgggaacgtaagttagtagggacgtaagggtacgggtaacgttaaccgtacgtaagttagttaaggttgtttacggttttagggaagggttacggggaacggtaacgggttcccgaaccggttacccgaagggttccgacggtaaacccccgg

SEQ ID NO: 285434 - DNA, 651 bp, Homo sapiens
  misc_feature: GYAE6OF01DNQDF.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgccacctgagcagcggactacaatgaatataaggtggactggtaccaacagagaccaggggagtcgccccgatttcgtgatgcggaggtcgggccggagtgggagtgggcgggatccggaagggggatgggctacgtccgtgacgtcggttctcgagtcgttgggctcgacggcctggactcggtccctgaccgatacaacaacactaccgaaggaagacggtatagaactagttacgaacttacgtaacgttggtaacgggtaacgtaagtttaagtacggtacgtaagggttagggaaacttaaccgttaacgagtttaggtaagtttcgggtttaacgttttaaggggtaaagggttacgggggtaaacggtaaaccggggtttaccgtaaaccccgggttacccggtaaacggggttcccgaaacggtaaacccccccggg

SEQ ID NO: 285435 - DNA, 921 bp, Homo sapiens
  misc_feature: GYAE6OF01EWCBI.43.73.G07.1.454.CMB.1.raw
tcagtgtgagtagtcacgaccggtgctcgatttagctctacgctcagggggagactgaagaacccagcattcgcacgcgagtctccgacctatggtcctgggctcctcgtgctacctcaccctcctcacgtcctcctcgacgtagggtccctcgtcccagtctttgttgtctggacctctaagtcctaccttctgcagtcacgcctcccgtggggacgccgtcggtcgacacttcacctcgcctaccggtgacgcgagccggctacgtaagtgaatagtaacggtggactcggtaaccaactacgaagaccgagggacgtcgacccccgtagtttcggcgacgtggccggaggtcggggacccggagtggggagtggggcgggtagtaccgggtaagggggtacgtggggcgtacggttcccggtaggtacgttccggtttacttccggtacggttcggttcgggcgttaccggacgggtcccgtacgggttaacccgttcccgggtaccccttaccggaaccctaacgttaacccgaaaacccgtaaaaccgtaaccgttaacccggaaaagggtaaacggtaacgggtaacgtaacggtaacgtaacggttaacgtaaaccgtttaaccgttaacggtacggttacggggtaaaccggttaaacgtttaacgggtaccggggtaacgttaacggggttaacggggtaaaaacccgtttaaacccggttaacgtttaacggttacgggtttaaacggtttaccgggtttaaaccgggttttaaagggggtaaaccgggggtttaacgggggtaaaaacccgggttaaaccggggtttaaccccggttaaacccggggttaaaccccccggttaaaacgggggttaaccccggtaaaccgggggttaaaaacccccccggg

SEQ ID NO: 285436 - DNA, 649 bp, Homo sapiens
  misc_feature: GYAE6OF01B9BMM.43.73.G07.1.454.CMB.1.raw
  modified_base (167)..(167): a, c, t, g, unknown or other
  misc_feature (167)..(167): n is a, c, g, or t
  modified_base (253)..(253): a, c, t, g, unknown or other
  misc_feature (253)..(253): n is a, c, g, or t
tcagtgtgagtagtcacgaccggtgctcgatttagctctacgctcagggggagactgaagaacccagcattgcagcagctccaccatggcctgggctcctctgctcctcaccctctcagtctcctcacaggtccctctcccagcttgtgctgactcagccaccttcngcatcagcctccctgggacgcctcggtcacactcacctgccacctgagcagcggctacatgaatataaggtggactggtaaccaanaggagaccgaggggacgtcgccccgtatttcgtagatgcgaggtcgggcccggagtgggagtgggcgggacgtaccggaagggggagtcgggactacgtcccgtagacgtcggttctcgagtcgttcggcttcgacggtcctgtaccgtccggtaccctcggacctacgactaaaccaactacgtaaccgaaggaacgacggatacggacgagtacgactacgtacgtcggtaggtaaccgtaagttacgttaggacgtaaggtagggtaaacttaccgtacgtaagttacgtagtttcggttacggtttagggtaacgggttacgggtaaaccgggtaacgggttacctaaacccggtaccgggtaaacggttcccgaacgggtaaaccccccgg

SEQ ID NO: 285437 - DNA, 838 bp, Homo sapiens
  misc_feature: GYAE6OF01D0O6C.43.73.G07.1.454.CMB.1.raw
  modified_base (131)..(131): a, c, t, g, unknown or other
  misc_feature (131)..(131): n is a, c, g, or t
  modified_base (171)..(171): a, c, t, g, unknown or other
  misc_feature (171)..(171): n is a, c, g, or t
  modified_base (195)..(195): a, c, t, g, unknown or other
  misc_feature (195)..(195): n is a, c, g, or t
tcagtgtgagtagtcacgaccggtgctcgatttagctctacgctcaggggggagactgaagaacccagcattgcagcagctccaccatggcctgggctcctctgctcctcaccctcctcagtctcctcacngggtccctctcccagcttgtgctgactcacgccaccttcngcatcacggccctccgtggggacnccgtcggtacactactcacctgccaccgtgacgcacggccgtactaacaataggaataacgtaagggtaggacgtacggtaaccaacgacggaacggaaccggagggggtacgtaccggtccccggttaagtttggacggtaagtcggacggtacgggttcggggacccgggtaggttacggggacggttcggggaccggggtaacggttaccgggaaggggggtaacgtcggggaccgtaacgttccggttaggtacggttccgggtttctcggtacggttcggttacgggtccgtacggtccgggtccgttacggtacccgttccgggtacccgtacgtaacctaacgtaaccaaactaaccgtaacgtaaccggaaagggaacggaaggtacgtaacgaacgtaacggtaacgtaaccgttaacgtaacggttacgggtaagggtaaacggttaagttaacggtacgggtaaccggttaagggtaacgggtaaaccttaaccggttaacgtaagtttaacggtttacggtttacgggttacggttttaacggggaaggggtttacgggaaaccgggtaacgggttacccggtaaaccgggttaacccggaacgggttaccggaaccggaaacccccgggg

SEQ ID NO: 285438 - DNA, 778 bp, Homo sapiens
  misc_feature: GYAE6OF01EAHPQ.43.73.G07.1.454.CMB.1.raw
  modified_base (189)..(189): a, c, t, g, unknown or other
  misc_feature (189)..(189): n is a, c, g, or t
  modified_base (288)..(288): a, c, t, g, unknown or other
  misc_feature (288)..(288): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggacncctcggtcacactcacctgccaccctgacgcagcggactaacaatgaatagtaaggtgactggtaccaacagagaccgagggagtcgccccgtatttgngatcggcggaggtcggggacccggtagtggggagtcgggacggggtagtaccgggaaaggggggacttcggggacgtaacgttccccgtaggtaacgtttccgggtttcgttacggtacggtttccggtttaggggccgttacggaaccgggttcccgttacgggtaacccgttcccgggttacccctacggaacccctaacgttaaccctaaaaccgaaaccgtaacgttaacccggaaaaggggtaaacgggtaagggtaagtacggaaacgtacggttaacgtaacccgttacgttaacgttggggtaacgggtagtttaacggtaaagttttacggtacgggtacgtaagggttaacgggtaaaccttaaccgtaacgttagttagtttacgttaggtttacggtttaggggaaagggttacggggaaaccggttaacgggttacccggtaaccggttaaccgggaaacggttcccgaaacccggg

SEQ ID NO: 285439 - DNA, 570 bp, Homo sapiens
  misc_feature: GYAE6OF01ATW8V.43.73.G07.1.454.CMB.1.raw
  modified_base (331)..(331): a, c, t, g, unknown or other
  misc_feature (331)..(331): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgacgcagcggctacaatgaatataaggtgactggtaccaacagagaccaggggagtcgcccccgattgtgatgcgaggtcgggcccggagtgggagtgggcgggagtccgaagggggntggcagtccctgacgtcggtctcgagtcgttgggctcgaggtcctgacgtcggtccctgaccatcaacaacactaccgaggacgaggatagacagtacgactacgtacgtggtagggacgtaagttagtaggacgaagggtacgggaaataccgtactagtgtagttggttcgttagggtaacggtagggaacggtaacgggtaccgtacccggtacgaacggtccgaaccgtacccgg

SEQ ID NO: 285440 - DNA, 538 bp, Homo sapiens
  misc_feature: GYAE6OF01BVLXA.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatgggcgggatccgaagggggatggcatcccgtgacgtcggtttctcgagtcgttgggctcgaggcctgacgtcggtccctgaccatacaacaacatacgaggaagaggatgacagtgactactacgtggtagggaactaagttagtggacaggtaggaataccgtacatagtagtgttcgttagggaaggtgggaagtaacggtccacgtaccgaaggtcgacgtaaccccgg

SEQ ID NO: 285441 - DNA, 642 bp, Homo sapiens
  misc_feature: GYAE6OF01EAM6V.43.73.G07.1.454.CMB.1.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagcttgtgctgactcacgcctaccttctcgctactcacgccctcccgtgggacgtccgtcggtccacactccacctcgccacccgtgacgcgacgcggactacgatacgaatagaggcgacgtacgacaacgagacgacggacgggcgtccggcccgtagttgtgagtggcgnggtcgggcgtaggcggtagcggacggtagacgggaagggtncgggctctccgtgtacgttcggtactcgtagtcgtcggcgtcgcggtccttcggaccgtttcggccctagaacctagaccaaacactacggtacgaaagggtagaggtaaccgtcgaactacgggtaccttaaccttacggttcggtaagggaacggggttaactaggtgtaacgggacgtaggtaacggtacttaccagtagtagttacgtggtttaaggacgggaagttacggggaacttaaggcccgaaacgggttaccaaacgtcccgaggaaaccccgg

SEQ ID NO: 285442 - DNA, 650 bp, Homo sapiens
  misc_feature: GYAE6OF01D3SDB.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggacgcctcggtcacactcacctgcaccctgagcagcggctacaatgaatataaggtggactggtaccaacagagaccgaggggagtcgccccgtatttgtgatggcgaggtcgggcccggagtcgggagtgggcgggacgtccggaagggggatgggcagtcccgtggtactcggttctcgtacgtcgttgggcctcgacgggccgtgtaccgtccggtccccgtcgaaccctacgtaccaaaccgaaccaacgtacccgtaaagggaacgaaggatagaacgtaggtacgacgttaacgtaacgtcgggtaacgggtacggtaaattacggtacggtacgaaggtaggggaaacttaaccgtacgtagttacgttagttcggttagtttacgggtaaagggtaggggtaacggtaacggtaccggtaccggtaacccgaagggtccgacggtaaaccccccggg

SEQ ID NO: 285443 - DNA, 633 bp, Homo sapiens
  misc_feature: GYAE6OF01CJGWL.43.73.G07.1.454.CMB.1.raw
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgccaccctgacgcagcgctacatgaatataaggtgactggtaccaacagagacgaggggagtcggcccccgatttgngatgcgaggtcgggccggagtgggagtgggcgggatcggaagggggntggacacgtcccgtgacgtcggttctctagtcgttcgggctcgacgggtcctcggacgtccggtcctacgaccagtaccaaacaacacgtaccgaggaagagatagacgtaggtacgacgttactacggtaggtacggggtaacgtaagtttaggtacgggtacgtaagggtacgggtaaacttaccgttaacgacgttacgttaagttcggttacggttttaaggggaaggtttacggggaacggttaaccggggtactacccgggttaaccgaaccgggttaccgaaccggtaaaccccgg

SEQ ID NO: 285444 - DNA, 661 bp, Homo sapiens
  misc_feature: GYAE6OF01BQ4JB.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctggagcctcggtcacactcacctgccaccctgagcagcggctacaatgaatataaggtggactggtaccaacagacgaccgaggggacgtcggccccccgtatttggtgatggcgaggtcgggcccggagtggggagtgggcgggagtaccggaagggggagtcggcacgtccctggtattcggttctcgtaggttcgttcgggcctcgacgggtcccttcgtaccgttccggtaccccgtcgaccctacgttaccaaaccaacacgtacccgaaagggaaggacggagtacgtacgaggtacgaacgttaactacgttcggtaggggaaccgtaagtttacgtagggtacgagggttagggaaacttaccgtaactagttagttacgttcggtttaggttagggtaacggtacggggaacggttaacgggtccgtaacccggttaaccgaacggttaccggaccggtaaacccccggg

SEQ ID NO: 285445 - DNA, 859 bp, Homo sapiens
  misc_feature: GYAE6OF01DHECV.43.73.G07.1.454.CMB.1.raw
  modified_base (217)..(217): a, c, t, g, unknown or other
  misc_feature (217)..(217): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctccagtcttgtgctgactcacgcctaccttctgcatcacgtcccgtccgtggacgccgtcggtcaccactcaccgtnccaccgtgacgacgacggtccggtactaaacgtaagtaagtaaagttaacggtaagggtacggtaacgtaacggtaaaccgaaacgaacgggaacggaaccgggtaacggggtaaccggtccccggtaccccggttagtttacggacgtacggtcgggtaccgggtacgggtccgggggtacccgggtagggtacggggtacgggtacgggggtaccgggtaacgggtaaccggggaaggggggtaacgtccgggtaaccgttaaccgttcccggtacggttaccggtttccgggtttaccgtaccggtttacggttcgggttcccgggtacgtacgggtacccgggttccgtaccgggttaacccgggttcccggttccctaacggtaccctaaccgtaacgaaacgtaaccgtaacggtaaccggaaggtaacggacggtacgaacgtacgtaacgtaccgtaacgtacgttacgggtaggtaacgggtaacggttagtaggaacggtgttaacgggtacgtaaactaaccgtattcgttaagtaggtttaacggttgggtaaagggtcgggttaacgggaacggttacggtacccgttaacccggaagggttaacgccggttaacccggaaaccccggg

SEQ ID NO: 285446 - DNA, 837 bp, Homo sapiens
  misc_feature: GYAE6OF01BB8TC.43.73.G07.1.454.CMB.1.raw
  modified_base (342)..(342): a, c, t, g, unknown or other
  misc_feature (342)..(342): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagtcttgtgctgactcacgccctaccttctcgcatccacgtccctcccgtgggacgcccgtcggtccacacctccacctcgccacccgtgacgccgacggccggactaacaagtacgaaataagtaaggtcggtaacgtacggtaaccaacgaggaacggaccggaaggggtacgtaccggacccccggtagtttggngtacgtcgggaccggacggggttccggggacccggtagggtcggggtacggtcggggtaccggggtacggtaccggggaagggggtacgtcgggaccgtaccgtcccgttaggtaccggtttaccggtttcgttacggtacggtttcgggttacgggtccgttacggaccggttcccgtaccgggttaacccggttccccgggttaccccgttaaccgggtaccctaaccgtaaaccgtaaaaccccgtaaaccgtaaccgtaacccgggaaagggtaaacgggtaacgggttaacgtacggaaaccgtaggttaaccgtaccttaacggtacggttaggggtaaacggtaacgttaaaggttacggtacgggtagtagggttaacggtaacttaccgttaagtattggttaagttcggttagtagggtaacgggtacgggaacgtaccgggtacctacccggttaacggacgtaccggaccggtaaacccccgg

SEQ ID NO: 285447 - DNA, 683 bp, Homo sapiens
  misc_feature: GYAE6OF01D1QZO.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcacgcctaccttctgcatcagcctcccgtggggacgcctcggtcacactcacctgccacctgagcagtcggctacaatgaatataaggtggactggtaaccaacagagaccgaggggagtcgccccgtattcgtgatgcgagtcgggccggagtgggagtggcgggagtccgaagggggatggcacgtccgtggtactcgggttctcgtaggttcgttacggggctacggacggtccgtgtaccgttccggtcccgttacggaccctaagtaccgaaacctaactaacgtaccgaagggaaagtacgggaagtacggaacagtagtaaccgtataacgttggtaacgggtaccgtaaagttagtacgggacgtaagggtacgggtaactaaccgtaacgtactacgttaggtttacgttacggttttaaggggaacgggtacgggggttaaacgggtaaacgggttccccgtaaccgggttaaaccccgtaacggggtaacccgttaaacgggtaaaccccccggg

SEQ ID NO: 285448 - DNA, 647 bp, Homo sapiens
  misc_feature: GYAE6OF01CXE7H.43.73.G07.1.454.CMB.1.raw
  modified_base (255)..(255): a, c, t, g, unknown or other
  misc_feature (255)..(255): n is a, c, g, or t
tcagtgtgagtagtcacgaccggtgctcgatttagctctacgctcagggggagactgaagaacccagcattgcagcagctccaccatggcctgggctcctctgctcctcaccctctcagtctcctcacgagggtccctctcccagcttgtgctgactcagccaccttctgcatcagccctcccgtgggacgcctcggtcacactcacctgccacctgagcagcgctacatgaatagtaaggtgactggtaccaanagagaccaggggagtcgccccgtatttgtcgatgcgaggtcgggcccggagtgggatcgggacgggagtaccggaagggggagtcggctacgtcccgtgtacgttcgggtcttcgtacggttcgtgggtctcgacggtcgtggaccgttccggtaccctcgaacctataccaaacctaagaacgtacgaaggtaaggaaggtatacggacgaagttacggacttaaccgttacggttagggttacggaagttagtaacgtttagtcggacgtaggacgggtaatacctacgtattacggttagttaggtttacggtttaaggggtaggttaaggggtaacggtaaacgggttaccgtaacccggttacggtaaccgggtcgtaaaccccggg

SEQ ID NO: 285449 - DNA, 653 bp, Homo sapiens
  misc_feature: GYAE6OF01CTVTE.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcacgccctcccgtgggacgcctcggtcacactccacctgccacctgagcgacgtcggactaacgagtacgaatagtaacggtgactaggtaaccaacagagaccgagggagtcgccccgtatttggagatgcgaggtcgggaccggagtgggtagtcgggacgggtacgtaccggaaagggggtctacggctacgtcccgtagtacgttcgggttactcgtagttccgttgggcttacgaggtcctaggtaccgtcggttcccacggacctacacgaacctaacgtactaaccgaaggacgaaggacgtacgacgtagtacgacttaacgtacggttggacggggtactaaagttggtacgtacgtaggtacggtaactactacgtagtagtacggtgtttaacgttaggtaagggttacgggtaaccggtaacggttaccgtaacggtaccggtaacggtacggtacccggaaacccgg

SEQ ID NO: 285450 - DNA, 926 bp, Homo sapiens
  misc_feature: GYAE6OF01BY2Z7.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagcttgtgctgactcagcccaccttctgcatcacgcctcccgtgggacgcctcggtcacactccgacctgcctaccctgacgccgaggccggactaacaatgaaacttagtaaaggtcggaacgtcggtaaccaaacgaggaacgaaccggaaggggtagtaccggcccccgtattttacggtggtaagtcggccgggtacgggtcgggggaccccggtagggtacggggtaggttacggggaccgggggtaacgttaccgggaaacgggggggtaactcgggggtaccgtaaccgttcccggttacggtaacggtttccggggtttaccgttaccggttaacgggtttccggtttcgggggtacccgtttaccggtaaccgggttacccgttaccgggttacccgggttacccgggttaccccggttaaccggaacccgtaaccgtttaaaccgaaaacccgtaaaaccggtaaccgttaaccccggaaagggtaaacggggtaaacggggttaacgtacgggtaaacgtaacgggttttaaccgtaaaccgttaaccgtttaacgggttacgggttaacgggggtaacggttaaacgttttacgggtaacgggtacggttaaacgggttacgggtaaaacgttaacccggttaacgttaagttaacggtttaaggtttcggtttaaacggtttaggggtaaacggggttacggggtaaacgggtaacgggttaaccggtaccgggtaacgtaacgggtaccggtaaccgaaacccccggg

SEQ ID NO: 285451 - DNA, 812 bp, Homo sapiens
  misc_feature: GYAE6OF01BVJV1.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcacctcctcagtctcctcacacgggtccctcctcccagtcttgtcgctgactcacgccctaccttctcgacatccgacgccctcccgtgggactcccgtcggtaccactacctccaacctaccacccgtgacgccgacggccggtactaacaagtagtaaagtaaggtaaggtggactacggaaaccgaacgacggacgaccgggtaaggggcgtcccggtaccccgttagtttcggaggtaacgtcgggacggtacgggtccggggaccggtaggtaccgggggtaaggtcgggggtaaccgggtaaccggttaaccgggggaaacggggtgttaccggaccggttacccgtttaccggttcggttaaccgggtttcggttacgtaccggttaacggttcggttacgggtccgtacggtaccggtccgtacgtccggttcccgtaccgtaacgacctaacaccgtaaacaccgtacgtaaccggaagggtaacgtaggacgtaggacgtaacggtaccgtaacgtacgttacgggtaagggcgttaaagtttacggtggtacggaacggttaaggtaacgttaaccgttaactagttacggtttacgttacggttcggttacgggttaagggacgggttaacgggaacgtaccggtaccgtaaccgtacggtaaccggtacccgacggtaaccctaacccggg

SEQ ID NO: 285452 - DNA, 761 bp, Homo sapiens
  misc_feature: GYAE6OF01DBGCW.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagtcttgtgctgactcacgcctaccttctgcatcacgccctcccgtgggacgccgtcggtaccaacctacctccaccctcgacccacccgtgacgcgacggcggtactaacgatagaaattaaggtaaggtcggtaacgtacggtaaaccaacgaggaacggaccggaaggggtacgtaccggtcccccggttagtttggtacgagttcggcggtacgggtccggggccggaggtcggggaagtcggggacgggtacgtaccgggaaggggtcgtacggctaccgtccgtggtacgttcggttctacgtcgttcgtcgggctcgcggtcgtcgtaccgtccgtccgtcgaaccgtataaccaaaccaacgaccgtaacggaacgggtaacggaaggtaactaggacgtaacggtacgtaaccgttacgttaacgggtacgggttaagggtaaaccgtaagtttacggacggtacgtaagggtacggtaaacttaacccgataacgttaggtacgtttacggttacggtttaggggtaaacgggttacggggtaaccggaaacgggttcccgtaaacgggtaccctaaacggggtacccgtacgggtaaaccccccgg

SEQ ID NO: 285453 - DNA, 659 bp, Homo sapiens
  misc_feature: GYAE6OF01CK7N9.43.73.G07.1.454.CMB.1.raw
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (255)..(255): a, c, t, g, unknown or other
  misc_feature (255)..(255): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcacgcctcccgtgggagcctcggtcacactcacctgcaccctgagcagcggctaacatgaatagtaaggngacnggtacaanagagacgagggagtcgaccccgtatttgtgatgcggaggtcgggcccggagtgggagtcgggacgggacgtaccggaaagggggagtcggtcaacgtcccgtaggtaacgttcgggttacgtcgtacggttcgttcgggtaccgttcgaacgggtccgtacggtaccgttcccggtaccccgtagaccctaagtaccaaacaacctaactaacccgaagggaacggaggtagtacgaacgagtacgtaactaacgtagtcggtaagggtacgtaaagttgtaggactaagggtacggtaactacgttacagttagtagttggttacgttagggaacgggttacgggtaacggtaacgggttaccgaaccggtaccggaacggttacgaacccggtaaaccccgg

SEQ ID NO: 285454 - DNA, 699 bp, Homo sapiens
  misc_feature: GYAE6OF01E2T74.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagtcttgtgctgactcagcctaccttctgcatcacgcccgtcccgtgggacgtccgtcggtacactacctcacctcgcctacctggacgcaggtccggctaacaagtagtaagtaagtaggtaggacgtacgtaaccaacgagacgacgaggggacgtcgaccccgtagttgtgtagtggcggtaggtcgggccggaggtgggtagtgggcgggacgtaccgggaaggggtagtggcgtacgtccgtagtacgtcggttcgtcgtacggttcgtcgggccgttcgacggtccgtcggtaccgttccggcccgtcgaacctacgtaccaaacctaactacgtaccgaaggaacggaggtagtacgacgtagtacgtacgtaacgtcggttcggaacgggtaacgtaagttacggtggtacggttaggtacgggttaacctacgttaacgtacgttagttaacgttggttaaccggtttagggtaacgggtacgggtaaacgggttaccggtaaccgtaaccggtaccggtaacggtaccgaacccgggtaaccccgg

SEQ ID NO: 285455 - DNA, 1072 bp, Homo sapiens
  misc_feature: GYAE6OF01B2DWZ.43.73.G07.1.454.CMB.1.raw
  modified_base (208)..(208): a, c, t, g, unknown or other
  misc_feature (208)..(208): n is a, c, g, or t
tcagtgtgagtagtcacgaccggtgctcgatttagctctacgctcagggggagactgaagaacccagcattgcagcagctccaccatggcctgggctcctctgctcctccaccctcctcacgtctcctcaccgacgggtccctctcccagcttgtgctgactcacgccctaccttctgactataccgaccgtcccgtcccgtggggcncccgtcggtccactacctccacctcgccaccgtgacgcgacggacggtactaacaagtacgaagttaacgtaacgggtcggtaacgtacggtaaaccaacggaacggaacggaccgggaagggggaccgtacccggtaccccggtttaagtttcggtagtacgtacggtaccgggtacggggtccgggggacccgggtaggtacgggggtacggttacgggggaaccggggttaacgggtaaccgggggtaaagggggtacgtacggggtaccgttacccggtacccggtttagggtaaccggtttacccgggttttcctaacgggtttaccggtttccggggttcggggttaccgttaccggtaacccggggttcccgttaaccggggttccccggttttaccccgggtacccccgtaacggtaacccctaaaccgtaccccgtaaaaacccgtaaccccgtaacggtaaacccgggtaaaggggaacgtacgggtaaaccggtttaaccggaaaccgttacgggtaacggtttaacccgttaaaccgggttttaacgggaacggggttaaccggggtttaaaaccgtaaacgggttttacgggaaacgggttaaaccggggtaacgggtttaaaccggaaaaccggttttaaaccctaaaaggggtttaccgtttaaaggggtttaccggttttaccggggttttaaacgggggttttaaaccggggtaaaacggggggttaacccgggggtttaaaaccggtttaaaccccggggttaaaacccccggttaaaccccggtaaacccgggggttaaaccccggtacccgggtaaaccccggttaaaaacccccccccggggg

SEQ ID NO: 285456 - DNA, 775 bp, Homo sapiens
  misc_feature: GYAE6OF01AWT00.43.73.G07.1.454.CMB.1.raw
  modified_base (193)..(193): a, c, t, g, unknown or other
  misc_feature (193)..(193): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcacgccaccttctgcatcacgccctcccgtgggacncctcggtcacacctcacctgccaccctgacgcagcggctacaatgtaataagtaaggtggactcggtaccaacagacgaccgagggacgtcgccccgtagtttgtgagtggacggtagggtcggggacccggtagtcggggagtggggacgggtacggtaccgggaagggggtacgtcgggacctacgtacccgtaggtacgttccgggttcgttaccgtacggttcggttacgggtaccttacggaccgggtcccgtcggtacccgtcccggttcccgtacgtaccgtactaccgtaaacaaccgtaacgtacccggaaaggtaacggaaccgggtatacggacgtaagtaccgtaactttaacgacggttacggtacggggtaaacgtaagtttaacgggtacggttacggtaacggtaagggtaaaccttaaccgtaacgtagtttacggttaagtttaccgggtttaggtttaacgggggtaacgggttaacgggtaaacccgggttaaacgggttaaccccgggtaaccgggtttacccggaaacgggttaccccgaacccgggtaaaccccccggg

SEQ ID NO: 285457 - DNA, 689 bp, Homo sapiens
  misc_feature: GYAE6OF01BKDGD.43.73.G07.1.454.CMB.1.raw
  modified_base (206)..(206): a, c, t, g, unknown or other
  misc_feature (206)..(206): n is a, c, g, or t
tcagtgtgagtagtcacgaccggtgctcgatttagctctacgctcagggggagactgaagaacccagcattgcagcagctccaccatggcctgggctcctctgctcctcaccctcctcacgtctcctcacagggtccctctcccagcttgtgctgactcagccaccttctgcatcacgccctcccgtgggacgcctcggtccaacncctacacctgcctacctgacgcagcggactacaatgaatagtaaggtagacgtacggtaaccaacgagacgaccgaggggacgtcgaccccgtattcggacgactggacgacggtcgggaccgtagtacggggacgtcgggacggactaccgggtaaggggacgtcggctacgtccgtaggtacgttcggtactcgtagtcgttcggctacggtacggccgtagaccgttccgtaccctagaccaactacaaacaacgacgtaaccgaaggacgaagacgcgaacgtagtacgtactacgtacgtacggtacgggtaaccgtaagtttacggcgaacgtacggtaacgggtaaacttaccgtaacctaggttacgttaacggttcgtttacggggttaaggaaacggggttacggtaaaccggttaacggtacccggtaaccggttacccgtaaacggttcccgaaccggttaaacccccggg

SEQ ID NO: 285458 - DNA, 966 bp, Homo sapiens
  misc_feature: GYAE6OF01E5T29.43.73.G07.1.454.CMB.1.raw
tcagtgtgagtagtcacgaccggtgctcgatttagctctacgctcagggggagactgaagaacccagcattgcagcagctccaccatggcctggctcctctgcctcctccacccctcctcacgtcctccctcaccgacgggtcccctctcccagtcttgtgctgacctcacgtccctaccttctgactactccgaccgtcccgttcccggttggggaccgtcccgttaccgggtacccaaccctaccgtacccaccgttccgaccctaaccccgtgaccggaccgacgggtaccggtacctaaacgtaaagtaagtaaacgttaaggtaacggtacggaccgttacggaaccgaacgacggaaccggaaccggagggtaccgtccggtaccccgttagttggtacgtaacgtcgggaccgggtacggggtccggggtaccggggtagggtacgggtacgggtaccggggaacgggtaaccgggtaacgggggaaggggtcgtacggtaccccgtaccggtccgttaggtccggtttcgttaccgtcgggttacgtttcgggtaccggtcccgtacgggtcccggttacgtacccggttacccggttccccggtaaccctaaccgaacctaaccgaaaccgtaaaaccgaccggttaaacggacgggaaacgggtaggtaaacggtactaacgggtaaccggttaacgtaacccggttaaacgttaaccgggtaacggggttcgggttaaacgggttaacgttaacgggttagggttaaccgtacggttaaacgggtaaccggttaaacctggttaacggttaggttacggtttaacgggtttcggttaacggggttaaacggggtaaccggttaacccggggtaaaccggtttacccggtaaccccggtaacccgggtaacccggtaacccgggttaaaccccggacccgggtaaaacccccccgg

SEQ ID NO: 285459 - DNA, 786 bp, Homo sapiens
  misc_feature: GYAE6OF01CZ910.43.73.G07.1.454.CMB.1.raw
  modified_base (153)..(153): a, c, t, g, unknown or other
  misc_feature (153)..(153): n is a, c, g, or t
  modified_base (181)..(181): a, c, t, g, unknown or other
  misc_feature (181)..(181): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacgacgggtccctctcccagtcttgngctgactcacgcctaccttctgcatccncgccgtcccgtggacgccgtcggtcacactcgacctgccacctgacgcaggcgtactaacagtagaaagtaagtaggtacggacgtacggaaaccaacgagaacggaccggtagggacgtaccggccccgtaagtttggtagtagtggacggtacgggtcggggaccggagtcggggagtacggggacgggtacgacggggaaggggtactcgggacgtacgtacccggttaggaccgtttcggttaaccgtcgttacggttcggtttaacgggccgtacgggtaccgtacccgttcggtaaccccggttccggttaccccgacgtaaacctaccgaaacctaaaacgtaacccgtaaggttaaacccggaaaggggaacgggtaacgtaaaggttaccggaaacgtacgggttaaaccgtaacgttttaccgggtaacgggttagggaaccggttaaaggtaaaccgttgtaaccgggagttagggtaacgtaaaccttacgtacgtagttagacgggtttacttacgggttaggtaaagggtaccgggtaaacgtaacggttcccgaaaccgttacgaacggtaaccaccgggtaaaccccgg

SEQ ID NO: 285460 - DNA, 838 bp, Homo sapiens
  misc_feature: GYAE6OF01DEVFK.43.73.G07.1.454.CMB.1.raw
tcagtgtgagtagtcacgaccggtgctcgatttagctctacgctcagggggagactgaagaacccagcattgcagcagctccaccatggcctgggctcctctgcctcctccaccctcctcagtctcctcacgacggtccctctcccagtcttgtgctgactcacgcctaccttctcgcactcgacgtcccgtcccgtgggacgtcccgtcggtacaccactccaccgtcgccgaccctgacgcgcggcgtactaacaatagtaaatagtaaggtaggacgtacggtaaccaacgagaacggaccggacggggtacgtaccggccccgttagtttacggtagtaagttcggacggtacggtccggggccggtagggtacgggtaggtacgggacgggtacgtaccgggaacggggtagtcggactccgtccgtagtacgttcggtttctacgtacgttcggttcggtcgtccggacgttccgtacgttccggtaccgttacccgtacgtaacctacgtaaccggaaaccctacgtaacgtaaaccggaacggtaaaggacggtacgtaacgggaacgtaagggtttacgtaacgttaacggtttacgggttaagggtaacggttaaacggttaaggtttacggtaacggggttaacgtaaggggttaaaccggttaaacgttaaccgttaacgttacggtttaggttaaccggtttagggttttaaccggtttaaggggtaaaccgggggttaacgggggttaccgtaaacggttacccccggggaaacgttaccccgggtaaaaggttcccggaaaccccgggtaaaaccccccgggg

SEQ ID NO: 285461 - DNA, 695 bp, Homo sapiens
  misc_feature: GYAE6OF01D8KYT.43.73.G07.1.454.CMB.1.raw
  modified_base (130)..(130): a, c, t, g, unknown or other
  misc_feature (130)..(130): n is a, c, g, or t
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
tcagtgtgagtagtcacgaccggtgctcgatttagctctacgctcagggggagactgaagaacccagcattgcagcagctccaccatggcctgggctcctctgctccctcaccctctcagtctcctcacngggtccctctccagtcttgtgctgactcancctacttctncatccacgtcccgtcccgtaggggaccgtccgtacggtacacctacttaccaccgtacgccctacccgtaggacgaccgaacggccggtactaaactaaagtaggaaaacttaagtaaggtacggtaacgttacggaaccgaacgaagacggaaccggtaaggggacgtccgtaccccggttattcgtagtagtacggcggtaggtacgggtaccggaggttagggaacgtggggacggaacggtaccgggaaggggtactacgggtacaacgtcgtagtacgttcgttaccgttagtacgtcggttcgggtctacggtacgtaccgtgtaccgtccgtaccgacgaacactaacaaacacacgtacggaagaacggtagagagactagtacgtaactacgttagtaggttacggaacgttaagttacgtagtacgaggttagtaaacgtaacttacgtagtagtagtacggttggttagaacggtaggacgtaacgtactaccgtagtaacgctacggaacccg

SEQ ID NO: 285462 - DNA, 867 bp, Homo sapiens
  misc_feature: GYAE6OF01BTGXB.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcacgttctcctcacagggttcccctcctcccagtcttgtgctgactcacgcctaccttctgtccatccacgtccctcccgtgggacgtcctcggtccacctactccacctcgacctaccgtcgaacgtccgacggtccggtacctaaacgaagtagtaaaagtaacggttaagggtacggtaacgttacggtaaaccaacgaggaacggtaaccggaggggtacgtcccggtacccccggttgtttcggtagtacggtcggtacggtagggtaccggggtacccggtaaggtaggggtagttacgggggcggggtaacgaccggggtaagggggtacgtacgggtactaccgtccgtaggttacgttaccggtttacgtcgttacggttccggttacgggtcgtaccggtacggtccgttacggtaccgttaccggtcccgtaaccgtaccaactacccgaaactaaccgtacgtaaaccggtaaacgggtaacgtaagggtaacgtaacggaaccgtacgtaaccgtaaccttacgtaaccggttacgggtacgggttaaacgttaacgttaacggtcgggttaacgggtaaccgggttaaggtaaaccgttaccgtaaacgttagtttcggttacggttttacggttacgggtttaacgggtaagggttaacgggtaaaccgggttaccggtaacccggtacccgggttaaaggaacccggttaacgaaccccggtaaaacccccggg

SEQ ID NO: 285463 - DNA, 766 bp, Homo sapiens
  misc_feature: GYAE6OF01A7VRW.43.73.G07.1.454.CMB.1.raw
  modified_base (166)..(166): a, c, t, g, unknown or other
  misc_feature (166)..(166): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (701)..(701): a, c, t, g, unknown or other
  misc_feature (701)..(701): n is a, c, g, or t
tcagtgtgagtagtcacgaccggtgctcgatttagctctacgctcagggggagactgaagaacccagcattgcagcagctccaccatggcctgggctccgtctgctcctcaccctctcacgtctcctcacacgggtccctctacccagtcttcgtgccttgactcncgtcctaccttgtgccattccacgcccgttcccgtagggactccgtcggtccacgtactccacctcgcctaccgtgacgcagcgactaanagtanatagtaaggtcgtacgtacggtaaccaacgagacgaaccggtagggacgttccggaccccgttgttacggtagtagtcggtacggagggttcgggtaccggtaggtggggtacggtcggggtacgggaacgttaccggggaaggggcgttcggaacttaccgttccggtacgttaccggtttccgggtttactcggtaaccggtttcggttacccgggtaccgttaccggaaccgggttcccgtcgggttaacccgttcccgggttaaccttaccggaaccttacgaccctaactaccgaacgtaccggaaggagtaggtactagaaccgtgggtactacgttaacgtcggtacggtaacggtacgtaaggttaggtcggacggtaagggtaacggtactaaccgtagttgtacgttaagttccggttaagtttaagggnggttaacgggtaccggtacggtaaccccgtacgggtaaccgaccggtaaccgcccgtaaccccgg

SEQ ID NO: 285464 - DNA, 786 bp, Homo sapiens
  misc_feature: GYAE6OF01BWPYO.43.73.G07.1.454.CMB.1.raw
tcagtgtgagtagtcacgaccggtgctcgatttagctctacgctcagggggagactgaagaacccagcattgcagcagctccaccatggcctgggctcctctgcctcctcaccctcctcacgtctcctacacgacgggtccctctcccagcttgtgctgactcagccaccttctgcatcacgtcctcccgtgggacgtccctcgggtacacctacctctaacccgtcgacctacccgtgaacgccaacgccggactaacaatagtaaataagtaagggtacggaacgtacggtaaccaaacgaagacggaaccggaaggggtaacggtccggtacccccggttagtttacggtacggtacgttacggacggtaaggggtccggggtacccgggtaaggttacgggggacgttacgggggacggggtaacgtaccgggaaaggggggtacgtagggactacgtcccgtagtacgttcgttacgtcgtacgtcgtcgggtctacgtacggtccgtacgtaccgtccgtccgtacgactactaacaaaccaacgaactaccggaaggtaacggaacgtagtacgacgtacggtacgtaaccttacgtagtagggtaacgggtaacttaaacggtagtacggtacggtacgggttaaaggaccttaaccgtaacgttacgttaagtacgggtttacgtttaggtttagggaaacgggttacggggtaaacccgtaagggtaccccgtaaccggtaaccggtaacggtacccggtaacggaaaacccccgg

SEQ ID NO: 285465 - DNA, 502 bp, Homo sapiens
  misc_feature: GYAE6OF02HEXG4.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttcgtgatgcgagtgggccggatgggatggcgggatccaaggggatggcatccctgatcggttctcagtcttgggctcaggcctgactcggtcctggaccatcaacaacatccaggagaggatgacagtgactacgtactgtggacgaattatggcaggtggaatacctacattcgtagtgttacttgggaagttggagaaggtcaccgtcaaggtcagacccg

SEQ ID NO: 285466 - DNA, 699 bp, Homo sapiens
  misc_feature: GYAE6OF02I0CRE.43.73.G07.1.454.CMB.1.raw
  modified_base (190)..(190): a, c, t, g, unknown or other
  misc_feature (190)..(190): n is a, c, g, or t
tcagtgtgagtagtcacgaccggtgctcgatttagctctacgctcgagggggagactgaagaacccagcattgcagcagctccaccatggcctgggctcctctgctcctcaccctcctcagtctcctcacagggtccctctcccagcttgtgctgactcagccaccttctgcaatcagcctccctgggancctcggtcacactcacctgctaccctgagcaggccggctacgatgaactataaggtggactggtaccaacagacgacccgaggggacgtcgccccgtatttcgtgatcgcgaggtcgggccggagtcgggactgggcgggataccgaagggggactcggcgacgtcccgtgtacgttcggttactcgtacgttcgttcgggctcgacggtccttacggaccgttccgggtccctacggaacccgtacgtacccgaaaacgtaaccgacgttacccgaagggaaacgacggatcgaacaggtacgaacgtactacgtggtacggggtaacgtaagtttacgtagggtaccgtaagggttacgggtaaacttaacccgttaacgtacgtttaggttaacgtttaggtttccggttttaaggggtaaacgggtttagggggtaaaccggtaacggggttccgtaaaccccgggttacccgaaacgggtttacccgaacgggtaaccccccgg

SEQ ID NO: 285467 - DNA, 558 bp, Homo sapiens
  misc_feature: GYAE6OF02I7ZZV.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgaggtgggcccggatgggatgggcgggatccggaagggggatggcatcccgtgatcgggttctcgagtcttgggctcgaggcctgacgtcggtccctgaccatcaacaacataccaggaagaggatgacagtgactactacgtggtagggacgtaattagtagggcaaggtgggaaactaccgtaacgattggttattggttactttaggggaaaggtttggggaacgtaagggtacccgtaccggtaccgtaacgttcggtacaacccgg

SEQ ID NO: 285468 - DNA, 560 bp, Homo sapiens
  misc_feature: GYAE6OF02IQVDP.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatggcgaggtgggcccggagtgggatgggcgggagtccgaagggggatggcagtccctgacgtcggtttctcgagttcgttgggctcgacggtcctgaccgtccggtccctcgaccactcaacaacactaccgaaggaagaggatgacagtgactactacgtggtaggacgtaattagtggacaggtaggaactaccgtactagtagtagtggttacgtttagggaaggttgggaacgtaaggtcgtaccggtaccgaacggttcacggtaaccccg

SEQ ID NO: 285469 - DNA, 515 bp, Homo sapiens
  misc_feature: GYAE6OF02GZ7X2.43.73.G07.1.454.CMB.1.raw
  modified_base (282)..(282): a, c, t, g, unknown or other
  misc_feature (282)..(282): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgngatgcgagtgggcccggatgggatggcgggatccgaagggggatgggcatccctgatcggttctcagtcttgggctcaggcctgactcggtccctgaccatcaacaacatccaggaagaggatgacagtgactactactgtagggacgtaattagtggctaggtgggaaataccgtacagtagtagtgtctttagggaagttgggacgaaggtcaccgtcaaggtcagacccg

SEQ ID NO: 285470 - DNA, 503 bp, Homo sapiens
  misc_feature: GYAE6OF02FTGX4.43.73.G07.1.454.CMB.1.raw
  modified_base (441)..(441): a, c, t, g, unknown or other
  misc_feature (441)..(441): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccgaagggggatggcatccctgatcggttctcagtcttgggctcaggcctgactcggtccctgaccatcaacacatccaggaagaggatgacagtgactactacgtgtagggacgtaattagtgganaggtaggaatacctacatgtatgtctttggaagtggacgaggtcaccgtcaggtcagacccg

SEQ ID NO: 285471 - DNA, 522 bp, Homo sapiens
  misc_feature: GYAE6OF02IDGTG.43.73.G07.1.454.CMB.1.raw
  modified_base (189)..(189): a, c, t, g, unknown or other
  misc_feature (189)..(189): n is a, c, g, or t
  modified_base (392)..(392): a, c, t, g, unknown or other
  misc_feature (392)..(392): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggacncctcggtcacactcacctgcaccctgagcagcggctacaatgaatataaggtggactggtaccaacagagaccaggggagtgcccccgattgtgatgcgagtgggcccggatgggatggcgggatccgaagggggatggcagtccctgactcggttctcagtctgggctcgaggcctgactcggtccctgaccatcaacaacntaccgaggaagaggatgacagtgactaactactggtagggacgtaagttagtggacaggtgggaatacctacatgtatgttctttagggaagttcgggagtaggtcgaccgtacgacggtacacgacccg

SEQ ID NO: 285472 - DNA, 511 bp, Homo sapiens
  misc_feature: GYAE6OF02FRSM6.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggccggatgggatggcgggatccgaaggggatggcatccctgatcggttctcgagtcttgggctcgaggcctgactcggtccctgaccatcaacacatccaggaagaggatgacagtgactactacgtgtagggtacgaattagtggacaggtagggaattaccgtacatagtagtgtatttagggaagttggacgaggtcaccgtcaggtcagacccg

SEQ ID NO: 285473 - DNA, 533 bp, Homo sapiens
  misc_feature: GYAE6OF02HHD3S.43.73.G07.1.454.CMB.1.raw
  modified_base (190)..(190): a, c, t, g, unknown or other
  misc_feature (190)..(190): n is a, c, g, or t
  modified_base (323)..(323): a, c, t, g, unknown or other
  misc_feature (323)..(323): n is a, c, g, or t
tcagtgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggancctcggtcacactcacctgcaccctgagcagcggctacaatgaatataaggtggactggtaccaacagagaccaggggagtgccccgattgtgatgcgagtgggccggatgggatggcgggatccgaaggggntggcatccctgatcggttctcgagtcgttgggctcgaggcctgactcggtccctgaccatcaacaacataccgaggaacgaggatgaacagtgactacgtacgtggtagggaactaagttagtcggctaaggtagggaactaccgtacattagtattgttacgttaggaaggtgggtacgaaggtcgaaccgtaccgtaggtctaaccgg

SEQ ID NO: 285474 - DNA, 598 bp, Homo sapiens
  misc_feature: GYAE6OF02I0SCW.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccgaggggagtgccccgatttgtgatgcgagtgggccggatgggatggcgggagtccgaagggggatgggacatcccgtgacgttcggtttctcgagttcgttgggcttcgaggcctgacgtccggtccctagaccataccaaactaacatccgaaggaagaggatgaacagtgactactacgtgtagggactaagttagtaggcgtaaggttgggaaacttaccgtaactagttacggttaagtttcggttaccggttttagggaaggttaacggggaacgttaaacggggtcccgtaacccggttaccggtaaacgggttccgaacggaacccccgg

SEQ ID NO: 285475 - DNA, 561 bp, Homo sapiens
  misc_feature: GYAE6OF02GCOOP.43.73.G07.1.454.CMB.1.raw
  modified_base (281)..(281): a, c, t, g, unknown or other
  misc_feature (281)..(281): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgccccgatttgngatgcgagtgggccggatgggatggcgggatccgaaggggatggcatccctgatcggttctcagtcttgggctcaggcctgacgtcgtccctgaccatcgaacaacatccaaggaagaggatgacagtagactacgtactggtagggactaattagtggacgtaggtagggaaataccgtaacgtattaggtagttggttacgtttaggggtaaaggttggggaacgtaaagggttccgaacccggttaaccgtaacgggttaccgaaggtaacccccgg

SEQ ID NO: 285476 - DNA, 694 bp, Homo sapiens
  misc_feature: GYAE6OF02HT83A.43.73.G07.1.454.CMB.1.raw
  modified_base (190)..(190): a, c, t, g, unknown or other
  misc_feature (190)..(190): n is a, c, g, or t
  modified_base (577)..(577): a, c, t, g, unknown or other
  misc_feature (577)..(577): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtcccctctcccagcttgtgctgactcagccaccttctgcatcagcctccctgggacncctcggtcacactcactcgcacctgacgcagcgctacaatgaaatataaggtggaactggtaccaacagacgaccgaggggagtcgacccccgatttgcgaatcgcgaggtcgggccggagtcggggatgggcgggtacgtaccggaagggggactgggctactcccgtgacgttcgggttactacgtggttcgttgggtcctacgacgggcctcggtaccttccgggtaccctcggaacctacgtaccaaactaaccaagttacccgaagggaaggaacggtaacgtagaacctaaggtacgtaacgtttaacctaaggttcggtaacgggtaaacgtaaagtttaggtacggtacgtaagggtaacgggtaacttaacccgtaanacgtttacgttaagttcggtttaggttttaacgggaacgggttacggggtaaccggtaaaccgggttcgtaaaccccgggttaacgtaaccgggttaccgaaccggtaaacccccgg

SEQ ID NO: 285477 - DNA, 564 bp, Homo sapiens
  misc_feature: GYAE6OF02IA6D7.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcacctgagcagcggctacaatgaatataaggtggactggtaccaacagagaccaggggagtgcccccgatttgtgatgcgagtgggcccggatgggatggcgggatccgaagggggatggcagtccctgatcgggttctcgagtcgttgggctcgaggcctgactcggtccctgacccatcaaacaacataccgaggaagaggatgacagtcgactactacgtggtagggacgtaagttagtgggacagggtaggaaacttaaccgacgtagttagtattggttaccgtttagggaaggttcgggaacggtaacgggtccgtaacccggttaccgaagggttaccagtaacccccgg

SEQ ID NO: 285478 - DNA, 567 bp, Homo sapiens
  misc_feature: GYAE6OF02HBFMI.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagacccaggggagtgcccccgatttgtgatgcgagtgggcccggatgggatggcgggatccgaagggggatggcagtccctgatcggttctcagtcttggctcaggcctgactcggtccctgaccatcaacacatccagagagatgacagtcgactactacgtaggtagggacgtaattagtggacgtaggtagggaaactacctaacgagttaggtattggttaccgtttagggtaaggttacggggtaacggtaacggggttaccgtaacccggttacccggaaagggttccgaaccggtaacccccgg

SEQ ID NO: 285479 - DNA, 656 bp, Homo sapiens
  misc_feature: GYAE6OF02JDG25.43.73.G07.1.454.CMB.1.raw
  modified_base (187)..(187): a, c, t, g, unknown or other
  misc_feature (187)..(187): n is a, c, g, or t
tcagtgtgagtagtcacgaccggtgctcgatttagctctacgctcaggggagactgaagaaccagcattgcagcagctccaccatggcctgggctcctctgctcctcaccctcctcagtctcctcacagggtccctctcccagcttgtgctgactcagccaccttctgcatcagcctccctgggacncctcggtcacactcacctgccacctgagcagcgctacatgaatataagtggactgggtaccaacagacgacaggggagtcgccccgatttgtgatgacgaggtggcccggagtgggagtggcgggagtccggaacgggggatcggcgagtcccgtaggacttcgggtttctcgtaggtccttaggggtctcgacggtcctaggtaccgtccgggtccctaggacctacgtccgaaacctacgaactcccgaagggaacgacgggaatggtaacgagttacgacttaaccgtacgtaggttacgggaacgtaacgttagtacgggtacgaaggtacggtaaacttacccgttaactagttacggttactacgggtttacttttaggggtaacggttaggggttaacccgtaaacgggttaccggtaaacccggttaccggaagggttacccgtaaggtaaaccccccggg

SEQ ID NO: 285480 - DNA, 520 bp, Homo sapiens
  misc_feature: GYAE6OF02HP37V.43.73.G07.1.454.CMB.1.raw
  modified_base (283)..(283): a, c, t, g, unknown or other
  misc_feature (283)..(283): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgccaccctgagcagcggctacaatgaatataaggtggactggtaccaacagagaccaggggagtgcccccgatttgngatgcgaggtgggcccggatgggatggcgggatccgaagggggatggcagtccctgagtcggttctcgagtcgttgggctcgaggcctgaccgtcggtccctgaccatcaacaacataccgaaggaagaggatagacagtcgactactactggtaggacgaattgtgcgagtaggaactactacatgtagtgtgttaggaagtgggagtaggtcgaccgtacaacggtcagtacccg

SEQ ID NO: 285481 - DNA, 639 bp, Homo sapiens
  misc_feature: GYAE6OF02GNGE1.43.73.G07.1.454.CMB.1.raw
  modified_base (285)..(285): a, c, t, g, unknown or other
  misc_feature (285)..(285): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctcccgtgggagcctcggtcacactcacctgccacctgagcagcgctacaatgaatataaggtggactggtaaccaacagagaccgaggggagtggcccccgatttgngagtgcggagtcggggcccggagtggggagtgggcgggagtccggaaaggggggatgggccagtcccgtggtattcggttctcgaggttcgttgggctcgaggtcctgtacgtccggtccctgaccataccaacaactactccgaaggaagaggagtacgacgagtacgacttactacgtggtacgggaacgtaagttagtacgggtacgtaaggtacgggtaaacttacccgtaagtacgttagttaagttcggtttaccgttttaggggtaacgggttacggggaacggttaaccgggttaccggtaacccggttaccggtaaccgggttacgtaacccggtaacccccggg

SEQ ID NO: 285482 - DNA, 659 bp, Homo sapiens
  misc_feature: GYAE6OF02HRTY7.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggacgcctcggtcacactcacctgccacctgagcagcgctacaatgaatataaggtggactggtaccaacagagaccgaggggagtcgcccccgtatttgtgatgcggaggtcgggacccggagtggggagtgggcgggaacgtccggaaggggggagtcgggacacgtcccgtagacgttcggtttcgtacgacggttcgttgggtcctcgacggtccgtcggaccgttccggtcccgtacggaaccctacgtaccaaaccaactacgtaccgaagggaagaaggagtacgaacgtagtacgtactaacgtacgtaggtaggtacgtaagttagtggtacgtaggtacgggaaacttaaccgtatacgttagtacgttaggtttacgtttaggggtaacggttacggggtaaccggtaacgggttacccgtaaccggttaaccggtaacggttacccgaacggtaacccccggg

SEQ ID NO: 285483 - DNA, 643 bp, Homo sapiens
  misc_feature: GYAE6OF02HSZCN.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagcccaccttctgcatcacgccctcccgtgggacgcctcggtccacacctcaccctcgccaccctgacgcgacggccggactacaatagaaataataaagggtggactggtaaccaacgagaagaccgaggggagtcgcccccgtatttgtgatgcggaggtcgggccggagtgggagtgggcgggagtccggaagggggatggacacgtccgtgacgtcggttctcgtacgttcgttgggcgtcgacggccgtcggaccgttccggtcccgtacggaccctactaccaaacctaacactaccgaaggaaggaaggacgtagacgtagtacgtactacgtagtggtagggtaacgtaagttagtggagtaaggtacggtaaacttacctaatagttcgtaagttggtttacgttagggtaaggttacgggtaacggtaacgggtacgtaacccggttacggtaacggtaccgacggtaaccccgg

SEQ ID NO: 285484 - DNA, 714 bp, Homo sapiens
  misc_feature: GYAE6OF02GASZ1.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggacgcctcggtcacactcacctgccacctgacgcagcggctacaatgaatataaggtggactcgggtaaccaacagagaaccgaggggagtcgccccgatttggagagtgcgaggtcgggcccggagtcggggagtgggcgggataccggaagggggactggcgacgtccgtgtacgttccggttctcgtacgttcgttaggggtctcgacggtccgtcggacctccggttccctacgaccctactacccaaacaaacctaacgttacccgaagggaaaggtacgggaatacggaccgaagggttacgaaccttaaccgttacggttcgggtaaggggtaaccgttaaagtttcggtagggtaccgtaaggtacgggtaaaccgttaacctaacggttactttaagggtacttttccgggttaacgttttaacgggggtaacgggttaggggtaaccgggttaaacgggtaccgttaaaccccggggttaccggtaaaaccgggttcccggaaccggtaaaccccccgg

SEQ ID NO: 285485 - DNA, 761 bp, Homo sapiens
  misc_feature: GYAE6OF02IXT76.43.73.G07.1.454.CMB.1.raw
  modified_base (192)..(192): a, c, t, g, unknown or other
  misc_feature (192)..(192): n is a, c, g, or t
tcagtgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctcccgtgggacncctcggtcacactcacctgccaccctgacgcagcgctaacatgaatagtaaggtggactaggtaaccaacagacgaccgaggggagtccgaccccgtagtttcgtagatggcggaggtcggggacccggagtgggagtcgggcgggaacgtaccggaaagggggtagtcggacgacgttcccgtaggtacgttcggttctacgtacggtttcgttcgggcttaccggtacggtccgttacggtaccgttacccgggtcccgtacgaacccgtacttaaccgaaaccgaaaccgaaaccgttaaccccggaaagggtaaacgggtaacggtaacgttaccggaacgtaacgggttaccgtaaccgttaaccgtttaacggttaacgggttaacggggaaacgtttaaaggtttacggttacggggtaaccggtagggttaaacgggtaacgttaaccgtacgttaagtttacggttaacgtttacggtttacggttttaagggaacgggttacgggtaacggtaacgggttacccgtaacccgggtaccgtaacgggtccgaaacccggg

SEQ ID NO: 285486 - DNA, 630 bp, Homo sapiens
  misc_feature: GYAE6OF02HS73U.43.73.G07.1.454.CMB.1.raw
  modified_base (189)..(189): a, c, t, g, unknown or other
  misc_feature (189)..(189): n is a, c, g, or t
tcagtgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccacttctgcatcagcctccctgggancctcggtcacactcacctgccacctgacgcagcggctacaatgaatataaggtgactggtaacaacagagaccgaggggagtcgccccgatttgtgatgcggagtcgggcccggtagtgggagtcgggacgggacgtaccggaagggggtatacgggactacgtcccgtagacgttcggttctcgtacgtcgttgggctcgacggtccgtggtacgtcccggtaccctacgtaccctacgtacaaacaacacgtaccgaaggtaagtaaggagtcgaacgtagtacgaacgttaactacggtagtacgggaacgttaagttacgtagggacgtaaggtacgggtaactacctacgtagttaggtaacttcggtttaacgttggtaacggttagggaacgtaacgggtaccgtaaccggttaccgaacgggtctaacccggg

SEQ ID NO: 285487 - DNA, 671 bp, Homo sapiens
  misc_feature: GYAE6OF02HYDWL.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagccttcccgtgggacgcctcggtcacactcacctgccacctgacgcagcgctacaatgaatataaggtgactggtaccaacagagaccgaggggagtcgaccccgtattgtgatggcggaggtcggggcccggagtggggagtgggacgggataccggaaggggggatgggcacgtccgtaggacgttcggtttactcgacggttcgttacgggctccggacggtccctacggtaccgttccgggtccccgtacggaaccccgtaacgtacccaaacctaaaccgtacttacccggaacgggtaaaggaacgggtaacgtacggaacgtaggttacgtaacttaaccgttacgtaggttacggggaacgtaaagtttagtgggactagggtacggaaacttaccgtacagttcggtaagttcggttacgtttagggaaggttacgggaagtaacggttaccgaaccggtaccgtaacggtccgaacgtaaccccgg

SEQ ID NO: 285488 - DNA, 761 bp, Homo sapiens
  misc_feature: GYAE6OF02GS0EV.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggacgcctcggtcacactcacctgccacctgacgcagcggctacaatgaatataaggtggactggtaccaacagagaccgaggggagtcgacccccgtatttcggtgatgcggaggtcgggcccggagtgggagtcgggcgggacgtaccggaaggggggatcgggacacgttcccgtggtaacgttcgggtttctacggtacggttaccgtttggggcccttacggacgggtccccgttaggtacccggtttacccgggttccccgtacggtaaccccgtaacgtacccgaaaaacccgtaaaccgtaaacgttaccccgggaaaagggtaaaccggaaaggggttaacgttacgggaaaccgtaagggttaacccgtaacctttaaaccggttaacggttacggggtacggggtaaaccgtaaagtttaggtacgggtacgtaacgggttaggtaaacttaccgtaagtacgttaggtttaacgtcgtttaacggtttagggaacggtttaacgggaacggtaacgggttaccgtaacccggtaccggtaacggttaccgaaccggtaaccccgg

SEQ ID NO: 285489 - DNA, 562 bp, Homo sapiens
  misc_feature: GYAE6OF02IC0N0.43.73.G07.1.454.CMB.1.raw
  modified_base (127)..(127): a, c, t, g, unknown or other
  misc_feature (127)..(127): n is a, c, g, or t
  modified_base (188)..(188): a, c, t, g, unknown or other
  misc_feature (188)..(188): n is a, c, g, or t
  modified_base (216)..(216): a, c, t, g, unknown or other
  misc_feature (216)..(216): n is a, c, g, or t
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctnacagggtccctctcccagcttgtgctgactcagccaccttctgcatcagcctccctgggancctcggtcacactcacctgcaccctgancagcgctacatgaatataaggtgactggtaccaacagagaccaggggatgcccccgattcgtgatgcgagtgggcccggatgggatggcggatccgaaggggatggcagtccngatcggttctcgagttcgtggctcaggcctgactcggtccctgaccatcaacaacataccaggaagagtanagactagtgactactacgtgagggtacaattagagtaaccgaggtacggtaaacgttacctaacgtatacggttattcggttactttagggaacggttacggaacggtaacggttaccgtaacccgggttacccgaaaggttcccgacgtaaaccccccggg

SEQ ID NO: 285490 - DNA, 695 bp, Homo sapiens
  misc_feature: GYAE6OF02HXKZ6.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagcctaccttctgcatccaggccctcccgtggggacgtccgtcggtcacgtaccttccacctcgccaccctgacgcacggcgactaacaatgaataagtaaggtcggactacggtaccaaagagagaccggaggggagtccggacccccgtagtttggagtagttcggacggagggtcgggacccggaggtggggaagtcggggcgggacgtaccggaagggggtactcggacgtacgttcccgtagtacgttcggttcctacgtacgttcgttcgggtctacgacggtccgtgtaccgtaccgtcccgtacgtaacccgtataaccaaacgaactacgtaccggaacggtaagaacggtaagtacgaacgttaagtcgtaaacttaccgttagtacggtaagggtaacgtaagttagacgggataacgggtacggtaacttaacgtactagttacgtgtaacggttggttaacggtaagggttaccggaacgggtacgtaccgaccgttaacggaacggtacaccggtaaaccccg

SEQ ID NO: 285491 - DNA, 796 bp, Homo sapiens
  misc_feature: GYAE6OF02HTKEN.43.73.G07.1.454.CMB.1.raw
  modified_base (210)..(210): a, c, t, g, unknown or other
  misc_feature (210)..(210): n is a, c, g, or t
tcagtgtgagtagtcacgaccggtgctcgatttagctctacgctcaggggagactgaagaacccagcatgcagcagctccacatggcctgggctcctctgctcctcaccctcctcagtctcctcacgacgggtccctctcccagtcttgtcgctgactcacgccctaccttctcggactactccgaacgtcccctcccgttaggggaccncccgttccggtaccaacctaccttccgaccgttcgacccctaacccgtggacggaccctagggcccggtacctaaaaccggaacttagggaaaactaacgttaaaaggggtcggtaaaccgttacgggtaaccaaaaccggacggtaaacgacccgggtaagggggacggtaccggtacccccggtaagtttcgtaggtaacgttacgggaccggtaacgggttccggggaccccgtaggtagggggttacgacggggtacgggtaaccgttaccggggtaacgggggaagtcgggaacgccgttaccggagtacggttcggttacgtcgaacgtcgtttgggccttacgacggtccgtagtacccgttcgtcccgtagaccctagtacaaacaactcgtaaccgaaggtaacgaagagtacgacgaagtacgtataccgtaggtacggtaacggacgtaagacggtcgacgtaaggtacgtaaactaccgaagtaacttggtacttacggttacgttagggtaaacgggtcggaacgttacggtaccctaacgggtaacccgtacggtacccgaggtaaccccgg

SEQ ID NO: 285492 - DNA, 679 bp, Homo sapiens
  misc_feature: GYAE6OF02HMEIC.43.73.G07.1.454.CMB.1.raw
  modified_base (187)..(187): a, c, t, g, unknown or other
  misc_feature (187)..(187): n is a, c, g, or t
  modified_base (287)..(287): a, c, t, g, unknown or other
  misc_feature (287)..(287): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctcctgggancctcggtcacactcacctgccaccctgacgcagcggctacaatgaatataaggtgactggtaaccaacagagaccgaggggagtcgaccccgtatttcgngatggcgaggtcgggcccggtagtggggagtgggacgggagtaccggaagggggtagtggaccgacgtcccgtgtacgttccgggtttctcgtacggttcgttcggggtcttacggacggtccgttcggtaccgttcccgggtccccgtacgaacccctacgtaacccaaaccgtaaacctacttaccccggaaagggtaaacggagggttaacgtacgaacgtaagtacgtaacttacgtaacggttggtacggggtaactaaagtttacggtagggacgtaagggttaaggaaacgttaccgtacgtagttagtacgttgtttacgttagggtaaggtacgggtaagtacggtacgtaacccggttacgaacggtcgacggtaaccccgg

SEQ ID NO: 285493 - DNA, 718 bp, Homo sapiens
  misc_feature: GYAE6OF02JWND4.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagcttgtgctgactcagccaccttctgcatcacgcctccctgggacgcctcggtcacactcacctgccaccctgacgcacgcggctaacatgaatagtaaggtggactaggtaccaacagacgacgaggggagtcgccccgtattgtgatgcggaggtcgggccggagtgggacgtgggcgggtagtaccggaaagggggcgtacggcgtacgtcccgtaggtacgttccggttcgtcgtaggttcgttacgggccgtacggacggtccgttaggacccgttccggtcccgttacgacccgtactacgaaacctaacgtacgtaccgaagggaacggtaggtaactacgaacgtaggtaccgtaacgttaaccgttaacggtacgggtaacgggtaacgttaacgttaacgggtacgggtaacgtaacgggtaacggtaaaccttaaccggtaacgtagttacggttacgttaacgggttacggttttaagggaacgggttaccgggtaacgggttaacggttacccggtaaccggttaacggtaacgggttaccgtaaccgggtaaccccggg

SEQ ID NO: 285494 - DNA, 699 bp, Homo sapiens
  misc_feature: GYAE6OF02IGNW3.43.73.G07.1.454.CMB.1.raw
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (403)..(403): a, c, t, g, unknown or other
  misc_feature (403)..(403): n is a, c, g, or t
  modified_base (580)..(580): a, c, t, g, unknown or other
  misc_feature (580)..(580): n is a, c, g, or t
tcagtgtgagtagtcacgaccggtgctcgatttagctctacgctcagggggagactgaagaacccagcattgcagcagctccaccatggcctgggctcctctgctcctccaccctcctcacgtctcctcacgacgggtccctcctcccagtcttgtcgctgactcacgcctaccttctgcctatccacgcctcccgtgggacgcccgttcgggtacaccacctccacgtcgaccaccctgacgcgacggcggcctaagatagaaatagtaaggcggtacgtagtaaccaanacggacgacggaggggacgtacgtccccgtagttgtcgtatggcgaggtcgggaccggnggtacgggtggtaggacgggtacgaccggaagggggtacgtggccacgtccgnggtacgttccggttactcgtacgttcgtcggtcaccggtacggtccgtacggtaccgttcccggtccgtaccgacctacgtaacaaaccgtaactacgtaccgaaaggaacgtaaggacgtacgacgtaacgttacgtactaacgttacggtaggtaaggaactaacgttaggacgngtaacgggtacgtaaacttcaacgtgtaggttattaacgggttagttaagggtaaacggtccgggtaaggtaccggtacccgtacggtaccgggtaaacgttccgaacccggaacccgg

SEQ ID NO: 285495 - DNA, 552 bp, Homo sapiens
  misc_feature: GYAE6OF02F18WX.43.73.G07.1.454.CMB.1.raw
  modified_base (188)..(188): a, c, t, g, unknown or other
  misc_feature (188)..(188): n is a, c, g, or t
  modified_base (464)..(464): a, c, t, g, unknown or other
  misc_feature (464)..(464): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggancctcggtcacactcacctgcaccctgagcagcggctacaatgaatataaggtgactggtaccaacagagaccgaggggagtcgccccgatttgtgatgcgagtgggccggagtgggagtggcgggatccgaagggggatggcatcctgatcggttctcgacgtcgttgggctcgaggcctgacgttccggtcccgtgaaccactacaaaccaaacacttaccgaaggaagaaggatgaacgagtagacctactacgtggtacggtaacgaattagnggtcgaaggtaggaatacctatatgtagttgttagttaggtaaggtagggacgtaaggtacgaccggtacgaacggtcacgtaacccg

SEQ ID NO: 285496 - DNA, 718 bp, Homo sapiens
  misc_feature: GYAE6OF02HYDBT.43.73.G07.1.454.CMB.1.raw
  modified_base (188)..(188): a, c, t, g, unknown or other
  misc_feature (188)..(188): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctccctgggancctcggtcacactcacctgccacctgagcagcgctacaatgaatataaggtggactggtaccaacagagaccgaggggacgtcggccccgtatttcgtgagtcggcgaggttcgggccggagtggggtagtgggcgggagtaccgaaggggggatcgggacacgtcccgtggtacgttcggttacctcgtagttcgttgggccttcgacggtcctcggtaccgtccggtaccccgtgtacccaacgtaccaaacaaaccgtaacgtaccggaagggaaacggtaggtaacgtacggacgtaaccggttagtaaaccgttacgttaaccggttagggtaacggggtaaccgttaaagtttaacgtacgggtacgtaacgggttaagggtaaaccttaaccgtaacgttagttacggtttaacgtacggttttaccgggtttaaggggtaagggttaccggggtaacggttaacgggttaccggtaacccggttaaaccggtaacgggtaccgtaacccggtaaaccccggg

SEQ ID NO: 285497 - DNA, 691 bp, Homo sapiens
  misc_feature: GYAE6OF02HIHFZ.43.73.G07.1.454.CMB.1.raw
  modified_base (302)..(302): a, c, t, g, unknown or other
  misc_feature (302)..(302): n is a, c, g, or t
tcagtgtgagtagtcacgaccggtgctcgatttagctctacgctcagggggagactgaagaacccagcattgcagcagctccacatggcctgggctcctctgctcctcaccctcctcagtctcctcacacgggtccctctcccagcttgtgctgactcacgcctaccttctgcatcacgtccctcccgtgggacgccgtcggtcacactccacctgccacctgacgcaggcgactaacatgaactagtaaggtggacgtaggtaccaacagacgaccgaggggacgtcgaccccgtatttgngacgtcggcgtaggtcgggccggagtgggagtcgggacgggtacgtaccggaagggggacgtcggacgtacgtcccgtagtacgttcggttactcgtacggttcgtcgggcttacggacggtccgtgtaccgtccggtccgtacgacctaacgaccaaacaactacgtaacggaacggtaaggaacgtacgtacggaacgtacgtacgtaactacggttacgtagggtacgggtaacgtaagttcgggtacggacgtaacgggtacggtaaccttactaacgtagttacgttacgtttcggttaggtttaacgggtaacgggtacgggtaacggtaacgggttaccggtaaccggtaccgggtaacggttacccgacggtaaaccccgg

SEQ ID NO: 285498 - DNA, 591 bp, Homo sapiens
  misc_feature: GYAE6OF02FXOH1.43.73.G07.1.454.CMB.1.raw
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (518)..(518): a, c, t, g, unknown or other
  misc_feature (518)..(518): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccacttctgcatcagcctcccgtgggacgcctcggtcacctacgtccacctgaccaccctgacgcagcggctacaatgaatagtaaggtgactaggtaccaanagagaccgaggggagtcgccccgtatttgngatggcgaggttggggcccggaggtgggagtgggcgggagtaccggaaggggatgggctacgtcccgagtacgtcggtttcacgtaggttcgttagggctcgaggtccctgaccgtccggtccctggaccagtacaaacacactaccgaaggacgaggatgaacacgtacgacctactagttggacggtaaggtaattagtaggagagtaggaacttacacgtancgtagttggttacgttagggaggtagggtaacgaacggttacaaccggtacgtacggtaccgtacgaacccgg

SEQ ID NO: 285499 - DNA, 794 bp, Homo sapiens
  misc_feature: GYAE6OF02I43W6.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacgacgggtccctctcccagtcttgtgctcgactcacgccctaccttctcgcatacacgtccctcccgtgggactccgtcggaccaccactcacctcgcctacccgtagacgcgacggccggactaacgaagtagaaagttaacgtaagggtaggacgtacggtaaaccaacgacgaacggaacccggaggggaacggttcccggacccccgttagtttaggtcgacgtcggaccgggtaggggtccgggtacccggggaagtcgggggtacggtacggggtacggggtacggtacccggggaagggggtactcggggactaccgtaccgtagtacgttcggtttcgtacgtacggttacggttcgtccgtacggaccggtccgttcggtaccgttcccggtaccgtaccgacctaactacgaaacctaaccgaacgtaccgaaagggaacgggtaacgtaagtacggtaacgtacggtaacgttaccgtaatccgggttaggtacgggaacgtaagttaccggagttacggagggtaaacggttaactaccggttatacgtttagggttactaacggttttacggaacggttagggtaacgggtaaccggttaacggttacccggaaccggttaccggaaccgggtacctacccggtaaacccggg

SEQ ID NO: 285500 - DNA, 755 bp, Homo sapiens
  misc_feature: GYAE6OF02IMUOQ.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcacgcctaccttctgcatcagccctcccgtgggacgtcctcggtacacacctcacccgtcgccctaccctggacgcgacggccggactaacaagtagaaataagtaagggtacggtacgttacggtaacccaaagacgaacggaccgggtaaggggacgtacccggacccccggttagttttcggtacggaacggtggacgggtggggtccgggggacccgggtagtcggggacgggtcgggacggtaacggtaccggggaaagggggtcgtacggaccttacgtcccgttaggtaccggttccggtttcgtcgtaggtttcggtcgggtactacggtacggtccgtacggtccgtccgggttccctacgtaaccactaaccgaaactaaacgtacgaaccgggtaagggaaacgaaggtacgaacgaaccgttagtacgttaaccgtaacgttcggtagggtaacggtaacgttaacgtagtacggacgggtaacgggttaagtaaacctacgttagtagtagttacgtcggttaggttaggtagggaacggtaacgtaccggtcctaaacggtcgaacgtcggaaccgtaacccgg

SEQ ID NO: 285501 - DNA, 918 bp, Homo sapiens
  misc_feature: GYAE6OF02HL6YB.43.73.G07.1.454.CMB.1.raw
tcagtgtgagtagtcacgaccggtgctcgatttagctctacgctcagggggagactgaagaacccagcattgcagcagctccaccatggcctggctcctctgctcctcacctcctcagtctcctcacacggtccctctcccagcttgtgctgacctcacgccctacctttctcgactatccgacgtcccttcccgttggggactcccgtccggtaccactacctcgacctcgcccaaccgtgagtccgacggccggacctaaataagtagtaaaagttaacgtaaaggggttacggtactaacggtaaccaaacgaaggaacggaaccggtaaggggtacggtacccgggtaccccccggttaagttttcgggtaactggtacggtacggtacggggttaccggggtaccccggtagggtacggggtacgggttcggggaccgggtaacgggttccgggtaaaacgggggacgtacggggtacccgtaacgttcccggtacgggttaaccggtttcccggtttacggtaccgtttacgggtttcggtttcgggtaccggttaccggaacggttccggtaccggttacccggttacccgggttcccgttaaccgtaaccctaacgtaaacccaaacgttaaacctaacggtaccggttaaaacgggaacggtaacggtaaacgtaggtaacccggaggttaaccgttaaccgtacgtttaacgggtacggtacggggtaaaccgtttaagttaccgggaagggttacgtaaacggggtacggttaaaccgtaacggtttaccaaggtttcggtttaaagttcgggtttaacgttagggtaaccgggttaaggggaacccggttacggtaaccccgtcggttaaaccggtaaggggttcccaacgggttaaaccccccgg

SEQ ID NO: 285502 - DNA, 714 bp, Homo sapiens
  misc_feature: GYAE6OF02GQITR.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagcttgtgctgactcagccatcttctgcatcacgccctccgtgggacgccgtccggtcaccactccacctcgccacccgtgacgcgacgcggactacaatagaataagtaacggtacggactacggtaaccgtaaacgaacggaacggaccggaaggggacgtccggaccccgtatttggtgtagtcggacggtaggtcggggacccggtaggtgggagtcggggtacgggacgtacggaagggggtacgtcggacgtaccgtccgtggtacgtttccggttcgtacgtcggtttacgttcgggtccgtacggtaccgggtccgtacggtaccgttcccggttacccgtccgtaacctaaccgtaacctaaaccgaaacctacgtaaccggaacggtaaagggaaggtacgtaacggtaactacgtacgacttaacgtagttacgggtaggtaacgtaagttagacggtacgtaggtacgaacgtacgtatacgttagtacgttaggttaggttaggtaagggtaggtacggtaacggttaccgacggtaccggtagtaccgtaacccgg

SEQ ID NO: 285503 - DNA, 806 bp, Homo sapiens
  misc_feature: GYAE6OF02GF2I7.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagcctcccgtgggagcctcggtcacactcacctgcaccctgagcagcgctacatgaatataggtgactggtaccaacagagaccgaggggagtcgaccccgtattgtgatgcgaggtcgggccggagtgggagtgggcgggacgtaccggaagggggactacgggacctacgtaccccgtggtacgttcgggtttacctacgtacggttcggtttacggggtccgtaccggtaacgggtcccgtacggtacccgttacccgggttaccccgtacggtaaacccgtaacttacccaaaaccgtaaaccgtaaccgttaacccgaaacgggaaacgggtaacgggtaaacgttacgggaaccgtaacggttacgtaaaccgtttaaaccgttaaccggttagggtaccgggggtaaacgttaaacggtttaggttacggggtacgtaaaggggttacgggtaaaaccttaacccgggttaaacgtacggtttacggttaacgttttaccgggtttaaccggtttttaacgggggaaaccgggtttaacgggggtaaaccgggttaaccggttacccggttaaacccgggttaacccggtaacggggtttaacccgaccggtaaaaccccccggg

SEQ ID NO: 285504 - DNA, 855 bp, Homo sapiens
  misc_feature: GYAE6OF02JZVQW.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagtcttgtgctgactcacgcctaccttctcgctactaccgacgtccccgttcccgtaggggccgtcccgttcggtaccaacctacctccaccctcgacctacccgtaggacgacacggccggtactaaccgaagtagtaaacgttacgtaaagggtacggtaaccgttacggtaacccaaacgaacggaacggaacccggaagggggtacgtacccgtacccccggttatttcggtacggtaatcggtacggtacgggtccggggacccggtaggtcgggtacggtcggggaccgggtacgtaaccgggtaaagggggtcgtacgggtcctaaccggtccgtaggtacggttccggttacgtacgtacggttacgttcgggtcctacgggtacggtacccgttcggtacccggttcccgtacccgtacgtaacctaccgtaaaccaaacgtaaaccgtacgttaacccgaagggaaacggtaacggtataaccggtaacgtacggtaaccgtaaccgttacgtaacggttacggtaacgggtacgttaaacgttagggtacggtacggtaacggtaaaccgttaacgtaaccgtaaggtactttacggttaacggttcggtttaacggttaagggtaacgggttaacgggtacgttaaccggacccgggttaacgtaaccggtaccgggtaacgtacccgtaaaccccggg

SEQ ID NO: 285505 - DNA, 989 bp, Homo sapiens
  misc_feature: GYAE6OF02HODUB.43.73.G07.1.454.CMB.1.raw
  modified_base (176)..(176): a, c, t, g, unknown or other
  misc_feature (176)..(176): n is a, c, g, or t
tcagtgtgagtagtcacgaccggtgctcgatttagctctacgctcagggggagactgaagaacccagcattgcagcagctccacatggcctgggctcctctgctcctcaccctcctcagtctcctcacgtcgggtccctctccagtcttgtcgctagactcacgtccctaccttcngctacgtcaccgtccctcccggtaggggccgtcccgttaccgggtaccaacctcctccacccgttcgacccacccgtggacgccgaacggtccggtactaacgtaacgtaggtaaaagttaagtaaacggggttcggtaaccgttaaccgggtaaacccaaaaggacggaaccgggtaacccggaacgggggggtaaccgtccccggggttaccccccgttaaggttttccggtagtaacggttacggccgggtaaccggggttccgggggaccccgggtaaggttcgggggaaacggttcgggggacggggtaaccgttaaccgggggaagggggtacgttcgggaccgttaaccggtaccggtcggtaccggtttaccgggtttccgtaacggttacgggtttcggttcggggtacctacccgggtaccggttaaccgttcccggtaacccgggttcccgggttccccgtacgggtaaacccctaacggtaaaccctaaaccgtaaacgtaacccggtaacgggaaacgggaaacgggtacggttaaacggtaccggtaaacgggttacgtaaacccgggtttaacttaaacccgggtggttaaaccgggggttaaccgggtaaacgttaaccggtttaaggacccgggtaaacggttaaaggggttaaccggtaaaccgttaccgtaaaccgttaggttaacggtttaccggttaaggtttacccggttaagggggtaacggtaaccgggttacgggtaaccgtaccgtaaccggttacccggtaacggtaccgacccggtaaaccccgg

SEQ ID NO: 285506 - DNA, 774 bp, Homo sapiens
  misc_feature: GYAE6OF02JMNM3.43.73.G07.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctccagcttgtgctgactcagccctaccttctgacatcagtccctcccgtaggggacnccgtccggtcactaccgtcacctcggcctaccctgacgcacggtcggctacaagtnaatagtaggtgacgtcgtaccaacagacgacgaggggacgtcgccccgtagttgngtagtgcgtaggtcgggacccggagtcgggagtgggcggtacgtacggaggggatcggactacgtccgtgtacgttcggttctacgtaggttcgttcgggctaccggacggtcctacggtacccggttccgggttacccctacgggtaaccctacgtaaccctaacccgaaactaccgtacccgggaaacggtaacggtacgggtaacgttaggaaccggtacggtaccgtaaaccgttaaccggtttaccgtaggggttaccggggaaacgtttaacggtttaggaaccgggttaccggaaaggggttaacccggtaaacgttacccgtaaacgttaggttacgttaacggttcggtttacgggtttaagggggtaaccggttaaggggtaacccgggtaacggttacccggtaaacccggttaacccgggtaaccggggttaacccggtaccggaaacccccggg

SEQ ID NO: 285507 - DNA, 725 bp, Homo sapiens
  misc_feature: GYAE6OF02FJDGT.43.73.G07.1.454.CMB.1.raw
  modified_base (191)..(191): a, c, t, g, unknown or other
  misc_feature (191)..(191): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagccaccttctgcatcagccctcccgtgggacncctcggtcacactccacctgccacccctgacgcagcggctacatgaatataaggtgactcggtaccaacgagacgacccgagggggacgtcggcccccgtattttggtgatggcggtaggtcggggcccggagtcgggagtggggcgggacgtaccgggaagggggacgtcgggctaacgtcccgtaggtacgttcgggtttctacgtacggttcgttcgggtctcggacggtcctcgtacgtccggtcccgcgaaccacgtaccaacaacctacgtaccgaagggtaaacggacggtaacgtacgaacgtacggtacgtaaccgttaaccgttaacggttacggtaacgggtaaccgtaaacgtttaaggtacgggtaacgtaacggttaacgggtaaaccttaaccgttaacgtacgttacgtacggtttaggttaccggtttacggggtaaacggttacggggaaaccggtaaccggttaccggaaacccggttacccggtaaacgggttcccgaaccggtaacccccggg

SEQ ID NO: 285508 - DNA, 706 bp, Homo sapiens
  misc_feature: GYAE6OF02FT8JT.43.73.G07.1.454.CMB.1.raw
  modified_base (185)..(185): a, c, t, g, unknown or other
  misc_feature (185)..(185): n is a, c, g, or t
  modified_base (317)..(317): a, c, t, g, unknown or other
  misc_feature (317)..(317): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagcctaccttctgcatcagcctcccgngggacgcctcggtcacacgtccacctgccacccctgacgcgaggcggcttaacaatcgaatagtaaggtggtacgtcgggtaaccaacgaggtaacgaccgagggggaacgtccggcccccgtaagttttgnggtagtcggcgaggtcgggacccggaggtgggagtgggcgggtacgtaccggaagggggtactcggggacctacgtcccgtaggtaccgttccggttcgtacgtacgggtccgttgggtcctacggtacggccctggacccgttccggtacccgcgtacctactaccgaaacctacgtactcggaaacggaaggtaggagtacgtacgagtacggaccttacgtagacggtacgggtaactaagtttagacggtacgtaaggggtaagttaaccgtaccgttaagacgttaggttacttcggtttaacggtttgggaagggttaccgggtaacggaccgggttacctaccgggttaaccgtaacgggttaccgaacggttaacccccgg

SEQ ID NO: 285509 - DNA, 644 bp, Homo sapiens
  misc_feature: GYAE6OF02IHDX3.43.73.G07.1.454.CMB.1.raw
  modified_base (194)..(194): a, c, t, g, unknown or other
  misc_feature (194)..(194): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (345)..(346): a, c, t, g, unknown or other
  misc_feature (345)..(346): n is a, c, g, or t
  modified_base (368)..(368): a, c, t, g, unknown or other
  misc_feature (368)..(368): n is a, c, g, or t
tcagtgtgagtagtcacgaccggtgctcgatttagctctacgctcagggggagactgaagaacccagcattgcagcagctccaccatggcctgggctcctctgctcctcaccctctcacgtctcctcacacgggtccctctcccagtcttgtgctgactcagccaaccttctcgacatcagcctccctgggacncctcgtcactacctcgacctgccaccctgagcgacgtcggactaacaatagaataagtaaggtaggactacgtaacaacagacgacgagggtacgtcgcccgtattcgagagtgcgaggtcggaccgngnggngnggcgacgacggagggnngacactcgtgtacgcgtttacncgtagtcgtcggtctcgacgcgtcgacggttaccgtcctacggaccaacaactaacaacacgtaccgaagggtaagaacggtagttaacgacgaaggttaacacgttaaccgttacggtagggttaacggaacgttaagtttaacgggtcggaagttacggttaaggaacttaacgttactagttaagtacgttacggtttacgttaggggtaacgtaagggtaaccggttacggtacctaccggtaaccggtaacggttcgaacccgtaacccgg

SEQ ID NO: 285510 - DNA, 962 bp, Homo sapiens
  misc_feature: GYAE6OF02I6LRI.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcacgtctcctcacgagggtcccctctacccagtcctttgtcgactgaacctcacggtcccctacctttctgacctagtccacggtcccgttccccggtaggggaccgtcccgttaccgggtaccaacctaccttccaacccttcgccctaacccgtaggacgccacggacccggtactaaactaacgttagaaaagttaaggttaacggggtacgtaccggtacggttaaacccaaaacggtaacggaaccggaacccggtaggggaccggttacccggcccccgtttaaggttttaaggtcgggtacgtcgggacggggttacgggtaccgggggaccggtaggtcggggacggttcggggggacgggtaaccggtaccggggtaagggggtaccggtcggaccgttaccgttcccgttagggttaccggtttcggtttccgtacggttacgggtttccgggttcgggtacctaccggggtacgtacccggttacggtaccccgggtttcccggtacccgtacccggaaaccgttacccgtaacctaaacccgtaaaccgtaccgtaaccgggtaaacgggaaaggtaccggttaaaagaccgtaaacggtacgggttaaccttaaccgtacggttaacgtaccggggtaaacggttaacggttaagtttcgggaacggttaaccgttaggggtaaaccgttaacgttaaccgttacggtacgtttattaacggggttaccggttttaagggttaacgggtaacggggttaccgggtaaacccggttacgggtacccgtaaaccggttaacgggtacccgggtaactaccccgggtaaccccgg

SEQ ID NO: 285511 - DNA, 700 bp, Homo sapiens
  misc_feature: GYAE6OF02HOPJ8.43.73.G07.1.454.CMB.1.raw
  modified_base (195)..(195): a, c, t, g, unknown or other
  misc_feature (195)..(195): n is a, c, g, or t
  modified_base (314)..(314): a, c, t, g, unknown or other
  misc_feature (314)..(314): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctacctcacacgggtccctctcccagcttgtgctgactcagtccaccttctgacatcacgcctcccgtgggacnccgtcggtcactactcacctgccaccgtgacgcgagcgactaacatagaactagtaaggtggacgtacggtaacctaacgagacgacggtagggacgtaccggccccgtagttcgtagngtcggacggtacggtcgggaccggtaggtcggggtagtcggggacggtacgtaccgggaagggggtacgtcggtacgtacgtccgtaggtacgttcgggttactacgtacggttacggttcgggtacgtacggtacggtaccgtacgttacccgtccggtaccctacggtacctaacgtaaccaaacgaactacgtaacggaacggtaagacggtatacgacgtaacgtacgtactaacgtcgtaggaggtaacgtagttacgacgggtacgtacgggtaacgtacgtaaccgtagtatagggtttagtcggtttaggttaacgggtacggtacgggtaacggtacggtaaccgtccggtaacgtaccggtacgaccgtaacccgg

SEQ ID NO: 285512 - DNA, 755 bp, Homo sapiens
  misc_feature: GYAE6OF02FK0RS.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctccagcttgtgctgactcagccaccttctgcatccacgcccttccccgtggggacgcccttcggtccaactactccaccttggcctaccctgagcagaccggctaacaatgaattagtaaggtggactggtaaccaacgaagacgaccgaaggggacgtcgccccgtattgtgatgcgtaggtacggcccggagtcgggtagtgggacgggacgtccgggaaagggggtagtagggccgtaacgtcccgttgtaacgttccgggtttaccgtcgtaacggttcggtttcggaccgttcgaacggtccgtcggtaccgtccgggtttaccctacggaaccctaacgtaaccctaaaccgaacaccgtaccgaacggggaaacggtaggaacgacgtaacggtaagtacgtaaccgttacttaacggttacggtttaggggaaaccgtaagtttaacgtaacgggcggtaacgggtaaacgggttaaactaaccgtaacgttacgtaggtttaacgttacggtttacgggttacggtaaaggggttaccgggttaaggtaaaccgggtaccggtacccggtaaccgtaacgggttacccgaaccggtaaacccccggg

SEQ ID NO: 285513 - DNA, 832 bp, Homo sapiens
  misc_feature: GYAE6OF02IGMI3.43.73.G07.1.454.CMB.1.raw
tcagtgtgagtagtcacgaccggtgctcgatttagctctacgctcagggggagagactgaagaacccagcattgcagcagctccaccatggcctgggctcctctgcctcctccaccctcctcacgtctcctacacacgggtccctcgtcccacgtccttgtcgtctacgactccgacgaccctaccttctcgaccatccgacgtcccttcccgtagggacgtcccgtacggtacaaccaccttaccgacccgtcgacctaccccgtagaaccgcgaggccgtaactacgtaagtagtaaattaaggtaagggtcggtaacgtacggtaaccaacgagaccggaaccggacgggtacgtaccccggtacccgttagtttacggtacgtacgttcgggaccggtacgggggtaccgggacccgggtaggtacggggacggttacgggggaccgggtaaaccggtaccggggaaaacgggggtcgtaccggtaccctaaccggttcccggtaacggtaccgtttccgggtttccaacggttcgggttccgtacggtaccgtccgtacggtcccgtcggtacccgttccggtaacccgtcggaaacctacgtaaacaaacgtaacctacgtaacggaaacgggaaccggtagtaacgtaacggtaaacgtcggtaaacctaaccgttaacgtagggtaacggggttacgaacgttaacgggtacggtacggaacggttaggttaaccgtaactacccggtattagttagttcttaggtaacgttagggtaacgtacggtaacgtacggtccgtaccggtaacgacgtccgaacccg

SEQ ID NO: 285514 - DNA, 760 bp, Homo sapiens
  misc_feature: GYAE6OF02FSWSY.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagcctaccttctgcatcagccctccctgggagcctcggtcacactccacctgcaccctgacgcagccggctaacaatcgaataagtaaggtggactggtaaccaacagagaccgaggggacgccgccccgtatttgagatgcggaggtcggggacccggaggtcgggagtggggcgggtagtaccgggaagggggacgtggaccgtaacgttccgtggttaacgttcgggtttcttcgtacggttcgggttacgggtcgttaccggagggtccctggtaccggtttcccgtacccggtccgtaaccctacgtaacccgaaacctaaaccgtaacctcccggaaaggtaaagggtaacggtaacgttacgaacggtacggttaaccgaaccgtttaaccggttaaccggtttggggtaaacggggttaacccgttaaagtttacggtacgggtacgggttaaggttaacgggaaacttacccgtagttacgtcggtttaaggttcggtttacggttttaacgggaaagggtttacgggggaaccggttaacggttaccgtaacccgggttaacgtaccgggttaaccaccggtaacccccggg

SEQ ID NO: 285515 - DNA, 739 bp, Homo sapiens
  misc_feature: GYAE6OF02G0SLZ.43.73.G07.1.454.CMB.1.raw
  modified_base (388)..(388): a, c, t, g, unknown or other
  misc_feature (388)..(388): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacagggtccctctcccagcttgtgctgactcagcctaccttctgcatcagccctcccgtgggacgccgtcggtccacacctccacctcgccacccgtgacgcacggcggactacaagtacgaagtaataaggtggacgtacgtaaccaacgagacgaccgaggggacgtccggaccccgtagtttcggtagtacgtggacggacgggttccggggaccggtaggtcggggtagtcggggacggtacggtacgggaaggggngtcggactcgtccgtaggtacgttacggtttctacgtacggttcgtcggtcgtcggacggtccgtacggtaccgtccggtacccgtacgtacctacgtaacccgtaaacctaacgacctaaccggaaacggtaaacggaacggtaacgacggtaaccgtaagtaccgtaaccttaaccggttagtaccgggtaaggtaaccgttaagtacggtacgtacgttaagggtacggtaaacttaaccgtagtacgttacggttaacgtttggttacggttagggtaacggtacgggttaacgaccggttaccggtaaccgttaccggaacggttaccggaacccgtaaccccggg

SEQ ID NO: 285516 - DNA, 676 bp, Homo sapiens
  misc_feature: GYAE6OF02G4WFM.43.73.G07.1.454.CMB.1.raw
  modified_base (319)..(319): a, c, t, g, unknown or other
  misc_feature (319)..(319): n is a, c, g, or t
  modified_base (470)..(470): a, c, t, g, unknown or other
  misc_feature (470)..(470): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacgacgggtccctctcccagtcttgtgctgactcacgccctacctttctcgctatcacgtccctcccgtgggacgtccgtcggtccacacctcaccgtcgaccaccctgacgcgacggcgactacaagtacgaataagtaaggtgacgtcgtaaccaagacgacgacgagggagtccgacccgtagttacgngtagtcgacgcggtcgggaccggagtagggacgtcgggacggtacggacggtaaggggatcgggaccgtacgtacccgtaggtacgtttcggtacttacgtacggtttcggtcggtacgtacgtacggtccgtcgtaccgtccggttaccncgtaactactaacgaacactacgtaccgaagggtacgaggactacgacgtagtactactacgtggtacggtacggtaattagttagacgtgaaggtaacgaaacttcaaggtcgtagttacgttggttacggttaagggtaacggtagggttaaccggaggtcccgtaacggttaaccgtacgggacccgtaaccgtaaccccggg

SEQ ID NO: 285517 - DNA, 825 bp, Homo sapiens
  misc_feature: GYAE6OF02F1LOP.43.73.G07.1.454.CMB.1.raw
tcagtgtgagtagtcacgaccggtgctcgatttagctctacgctcaggggggagactgaagaacccagcattgcagcagctccaccatggcctgggctcctctgctcctcaccctcctcagtctcctcacagggtccctctcccagcttgtgctgacctcgacgcctaccttctgcctactcgacgccctccgtgggaacgtcccgtcggtccactaccgtccacctcgaccacccgtgacgtccgaggccgtactaaccgtaagtacgtaataacggtaaggtacgtacgtacgtacaacaggacgaaccggagggacgtaccgtccccgtatttcgtacgtacgcggtacggtacgggtaccgggtccggtaggtggggtacgtcggggacgggtacgtaacggggacggggtacgtacggtactaccgtaccggtagtacggttacgttccgtacggtacggttcggttcggggacctacggacggtcccgttacggtaccgttccggttaaccctccggtaaacccgtaacggtaactaaacccgaacggtttaaccaccgggttaacggaaacgggtaacggttaacggtaccggtaacggtaaccgttaaccgtaccgttaaaccgttacgggttaacggggtacgggttaaaaccgttacgttacgggtaacggggtacgtaaggggttaaacggtaacctaacgttacggtacgtttaacgttgggttacgtttaacgggttacgggtaacggtaagggttaaccggtaacggaacccgttaccggtaaccggacggttacgacccgtaaccccggg

SEQ ID NO: 285518 - DNA, 933 bp, Homo sapiens
  misc_feature: GYAE6OF02GGVO5.43.73.G07.1.454.CMB.1.raw
  modified_base (127)..(127): a, c, t, g, unknown or other
  misc_feature (127)..(127): n is a, c, g, or t
  modified_base (171)..(171): a, c, t, g, unknown or other
  misc_feature (171)..(171): n is a, c, g, or t
  modified_base (198)..(198): a, c, t, g, unknown or other
  misc_feature (198)..(198): n is a, c, g, or t
  modified_base (824)..(824): a, c, t, g, unknown or other
  misc_feature (824)..(824): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctnacagggtccctctccagcttgtgctgacctcacgcctaccttcncgcatccacgtccctcccgtggggacncccgtcggtaccacgactccgacctggccctacccgtgaacgcgtaacgccggtacctaaccaaagtaggtaaacgttaagttaacgggtacggtaccgtacgggtaaccctaaacgaaggtaaccgaacccgggaacggggtacggttacccggtaccccccggttaagttttacgggtacggtaacggttcggtaaccgggtacggggttacccggggggaccccggggtaagggttaccgggggtaacggttacggggggaccgggggttaacggtaacccggggaaagggggggtacggtaccgggaccggtaccgttacccgttagggttaaccgtttaccggggtttacccgttacgtacggtttacggtttccggggtaaccgttaccgggttaccgggtacccgttacggtaacccggttccccgggttaccccgttacggtaaccccgttaacgttaacccgaaaccgtaaaccctaaccggttaacccggtaaagggaaacgggtacggtaacgtacgtaacgtaacgggtaaccgttaaccgtaaccggttacggtacggtagggttaaacgtaagtttcggacggttacgtaaggtacggtaaacttaaccgtntaacgtacgtttagtacggtttaacggttacgggtaacgggttacggtaacgggtaacggtttaccggaccggttaaccggtaacggttaccggaaccggtaaccccgg

SEQ ID NO: 285519 - DNA, 954 bp, Homo sapiens
  misc_feature: GYAE6OF02FH0WR.43.73.G07.1.454.CMB.1.raw
tcagtgtgagtagtcacgaccggtgctcgatttagctctacgctcagggggagactgaagaacccagcattgcagcagctccaccatggcctgggctcctctgctcctcaccctcctcagtctcctcaccagggtccctctcccagcttgtgctgaactcagcctaccttctgcattcacgtccctcccgtgggacgtcctccggtacaacacctccgacctcggaccaccccgttgacgcaggccggactaacactagaacttacgtaaaggtcggtactaggttacccaactaggaacggtaccggtaacgggggacggttaccggccccccggtaagtttttccgtaggtacgttaacggccgggttaacggttcggggggtaccccgggtacggtacgggggacgtttcgggggaccggggtaaccgtttaccggggaaaacgggggggtacgttacgggtaccgtaccgttaccccggttgggtacggtttacccgggtttaccgtacggttaaccgggtttccgttacgggggtcccgtttacggacccgggttccgtacgggtacccgtttcccgggtaccccgtacggtaaacccttacgtaaccctaaacggaaacccttacggtaacccggtaaagggtaaaccgggtaaacggtaacgttaaacggttaaaccgtacgggttaaaccgttaccggttaaaccgtttacggtaaccggggtaaggggtaaaccgtttaacggggtttaacgttaccgggtaagttaaccggggtaggggttaaaccttaacccgggtttacgtacgtttacggttaccggtttaggggtttaacccggtttaagggggttaaaggggtttaaccggggtaaccgggttaaccgggtacccggtttaaaccccggtaacgggtaacgggtacctaaacccgggtaaacccccggg

SEQ ID NO: 285520 - DNA, 336 bp, Homo sapiens
  misc_feature: GYAE6OF02FP3VP.43.73.G07.1.454.CMB.1.raw
  modified_base (175)..(175): a, c, t, g, unknown or other
  misc_feature (175)..(175): n is a, c, g, or t
  modified_base (202)..(202): a, c, t, g, unknown or other
  misc_feature (202)..(202): n is a, c, g, or t
  modified_base (262)..(262): a, c, t, g, unknown or other
  misc_feature (262)..(262): n is a, c, g, or t
  modified_base (265)..(269): a, c, t, g, unknown or other
  misc_feature (265)..(269): n is a, c, g, or t
  modified_base (272)..(336): a, c, t, g, unknown or other
  misc_feature (272)..(336): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctccctcactacgggtccctctcccgagtcttgtgctgacctcacgcccacttntcgcatcgacgtccctccgtagggacnccgttacggtacaccgtactccacctgccacccgtgacgcgggctggactaggcacgtanagnnnnncgnnnnnnnnnnnnnnnnnnnnnnnnnnnnnnnnnnnnnnnnnnnnnnnnnnnnnnnnnnnnnnnnn

SEQ ID NO: 285521 - DNA, 773 bp, Homo sapiens
  misc_feature: GYAE6OF02I63IJ.43.73.G07.1.454.CMB.1.raw
  modified_base (294)..(294): a, c, t, g, unknown or other
  misc_feature (294)..(294): n is a, c, g, or t
tcagtgtgagtagtcacgaccggtgctcgatttagctctacgctcagggggagactgaagaacccagcattgcagcagctccaccatggcctgggctcctctgctcctcaccctcctcagtctcctcacacgggtccctctcccagcttgtgctgactcagccaccttctgcatcagtccctcccgtgggacgccgtcggtcacactcacctgccacctgacgcagccggactacaatagaatataaggtgacgtggtaccaacagagaccgaggggagtcgccccgtatttgngatggcgaggtcggggaccggagtggggtagtgggacgggacgtacgggaagggggagtgggcacgtcccgtagtacgttacggttacgtacgtacggttcggttacgggtcctacggacggtccgtacggtaccgtcccggtacccgtacgaaccgtaacctaccgaaaaccgtaaccgtaaccgttaaccggaaacggggtaaaggaacgggtaacgtacggtaaccgtaagggtaaccgttaaccgttaaccggttaacgggttacggggttaccggggtaaacgttaacggtttaacggtacggggtaaccggttaagggttaaccgggtaaacgttaaccgttaacggttacgttaggtttacggtttagggtttacggtttaacggggtaacgggttacggggtaaccggttaacgggttacccggtaacccggttaaccggtaaccgggtacccgtaaccggtaacccccgg

SEQ ID NO: 285522 - DNA, 418 bp, Homo sapiens
  misc_feature: GYAE6OF01A9SNB.36.30.C08.1.454.CMB.1.raw
  modified_base (411)..(418): a, c, t, g, unknown or other
  misc_feature (411)..(418): n is a, c, g, or t
tcagtacgctgtctcacgaccggtgctcgatttagtctgacgtcaaagggaaagggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccaggggaaccctggtcaccgtctcctcagcctccaccaagggcccatcggtcttccccctggcgccctgctccaggagcacctccgagagcacagcggccctggctgcctggtcaaggctactccagacagctactgagcgggctggcaaggcgcatagnnnnnnnn

SEQ ID NO: 285523 - DNA, 487 bp, Homo sapiens
  misc_feature: GYAE6OF01A1Z6N.36.30.C08.1.454.CMB.1.raw
  modified_base (358)..(358): a, c, t, g, unknown or other
  misc_feature (358)..(358): n is a, c, g, or t
  modified_base (446)..(447): a, c, t, g, unknown or other
  misc_feature (446)..(447): n is a, c, g, or t
  modified_base (450)..(450): a, c, t, g, unknown or other
  misc_feature (450)..(450): n is a, c, g, or t
  modified_base (452)..(487): a, c, t, g, unknown or other
  misc_feature (452)..(487): n is a, c, g, or t
tcagtacgctgtctcacgaccggtgctcgatttagtctgacgtcaaagggaagggcgtggtgtgggtctcacgtattacgtagtgatgggagttacaccaactaatgtggagttccgtggtacgggcccgattcacctatctcccagagacaacgccaagaacacgactgtatctgcaaatgaacagtcctgagagccgaggacacggcctggtgtattattcgtcgctaaccttttcggggattaggttcggaccgacgcgcaatgggggccaggggaacccctggtcacccgtcgtcctcagcctaccaccaagggccccatccggtcttccccctggcgcccctgctccaggacncaccgtccgagaggcacagccggccctgggctgcctggtcaaggctacgtccagacagcgtactgacgcggctggcaaggcgcatagnngantnnnnnnnnnnnnnnnnnnnnnnnnnnnnnnnnnnnn

SEQ ID NO: 285524 - DNA, 416 bp, Homo sapiens
  misc_feature: GYAE6OF01ETO5X.36.30.C08.1.454.CMB.1.raw
  modified_base (411)..(416): a, c, t, g, unknown or other
  misc_feature (411)..(416): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccaggggaaccctggtcaccgtctcctcagcctccaccaagggcccatcggtcttcccctggcgccctgctccaggagcacctcgagagcacagcggcctggctgcctggtcaaggactactccagacagcgtactgagcgggctggcaaggcgcatagnnnnnn

SEQ ID NO: 285525 - DNA, 556 bp, Homo sapiens
  misc_feature: GYAE6OF01BBNB2.36.30.C08.1.454.CMB.1.raw
  modified_base (500)..(500): a, c, t, g, unknown or other
  misc_feature (500)..(500): n is a, c, g, or t
  modified_base (503)..(503): a, c, t, g, unknown or other
  misc_feature (503)..(503): n is a, c, g, or t
  modified_base (509)..(509): a, c, t, g, unknown or other
  misc_feature (509)..(509): n is a, c, g, or t
  modified_base (512)..(514): a, c, t, g, unknown or other
  misc_feature (512)..(514): n is a, c, g, or t
  modified_base (516)..(517): a, c, t, g, unknown or other
  misc_feature (516)..(517): n is a, c, g, or t
  modified_base (521)..(521): a, c, t, g, unknown or other
  misc_feature (521)..(521): n is a, c, g, or t
  modified_base (523)..(523): a, c, t, g, unknown or other
  misc_feature (523)..(523): n is a, c, g, or t
  modified_base (526)..(527): a, c, t, g, unknown or other
  misc_feature (526)..(527): n is a, c, g, or t
  modified_base (529)..(534): a, c, t, g, unknown or other
  misc_feature (529)..(534): n is a, c, g, or t
  modified_base (536)..(540): a, c, t, g, unknown or other
  misc_feature (536)..(540): n is a, c, g, or t
  modified_base (542)..(547): a, c, t, g, unknown or other
  misc_feature (542)..(547): n is a, c, g, or t
  modified_base (549)..(550): a, c, t, g, unknown or other
  misc_feature (549)..(550): n is a, c, g, or t
  modified_base (555)..(555): a, c, t, g, unknown or other
  misc_feature (555)..(555): n is a, c, g, or t
tcagtacgctgtctcacgaccggtgctcgatttagtctgacgtcaagggaaagggctggtaggtgggtcgtcacggtattacgtagtcgatgggagtttaccacgaacttaactgttgggagtccgtggaggggccgattcaccatctccagacgaccaacgccgaagtaacgacgactgtatcttgtctaaatttgaactagtctgagagccggaggacacggctggtggggtattagttgtgcaactttcggggattagttggaccgacgccgcaactggggccaggggaaccctggtcaccgttctcctctagcctccaccaagggcccctagtccggtcgttcccccctggccggcccttcggcgtccggaggtagcaccgtccgagacgtcacagcggcctaggtctggcctaggtacaagggtacctaccgttccagtacaggacggtaactggacggaccgggcttacgggacgaaggtcgactaataacggntgngctatnagnnnanncacncncanncnnnnnncnnnnngnnnnnntnntgtgng

SEQ ID NO: 285526 - DNA, 544 bp, Homo sapiens
  misc_feature: GYAE6OF01DPIRA.36.30.C08.1.454.CMB.1.raw
  modified_base (532)..(532): a, c, t, g, unknown or other
  misc_feature (532)..(532): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggagcttggtcaggccggggggtcctgagactctcctgtgcagcctctggacttccccttcagtgactactggatgcactgggtccgccaagctccgagggaaggggctggtgtgggtctcacgtattagtagtgatgggattacacaactatgtggagtccgtggagggccgattcaccatctccagagacaacgccaagaacacgctgtatctagacaaatgaacagtctgagagccgaggacacggctgtgtattattgtgctaacgtttgggatttaggtcggaccgagcgcaagtcggggaccacggggaacccctgggtaccnccggtctacccg

SEQ ID NO: 285527 - DNA, 543 bp, Homo sapiens
  misc_feature: GYAE6OF01C0KYR.36.30.C08.1.454.CMB.1.raw
  modified_base (497)..(497): a, c, t, g, unknown or other
  misc_feature (497)..(497): n is a, c, g, or t
  modified_base (531)..(531): a, c, t, g, unknown or other
  misc_feature (531)..(531): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggaggcttggttcagccggggggtccctgagactctcctgtgcagcctctggattccccttcagtgactactggatgcactggtccgccaagctccgagggaaggggctgggtgtgggtctcacgtattagtagtgatgggagttacacaactaatgtggagtccgtggaggccgattcaccatctccagagacaacgccaagaacacgctgtatctagcaaatgaactagtctggagagccgaaggacacggctgtgtattatgtgactaacgtttggattaggttggaccgngcgcaagtggggacctagggaaccctgggtaccnccgttctacccg

SEQ ID NO: 285528 - DNA, 421 bp, Homo sapiens
  misc_feature: GYAE6OF01AB54A.36.30.C08.1.454.CMB.1.raw
  modified_base (410)..(410): a, c, t, g, unknown or other
  misc_feature (410)..(410): n is a, c, g, or t
  modified_base (415)..(421): a, c, t, g, unknown or other
  misc_feature (415)..(421): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccaggggaaccctggtcaccgtctcctcagcctccaccaagggcccatcggtcttccccctggcgccctgctccaggagcacctccgagagcacagcggccctgggctgcctggtcaaggactacttccagacagcgtactgagcgggctggcaaggcgnatagnnnnnnn

SEQ ID NO: 285529 - DNA, 422 bp, Homo sapiens
  misc_feature: GYAE6OF01BBK05.36.30.C08.1.454.CMB.1.raw
  modified_base (415)..(422): a, c, t, g, unknown or other
  misc_feature (415)..(422): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccaggggaaccctggtcaccgtctcctcagcctccaccaagggcccatcggcttccccctggcgccctgcctccaggagcacctccgagagcacagcggccctgggctgcctggtcaaggctactccagacagcgtactgagcgggctggcaagggcgcatagnnnnnnnn

SEQ ID NO: 285530 - DNA, 439 bp, Homo sapiens
  misc_feature: GYAE6OF01DXFA3.36.30.C08.1.454.CMB.1.raw
  modified_base (435)..(439): a, c, t, g, unknown or other
  misc_feature (435)..(439): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaagacgcggccgtatatcactgtgcgaaattccccgggagggggcagtggctggtactgcaagggcactttgagtcctggggccagggaaccctggtcaccgtgtcctcagcctccaccaagggcccatcggtcttccccctggccgccctgcctccaggagcacctccgagagcacagcggccctgggctgctggtcaaggactactcagacagcgtactgagcgggctggcagggcgcatagnnnnn

SEQ ID NO: 285531 - DNA, 600 bp, Homo sapiens
  misc_feature: GYAE6OF01BECHU.36.30.C08.1.454.CMB.1.raw
  modified_base (418)..(418): a, c, t, g, unknown or other
  misc_feature (418)..(418): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggaggtccgggggaggcttggttcaggccggggggtcctgagactctcctgtgcagcctctggacttccccttcagtgactactggatgcacgtgggtccgccaagcctccgaggggaaggggctgggtgtgggtctcgacgtattagtagtgagtgggattacacaactaatgtgagtcggtggaggccattcaccatctacagagacaacgccaaagacacgntagtatctagacaaaatcgaaactagttcagaacgacgaccgaaggacaacggtcttaatttactacgtgacgacgaagaggaacggcgttagggggtaccgttttcgaacgttacggtcgggggaccctaaacgggggtaaccccctggggttaccccacccggttccttcccgtcaccgg

SEQ ID NO: 285532 - DNA, 605 bp, Homo sapiens
  misc_feature: GYAE6OF01BHMIN.36.30.C08.1.454.CMB.1.raw
  modified_base (444)..(444): a, c, t, g, unknown or other
  misc_feature (444)..(444): n is a, c, g, or t
  modified_base (590)..(590): a, c, t, g, unknown or other
  misc_feature (590)..(590): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggagcttggttcaggccggggggtccctgagactctcctgtgcagcctctggacttccccttcagtgactactggatgcacgtggtccgcaagctccgagggaggggctggtgtgggtctcgacgtattagtagtgagtgggattacactaactaatgtggagtccggtagggacgggcctattccaccatctaccagacgacaacgccaaagacacgctgtactctagacaaagtgaacngtctaggagacggccgaggaccacgggtctaggtagttatttagttggtacgtaccttaacggttttcgggattttacgggttcgggaacccgacggtcggacgtaaaggtcgggggaacccaacggggtaacccctgggtacccncccggttcctacccg

SEQ ID NO: 285533 - DNA, 422 bp, Homo sapiens
  misc_feature: GYAE6OF01E18E3.36.30.C08.1.454.CMB.1.raw
  modified_base (414)..(422): a, c, t, g, unknown or other
  misc_feature (414)..(422): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccaggggaaccctggtcaccgtctcctcagcctccaccaagggcccatcggtcttcccctggcgccctgctccaggagcacctccgagagcacagcggccctgggctgcctggtcaaggctacttccagacagcgtactgagcgggctggcaaggcgcatagnnnnnnnnn

SEQ ID NO: 285534 - DNA, 448 bp, Homo sapiens
  misc_feature: GYAE6OF01BYR95.36.30.C08.1.454.CMB.1.raw
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (424)..(448): a, c, t, g, unknown or other
  misc_feature (424)..(448): n is a, c, g, or t
tcagtacgctgtctcacgaccggtgctcgatttagtctgacgtcaaagggaaagggggctggtgtgggtctcacgtattagtagtgatgggagttacactaactaatgtggatccgtggaggccattcaccatctccagagacaacgccaagacacgctgttatctgcaaatgtaacagtctgagagccgaggacacggctgtgtattattgtggcaacgtttcgggattagttcggacgacgcgacaatcggggccaggggaaccctggtaccaccgtctctcagtcctccaccgaggccatccggtcttccccgtggccgccctcgcctccgagacgctaccgtcgagcgcacncgcgcctggctgccgtgacaagtcctactcgagcgntcgtacgtgacgcggctagcaggcananagcnnnnnnnnnnnnnnnnnnnnnnnnn

SEQ ID NO: 285535 - DNA, 538 bp, Homo sapiens
  misc_feature: GYAE6OF01D795L.36.30.C08.1.454.CMB.1.raw
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (500)..(504): a, c, t, g, unknown or other
  misc_feature (500)..(504): n is a, c, g, or t
  modified_base (506)..(507): a, c, t, g, unknown or other
  misc_feature (506)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(516): a, c, t, g, unknown or other
  misc_feature (515)..(516): n is a, c, g, or t
  modified_base (518)..(529): a, c, t, g, unknown or other
  misc_feature (518)..(529): n is a, c, g, or t
  modified_base (531)..(531): a, c, t, g, unknown or other
  misc_feature (531)..(531): n is a, c, g, or t
  modified_base (533)..(538): a, c, t, g, unknown or other
  misc_feature (533)..(538): n is a, c, g, or t
tcagtacgctgtctcacgaccggtgctcgattttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaacgtttcgggattagttggaccgacgcgcaagtggggccaggggaaccctggtcaccgtctcctcacgcctccacaaggcccagtcggtccttccccgtggccgcccctgcctccgacgggacgccgaccgtccggagacgccaacgacgccggacccgtgggcctcggacccgtacggtaccaaacgggtaccttaccgttaccgaagaccgacggtaccgttacgtggacggccgggctacgggaccgaaacgggccgacgaagtacgcgcancgancagnnnnncnngngncngnngnnnnnnnnnnnncncnnnnnn

SEQ ID NO: 285536 - DNA, 613 bp, Homo sapiens
  misc_feature: GYAE6OF01EFK0G.36.30.C08.1.454.CMB.1.raw
  modified_base (266)..(266): a, c, t, g, unknown or other
  misc_feature (266)..(266): n is a, c, g, or t
  modified_base (441)..(441): a, c, t, g, unknown or other
  misc_feature (441)..(441): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggaggcttggttcaggccggggggtccctgagactctcctgtgcagcctctggattccccttnagtgactactggatgcacgtgggtacgccaagctccgaggggaagggctgggtgtgggtctcacgtattagtagtgatgggtattacacaactaatgtagggagtccggtggagggccgtattcaccatctccagagaccaacgccaaagacacgctgtatctgacaaatgaacngtctgagagccgaaggcaacgggtctggtagttaattacgttggtacgaccgttaaacgttttcggggaaacttttagggttcgggaaccccgtacggtacggacgtaaacgttcggggggacccctaaagggggtaaccccctggggttacccaccccggttctaccccgg

SEQ ID NO: 285537 - DNA, 865 bp, Homo sapiens
  misc_feature: GYAE6OF01CGFH8.36.30.C08.1.454.CMB.1.raw
tcagtacgctgtctcacgaccggtgctcgatttagtctgacgtcaaagggaaaggggccccagccctgggactcccagctgtttctgcttgctgatcaggactgcacacagagaactcacatggagttgggctgagctcggttttcctgttgcctagtttaaaggcgtccagtgtagaaatgcagtctggtggaggtccgggggagtccttggttcgacgggccggggggtccctaggagactctcctggtgcaggcctcgtcggaccttccccgttcagttcgactactggatagctacgtcgggtcccacgaacgcgtaccggaaggggaacggggtctgggtcgtcggggttacctacgtaacggttagttacggtagtaggtagttcggggtaacttaaccaacgtaaaccgttaaagttcggtacggggtaacggttcccgggttacggggaaacggggtcccgttaaagtttccccggaaaccctaacgtttacccgttaacccgtaaagggtaaccgtaaacccgtaaaaccggtaacccgaaaaacggaaacccggtaaccggtacgtttaacgggttaaaccttaccgttaaacggaaaccctaaaaagtttaccggaaaactttacgggttaacccgtagggtaaacggaaccgggaacccgggaaagggtaaccctaccggggtctttaacgggttagtttaaaacgttcgtttaacggacgtaaccgtttaaacggtttcgggaacgtttaacggttaccggaaccccggtacgaccggtaccgtaaacggttccggggaacccgtaaccggggtaccccgttagggtacccgacccgttcccgttaccccgg

SEQ ID NO: 285538 - DNA, 652 bp, Homo sapiens
  misc_feature: GYAE6OF01D68ZR.36.30.C08.1.454.CMB.1.raw
  modified_base (550)..(550): a, c, t, g, unknown or other
  misc_feature (550)..(550): n is a, c, g, or t
tcagtacgctgtctcacgaccggtgctcgatttagtctgacgtcaaagggaaaggggctggtgtcggtctcacgtattagtagtgattgggagttacacaactaatgtggagtccgtggagggccgattcaccatctccagagacaacgccaagaactacgctgtatcttagcaaatgaacagtctagagagaccgaggacacggcgtggtgtattatgtgctaacgtttcggattagttcggaccgtacgcgcaagtggggccagggaccctggtccaccgtctcctcacgcctccaccaacgggccccagtccggtcctttcccccgtggccgccccgtaggccttccgagggacgcctacccgtccggagtacgtccaacgacgcgggacccgtgggccttcggacccttagggtacctaaaacgggtaccttaaccgtttcccgaaggaacccgtaaggtaccgttaacctacgggaacggtcccggggtacctacggggacccaaaggggtacccgtaacccgaaagttaaccggatacgcgtancgagagacgacgacacgacgtagagtacgacgacgtactgtactatagtagagagagagtcgtagacgcgacgacgacgtactactagtacgtcgtcgtcgg

SEQ ID NO: 285539 - DNA, 554 bp, Homo sapiens
  misc_feature: GYAE6OF01BWQQI.36.30.C08.1.454.CMB.1.raw
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
  modified_base (464)..(464): a, c, t, g, unknown or other
  misc_feature (464)..(464): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaggtgtccagtgtgaaatgcagctggtggaggtccgggggaggcttggttcgaggccggggggtcctgagactctcctgtgcagcctctggacttcccctcagtgactactggatgcacgtgggtccgcaagctccgagggagggctgggtgtgggtctcgacgtattagtagtgagtgggattacacaatatgtggagtcggtggacggcgattcactatctcgagagacaacgccaaagaacacgctagtatctgacaagtgaacngtcngagacgcgagacacggntgtgttattntgtcgactagtttcggatttaggtcggaccgagcggtacaaggtcggggacctaacggggtaccccgttggtccctccggttcctacccg

SEQ ID NO: 285540 - DNA, 482 bp, Homo sapiens
  misc_feature: GYAE6OF01BKQN9.36.30.C08.1.454.CMB.1.raw
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (448)..(482): a, c, t, g, unknown or other
  misc_feature (448)..(482): n is a, c, g, or t
tcagtacgctgtctcacgaccggtgctcgatttagtctgacgtcaaagggaaagggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattatgtgcaacttttcgggattagttggaccgagcgcaatggggccagggaaccctgtcaccgtctcctcagcctccaccaacgggcccatccggtcttccccctggccgccctgcctccaggcncacctcgagagcacngcggcctggctgcctggcaaggtacctactccagacagccgtagcgacggtcgggcctagggaccgaagggcccgacgtaaagtacgggangtgcgngngnnnnnnnnnnnnnnnnnnnnnnnnnnnnnnnnnnn

SEQ ID NO: 285541 - DNA, 515 bp, Homo sapiens
  misc_feature: GYAE6OF01CV7CW.36.30.C08.1.454.CMB.1.raw
  modified_base (489)..(515): a, c, t, g, unknown or other
  misc_feature (489)..(515): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtgggagggccgattcaccatctccagagacaacgccaagaacacgctgtatctgcaaatgaacagtctgagagccgaggacacggctgtgtattattgtgctaacgttttcgggatttaggttggacccgacgcgacaagtcgggggccaaggggacccctggtccacccggtctccctcacgcctccaaccgaacggggcccccagtccggttccccttcccccgtggccgcccttgcctccagggcgaccaccctcggagacgcaccgaggccggcccgtgggcctcggcccgtacgggtacaacgggacctaccttccagaccacggtcgtacgtggacggcgggctcgggacgaagggcgactaagtagnnnnnnnnnnnnnnnnnnnnnnnnnnn

SEQ ID NO: 285542 - DNA, 583 bp, Homo sapiens
  misc_feature: GYAE6OF01A39V5.36.30.C08.1.454.CMB.1.raw
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
  modified_base (528)..(528): a, c, t, g, unknown or other
  misc_feature (528)..(528): n is a, c, g, or t
  modified_base (568)..(568): a, c, t, g, unknown or other
  misc_feature (568)..(568): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggaggtccgggggaggcttggttcgaggccggggggtccctgagacctctcctgtgcagcctctggacttcccccttcagtgactactggatgcacgtgggtccgccaagcctccgaggggagggctggtgtgggtctcacgtattagtagtgatgggagttacacaactaatggtaggagtccgtgggacgggcctattcaccatcctacagagacaaccgcaaagaaccacgctgtatctagacctaatcgaacngtctgagacgccgaggacacgggtctgtgtatttnttgtgtactaacgtttcggattacggttggacccgaggccganaacggttcggggaccctaacggggaccccttgggtacccncccgggtctaccccg

SEQ ID NO: 285543 - DNA, 423 bp, Homo sapiens
  misc_feature: GYAE6OF01CGCBE.36.30.C08.1.454.CMB.1.raw
  modified_base (417)..(423): a, c, t, g, unknown or other
  misc_feature (417)..(423): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaacttttcgggattagttggaccgacgcgcaatggggccaggggaaccctggtcaccggtctcctcagcctccaccaagggcccatcggtcttccccctggcgccctgctccaggagcacctccgagagcacagcggccctggctgcctggtcaaggactacttccagacagcgtactgagcgggctggcaaggcgcatagnnnnnnn

SEQ ID NO: 285544 - DNA, 452 bp, Homo sapiens
  misc_feature: GYAE6OF01A43FW.36.30.C08.1.454.CMB.1.raw
  modified_base (423)..(423): a, c, t, g, unknown or other
  misc_feature (423)..(423): n is a, c, g, or t
  modified_base (428)..(428): a, c, t, g, unknown or other
  misc_feature (428)..(428): n is a, c, g, or t
  modified_base (431)..(452): a, c, t, g, unknown or other
  misc_feature (431)..(452): n is a, c, g, or t
tcagtacgctgtctcacgaccggtgctcgatttagtctgacgtcaaagggaaaggggctggtgtgggtctccacgtattagtagtgatgggagtttacacaactaatgtggagtccgtggagggccgattcaccatctccagagacaacgccaagaacacgctgtatctgacaaatgaacagtctgagagccgaggacacggctgtgtattattgtgcaacgtttcgggattagttggacccgacgcgcaagtggggccagggaaccctggtcaccgtctcctcagcctccaccaagggcccatcggtcttccccctggccgccctgctccagtagccacctccgagagcacagccggcctgggctgccctggtcaaaggtactacgttccagacagcgtactgagcgggctggcaaggccgnatagnacnnnnnnnnnnnnnnnnnnnnnn

SEQ ID NO: 285545 - DNA, 870 bp, Homo sapiens
  misc_feature: GYAE6OF01CQDLP.36.30.C08.1.454.CMB.1.raw
  modified_base (851)..(851): a, c, t, g, unknown or other
  misc_feature (851)..(851): n is a, c, g, or t
tcagtacgctgtctcacgaccggtgctcgatttagtctgacgtcaaagggaaagggggccccagccctgggactcccagctgtttctgcttgctgatcaggactgcacacagagaactcacatggagtttgggctgagtctgggttttccttgttgcctattttaaaaggtgtcagtgtagaaatgcagcgtgggtgggaggtccgggggaggtcgttggtcgacgggtccggggggtcctgagacctctccgtgtcgcacgccttcgtcggtacttccccgttcaggtcgtaactacgtggacttcgccgtacgtcgggtccgaccgaacgtccgtaccggaagggggtaacggggtcgttgggttggttcggggtcctacgtaacggttaagtttaggtaaggttgtaggttaggggtaacttaacgaactaaacgttaagttcgggtacgggtacggtacccgggtaggggaccgggtaccgtaacgtttacccaaccgtacttacccgtaccggaaacggaacgaacccgaaacccgggtaacccaaaacggtaacccgtaaccggtacttaaggttaaccttaccgtaaaggtaactaaaacggtacggttaaacgtacggttaccgttacggaaacggggtaacccggtaaccgggaacggggaacccgtacgggggttactttaaggggttacgtttaaagttttcgggttacgtacggtaacgtttaaacccggttttaggggtaacgttttaacggggttacccgggaaccggtacgtaccgggacgtaaacggggttccggggaacccggtaacggggtaaccccttcggggttaaccccncccggttcctaaccccggg

SEQ ID NO: 285546 - DNA, 622 bp, Homo sapiens
  misc_feature: GYAE6OF01B3ESK.36.30.C08.1.454.CMB.1.raw
  modified_base (450)..(450): a, c, t, g, unknown or other
  misc_feature (450)..(450): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagttttgggctgagctgggttttccttgttgccattttaaaaggtgtccagtgtgaaatgcagctggtggaggtccgggggaggcttggttcaggccgggggggtcctgagactctcctgtgcagcctctggacttccccttcagtgactactggatgcacgtgggtcccgccaagctccgaggggaaggggcgtggtggtgggtctcgacgtattagtagtgagtgggattacacaactagtgtgaggtccgtggacgggccgattcgacctatctaccgagacgacaccgaccaagacacgctagtatctgacaatgaaacngtcagagagaccgaggacgacgggcttggttacgttaagtttagttcggtagtaccgttaaccgttttgggggtattttaacgggttcgggacccggtacggacggtacgaacgggttgggggaccccgtaaggggtaaccccgtgggttacccacccggttccctacccgg

SEQ ID NO: 285547 - DNA, 634 bp, Homo sapiens
  misc_feature: GYAE6OF01AEEXB.36.30.C08.1.454.CMB.1.raw
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (474)..(474): a, c, t, g, unknown or other
  misc_feature (474)..(474): n is a, c, g, or t
  modified_base (504)..(504): a, c, t, g, unknown or other
  misc_feature (504)..(504): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgcctaattttaaaaggtgtccagtgtgaaatgcagctggtggaggtccgggggaggtcttggttcgaggccggggggtcctgagactctctgtgtagcctcgtggattctacctttaacaactacgtggatggtccgtgggtccgccaggcctccgaggggaaggggctagggaagtggggtacgaccaacagtggaacgccagagtggaagtcagactatacgtagtggtgactcgtaggtaggaacggccgtattaccaccatcctacgagagacacgcgacatcactcacgtgtacncgtanacaaagtcaaacgngcctagagacgaaccgtaagccgtacggtntttagtttaatacgtcggtgaggtacggaggtacgggtctttaagtttggggaggttttaacggttattacccggtacccgttttagggaacccgtttcggggtaaccgggggtccccgtaaaccggggg

SEQ ID NO: 285548 - DNA, 453 bp, Homo sapiens
  misc_feature: GYAE6OF01DE5NT.36.30.C08.1.454.CMB.1.raw
  modified_base (187)..(187): a, c, t, g, unknown or other
  misc_feature (187)..(187): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (440)..(440): a, c, t, g, unknown or other
  misc_feature (440)..(440): n is a, c, g, or t
  modified_base (442)..(453): a, c, t, g, unknown or other
  misc_feature (442)..(453): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccattcaccatctccagagacaacgccaaagaacacgctgtatctgcaaaatgaacagtctgagngccgaggacacggctgtntattatgtnctaactttcgggatttagttggaccgacgcgacaagtggggccaacggggacccctggtaccaccgtctccctcacgcctccaaccaaggggccccaatccggtccttccccctggccgccctagctccgaggacgcacctccgaagagcaacagccggcctgggctcgctggtcaaaggctacttcccagacagctactgagcgggntcggnaaggcgcagtagnannnnnnnnnnnn

SEQ ID NO: 285549 - DNA, 583 bp, Homo sapiens
  misc_feature: GYAE6OF01DL84S.36.30.C08.1.454.CMB.1.raw
  modified_base (444)..(444): a, c, t, g, unknown or other
  misc_feature (444)..(444): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagttgggctgagctgggttttccttgttgcctattttaaaaggtgtccagtgtgaaatgcagctgggtggaggtccgggggaggtcgttgggttcgaggcccgggggggtccctggacgactctcctgtgcagcctcgtggacttcaccttcagtagctatagcatgaactgggtccgcaggctccgaggggaaggggctgggagtgggtctcatccattagtagtagtagtagttacatatactacgcagactcagtgaacgggcctatcaccatctcagagacaacgccaaagactcactagtactctagacaaangaacacgcctagacgaaggccgaaggaccgacggcttggttagtacttacgtggtggaccgggatcggacgttatttagttttcgtacgtttgggtttaacttcccgttaacttaccgttaacttcgtaacgttaacgg

SEQ ID NO: 285550 - DNA, 813 bp, Homo sapiens
  misc_feature: GYAE6OF01B2AL8.36.30.C08.1.454.CMB.1.raw
tcagtacgctgtctcacgaccggtgctcgatttagtctgacgtcaaagggaaaggggccccagccctgggactcccagctgtttctgcttgctgatcaggactgcacacagagaactcaccatgggagtttgggctggagtcgttgggttttccttgttgacctaagttttaaaaggtgtccagtgtagaaatgcagcgtgggtggagggtccgggggaggtcgtttgggttcgacggggtccggggggtccctggacgtaccttccgtcctggtcgccgacgtcccttcgtcggtacctttccccgttagagttcgacttacgtggtatcgaccgtacggttcggggtcccgaccgtaacggccgtaccgggaagggggaaggggtccgttggggttcggttcgggtctacgtaacgtttagttaggtaggtggtaggttagggtaattaaccgaagtaaacgttaaggtggtagggtacggttccgggtagggacgggtacccgtagttacccgacgtacgtaccgtaaccgaagtaaccgaaccgaaccgaaccgaaagaacccgtacgtcgttacgtaactacgtaacgaactaaacgtacgaaagttacgtacgagggaagacccggaacggaacgggacctaacgggttcgtaagggtttacgttaagttttacgtcggtaccgtaacggttttaaccgggtttcggtaagttttaccgggaccggaacccggtacgacggttacggaaccgggtcggggaaccccgtaacgggacccgtttcgggccccttacccgggtcctcccg

SEQ ID NO: 285551 - DNA, 683 bp, Homo sapiens
  misc_feature: GYAE6OF01DCZRB.36.30.C08.1.454.CMB.1.raw
  modified_base (226)..(226): a, c, t, g, unknown or other
  misc_feature (226)..(226): n is a, c, g, or t
  modified_base (306)..(306): a, c, t, g, unknown or other
  misc_feature (306)..(306): n is a, c, g, or t
  modified_base (356)..(356): a, c, t, g, unknown or other
  misc_feature (356)..(356): n is a, c, g, or t
tcagtacgctgtctcacgaccggtgctcgatttagtctgacgtcaaagggaaaggggccccagccctgggactcccagctgtttctgcttgctgatcaggactgcacacagagaactcaccatggtagtttgggctgagtcgttgggtttttcttgtggtacttaagttttaaaggtgtccagtgtgaagtgctagttgtggattcgtggggagtcgttggtacgngggccgggggtcctgagactctcgtgtgcagcttgaggtattcagtcttagcacgctacgccagtcgagtcgtggtcccncgaggccgtacggagggaacggcgtggaggtcggtctcgtaggtgttggngacgaggtggtagacgaccatactacgtacgacaagtaccgtcggtacggaacgggtcccgttacacctagtccgtaccgaagaacgaacctaactacccgaaacaccctaccgtgtacctacgtacgaactaaataccgaaaccgtaacgtacggaacgtacgaccggtaacggaacccacggtacccttaagttaacgtaaccgtaacggtaaacgaaacgtcggtaaccgtaaccgtaagttaacgtcgttaaactacggttaggttaccgggtacgttacggttaacccgttacgatttacccggtcgggtccgggggttacc

SEQ ID NO: 285552 - DNA, 435 bp, Homo sapiens
  misc_feature: GYAE6OF01ERUUI.36.30.C08.1.454.CMB.1.raw
  modified_base (336)..(336): a, c, t, g, unknown or other
  misc_feature (336)..(336): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
  modified_base (428)..(429): a, c, t, g, unknown or other
  misc_feature (428)..(429): n is a, c, g, or t
  modified_base (431)..(435): a, c, t, g, unknown or other
  misc_feature (431)..(435): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaaagaacacgctgtatctgcaaaatgaacagtctgagagccgaggacacggctgtgtattattgtgcaacttttcgggattaggttggaccgacgcgcaagtggggccagggaaccctggtcaccgtctcctcagcctccaccaagggcccatccggtcttccccctggccgccctgcctccaggngccacctccgagagcacgagccggccctggctgccgtggtcaaggactacttccagacagcgtaacngagcgggntcggcaaggcgcatagnngnnnnn

SEQ ID NO: 285553 - DNA, 724 bp, Homo sapiens
  misc_feature: GYAE6OF01DNZKW.36.30.C08.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
  modified_base (520)..(520): a, c, t, g, unknown or other
  misc_feature (520)..(520): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagcgttggttttccttgttgcctatttaaaggtgtcgagtgtagaaatgcgagtcgtgggtgggtagggtccgggggaggtcgtttgggttccggacggggtcccggggggtccctggacgtacgttcctccgtggtcgacncgtcctcgtacggtccttcccttnagtcgtactacgtggattgactcggtcggacccgaccgaacgccgtacggagggacgggtcgtgggtggtcggtctacgtacgttagttgtagtgtaggtggtacttaacgaagtaacgtagtaggtggtacggtcggtagggacggtaccgtagtaccaccgtacgtctacgacgtacgaacgaccgtacgaaagaccacgtcttacgtactacgntaaaccgtaagacgtaacgatacgaggaacgacggacggtaacgagacggttctagggtttatacgtttgttaccggtagtaaccgtttaacgggttcggttaaaggtttacggtaccgggaaccgtccggaaggtccggaaacgggccggggtaaccccgtaccgggtaacccggttgacccccgtgtccccggttaaccccg

SEQ ID NO: 285554 - DNA, 730 bp, Homo sapiens
  misc_feature: GYAE6OF01ADU46.36.30.C08.1.454.CMB.1.raw
  modified_base (169)..(169): a, c, t, g, unknown or other
  misc_feature (169)..(169): n is a, c, g, or t
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaggngtccagtgtgaaatgcagctggtggaggtccgggggagcgttggttcgagggccggggggtccctggacgactctcctgtgcacgcctctggtacttccccttnagtgactactggatgcacgtgggccncaagcgtccgaggggagggcgtggngtggtctcgtagttagtagtagtgtagtgggtagttacaacgtaacgtaagtggtgggtaacggttccggtaggggacgggtaccgtaatttccgaaccctacgtcctacccgaaaggaaccgaaacctaaccggaccaaaacggaacctacccggtcttaggtaactttccgaaggtaacctaaaagttcggaaaacttacggtacgtaggaacggtacggacccggtaaacggggcccgtaacggggtctttagggtacgtttaagttttacggttggtacggtaacctttaaacgggtttcggggtaaacttttaggggtacccggaccgtacggtccgagttaaccggggtcggggacccgtaacggggtaccccttagggtaccccaccggttcctacccg

SEQ ID NO: 285555 - DNA, 563 bp, Homo sapiens
  misc_feature: GYAE6OF01COE1X.36.30.C08.1.454.CMB.1.raw
  modified_base (214)..(214): a, c, t, g, unknown or other
  misc_feature (214)..(214): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (521)..(522): a, c, t, g, unknown or other
  misc_feature (521)..(522): n is a, c, g, or t
  modified_base (524)..(527): a, c, t, g, unknown or other
  misc_feature (524)..(527): n is a, c, g, or t
  modified_base (529)..(530): a, c, t, g, unknown or other
  misc_feature (529)..(530): n is a, c, g, or t
  modified_base (532)..(532): a, c, t, g, unknown or other
  misc_feature (532)..(532): n is a, c, g, or t
  modified_base (534)..(536): a, c, t, g, unknown or other
  misc_feature (534)..(536): n is a, c, g, or t
  modified_base (538)..(563): a, c, t, g, unknown or other
  misc_feature (538)..(563): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaaggccaagaacacgctgtatctgacaaatgaacagtctgagagccgaggacacggctgtgtattattgngctaacgttttcgggatttaggttggaccgaccgcgcaaagtcgggggaccacggggtaacccctggtccacccgtcctcctcagccctccaccgaacgggcccatccggtccttccccccgtggccgccctggcctccgaggacgcctaccgccgagacgccaacgacggcccggtccgtcgggcctcgtcccgtacggtacaaacggtaccttaccgttacccgagaccgtaacggacgttaccgacgggacggaccggggtcgttacgggaccgaaagggcccgtaccgtaaggtacggngngnngnnnngnngncnnngnnnnnnnnnnnnnnnnnnnnnnnnnn

SEQ ID NO: 285556 - DNA, 717 bp, Homo sapiens
  misc_feature: GYAE6OF01A6HLR.36.30.C08.1.454.CMB.1.raw
  modified_base (272)..(272): a, c, t, g, unknown or other
  misc_feature (272)..(272): n is a, c, g, or t
  modified_base (527)..(527): a, c, t, g, unknown or other
  misc_feature (527)..(527): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgcctattttaaaaggtgtccagtgtgaaatgcagctgggtggaggtccgggggaggcttggttcgaggccggggggtccctgagactctcctgtgcagcctcgtggacttccccttnagtgactacgtggatgctacgtcgggtcccgaccaaggcctaccgagggggaacgggggctgggtggtgggtctcgacgtattagtagtgagtgggtattacactaactaagtggtaggagttccgagggacggccgtattccacctatcctacgagacgaacaaccgccgaaagaccgacgcttagtaatcctagaacctaaatcggaaacagttcgtaggaacgacggtaccgggaaggaccgtaaccgggtntttacggggtttagtttaacttttaggttacggtacgttacgtaaaccgggtttttcgggaaagtttttaacggggtacgggtacccggtaacggtacccggtacggtaacgggttacccgggggggacccctaaaccggggggttaaccccgttaccggggttaccctaccccggttcctaacccccgg

SEQ ID NO: 285557 - DNA, 672 bp, Homo sapiens
  misc_feature: GYAE6OF01CYWZL.36.30.C08.1.454.CMB.1.raw
  modified_base (250)..(250): a, c, t, g, unknown or other
  misc_feature (250)..(250): n is a, c, g, or t
  modified_base (383)..(383): a, c, t, g, unknown or other
  misc_feature (383)..(383): n is a, c, g, or t
  modified_base (454)..(454): a, c, t, g, unknown or other
  misc_feature (454)..(454): n is a, c, g, or t
  modified_base (642)..(642): a, c, t, g, unknown or other
  misc_feature (642)..(642): n is a, c, g, or t
  modified_base (654)..(654): a, c, t, g, unknown or other
  misc_feature (654)..(654): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctggttttccttgtgcctagtttaaaaggtgtcagtgtgaaatgcagctggtggaggtccggggagcgttggtcgacggccgggggtcctgagctctactgtcgcagcctntggtacttcccctgagtcgactacgtgatcgctacgtcggtcccgacaacgcctacggaggggacgggtctggtcgtcggtctcgagttatacgtagtcgagtggattacactaactagtgtaggacgtcggnggacggtccgattccgactagtccacgaagacgaacgaacgaccaaacggaaccacgtcgttaggttaacncgttaacactaaaagtcggaaactcgtacgacggaagacgaccgggagtaaccgacgggttattgggttacttaagtttcgtgtacgttaacccgttaaagggttttcgggaaaatttcgggaaccgggacccgtaggacccggttacgaaacgggttccgggggaacctacccgggggttaaacccngggtttaacccnccccggtttcgtaccccg

SEQ ID NO: 285558 - DNA, 892 bp, Homo sapiens
  misc_feature: GYAE6OF01BQ24W.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgcctattttaaaaggtgtccagtgtgaaatgcagcgtggtggaggtccgggggagtcgtttggttcgagggcccggggggtccctggacgtactcctccgtgtcgcacgtcctcgtcggtactttccccttgagtcgaccgtacgtgggatcgcctacgtcgggtcccgaccgaacgtccgtaccggaaggggaacggggtcgtgggttggtcgggtctacgtacgttagttagtaggtgtagtaggtacttaacgactaaacgttaagtggtacgggtacggttccggtagggacgggtacccgtatttacccgaaccgtacgttcccgtaaccgaaggaaccgtaacccgtaaaccggacccgtaaaacggtaacccgaacggttcgttaacggtaaaccttccggtaaacggtaaaccgtaaaacgttacggtaaaaccgtagggttaccccgttaagggaacggtaaccgggtaccccggtaaaggggaacccgtaccggggttaccgttagggtttaacgtttaagttttaacggttccgggttaacgtaaacccgtttaacgggtttttacggggtaacgttttaaccggggttaaccgggtaacccgggtaacccggtaccggtaaccggttaaaccgggggttaccccgggggaacccggttaaaccccgggggttacccccggtttaggggttacccccctaaccccgggtttccccgtaacccccgg

SEQ ID NO: 285559 - DNA, 553 bp, Homo sapiens
  misc_feature: GYAE6OF01B50HD.36.30.C08.1.454.CMB.1.raw
  modified_base (205)..(205): a, c, t, g, unknown or other
  misc_feature (205)..(205): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (483)..(483): a, c, t, g, unknown or other
  misc_feature (483)..(483): n is a, c, g, or t
  modified_base (496)..(496): a, c, t, g, unknown or other
  misc_feature (496)..(496): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(553): a, c, t, g, unknown or other
  misc_feature (524)..(553): n is a, c, g, or t
tcagtacgctgtctcacgaccggtgctcgatttagtctgacgtcaaagggaaaggggctggtgtgggtctcacgtattagtagtgatgggattacacaactaatgtggagtccggtgggagggcccgattcaccatctcagagacaacgccaagaacacgctgtatctgacaaatgaacagtctggagagccggaggacacggtntgtnttattattgnctaacgttttgggatttaggtcggaccgacgcgacaaggtcggggaccgacggggaacccttggtaccaccgttctccgtcacgccctaccaccgaacgggccccacgttccggtccctttcccccgtcgggccgtccccttacgcctccggaaggaccggccctacccgtccggaaggacgccgtaaccgacggcccgggcccgtcgggcctcggtcccgtggtacgaacggtacctacttaccgaacgacacggtcgttacncgggagccgggcngggacgacggcacagtcgngnangangnnnnnnnnnnnnnnnnnnnnnnnnnnnnnn

SEQ ID NO: 285560 - DNA, 805 bp, Homo sapiens
  misc_feature: GYAE6OF01CGSTA.36.30.C08.1.454.CMB.1.raw
  modified_base (571)..(571): a, c, t, g, unknown or other
  misc_feature (571)..(571): n is a, c, g, or t
tcagtacgctgtctcacgaccggtgctcgatttagtctgacgtcaaagggaaagggggccccagccctgggactcccagctgtttctgattgctgatcaggactgcacacagagaactcaccatggtagtttgggctgagtcttgggttttccttgttgaccttaagtttttaaaaggtcgtccagtgtagaaatgcagcgtgggtggagggtccgggggaggtcgttgggttcgacggggtcccggggggtccctggacgtacctccgtccgtgtcgccgacgtccttcgtcggtacctttccccgttacgtagttacgtaccgttacgtgggtactcgtaccgtacggtccgggtacccgaccgaacggccgtaccgggaagggggtacgggtcgttgggtcggttcgggtcctacgtaagttagttaggtagtaggtagtagggtaactaacagtaacgtagtggtaggtacggttccggagggacggtacctacgtaccactacgtcgaaccgtagaacgtaaccgaaccgacgaaacgtaaccgtacgtctaggttaactacgaanaaaccgtaagacggtaaactcgttacgacggtaagaccggaaccgggtacgaaccggtacggttacgtaggtttagttaaacgtttcgttacgggttactaaccggtttaacgggttttacggtaagtttaacccgggtaccggggaacccacggtacggtaaccggtaacggggtacccggggtacccgtaaaccggtacccccggttggtaaccccctaccgttccctcccg

SEQ ID NO: 285561 - DNA, 534 bp, Homo sapiens
  misc_feature: GYAE6OF01D6UMU.36.30.C08.1.454.CMB.1.raw
  modified_base (132)..(132): a, c, t, g, unknown or other
  misc_feature (132)..(132): n is a, c, g, or t
  modified_base (195)..(195): a, c, t, g, unknown or other
  misc_feature (195)..(195): n is a, c, g, or t
  modified_base (404)..(404): a, c, t, g, unknown or other
  misc_feature (404)..(404): n is a, c, g, or t
  modified_base (493)..(493): a, c, t, g, unknown or other
  misc_feature (493)..(493): n is a, c, g, or t
  modified_base (497)..(534): a, c, t, g, unknown or other
  misc_feature (497)..(534): n is a, c, g, or t
tcagtacgctgtctcacgaccggtgctcgatttagtctgacgtcaaagggaaaggggctggtgtggtctcacgtattagtagtgatgggattacacaactaatgtggagtccgtggaggccattcaccatcncagagacaacgccaaagacacgctgtatcagacaaatgaacagtctagagagccgagacacgntgtattattatgtgactaacgtttgggaatttagtgaacccgagccgataaaggtcggggaccaacggaacccttggtcgaacccgtctcctacacgaccctcccaaccgaacgggcccctaagtcccgtcctttcccccgtggccgtccccttggccaccaacgggagaccacccgtaccgagacgctaaccgagccggtccgtcggntcggtcctggtaaccaacggtacctaaccttcgaaggacacgtacgtctaggaaccgtgggactgaccgtaaggccgtaagactaagcngacnnnnnnnnnnnnnnnnnnnnnnnnnnnnnnnnnnnnnn

SEQ ID NO: 285562 - DNA, 520 bp, Homo sapiens
  misc_feature: GYAE6OF01DDBWY.36.30.C08.1.454.CMB.1.raw
  modified_base (369)..(369): a, c, t, g, unknown or other
  misc_feature (369)..(369): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (493)..(520): a, c, t, g, unknown or other
  misc_feature (493)..(520): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccgattcacatctccagagacaacgccaagaacacgctgtatctgcaaaatgaacagtctgagagccgaggacacggctgtgtattattgtgactaacgtttcgggatttacggtcggacccgacgcgacaaagtgggggaccaggggacccctggtccaccggtctcccgtacacgcccctccaaccgaacgggccccctagtcccggtccctttcccccgtggcccgcccctggcctccgaggacncctacccgtaccggagacgccaacgcggccgcccgtggcctcgccgtggtaaccaaggtactaccgtaccagacgcgtaccgtacgtggacggtcgggctcgggaacgacggcgagaangcngnnnnnnnnnnnnnnnnnnnnnnnnnnnn

SEQ ID NO: 285563 - DNA, 746 bp, Homo sapiens
  misc_feature: GYAE6OF01ENKES.36.30.C08.1.454.CMB.1.raw
  modified_base (550)..(550): a, c, t, g, unknown or other
  misc_feature (550)..(550): n is a, c, g, or t
  modified_base (622)..(622): a, c, t, g, unknown or other
  misc_feature (622)..(622): n is a, c, g, or t
  modified_base (641)..(641): a, c, t, g, unknown or other
  misc_feature (641)..(641): n is a, c, g, or t
tcagtacgctgtctcacgaccggtgctcgatttagtctgacgtcaaagggaaaggggccccacgccctgggactcccagctgtttctgcttgctgatcaggactgcacacagagaactcaccatggagttcggctgagcttgggttttccttgttgacctagttttaaaaggtcgtaccagtgtacgaaatgactagtcgtgggtgggtacggtccgggggtaggtccgtttgggttccgacggggtcccggggggttccctggacggtactccttccgtagtcgactacgtccttcgtcggtaccttccccgttacgacgttcgtaacctacgtggtaatcggtaccgtacggttccggtacccgaccgtaacgtccgttacccgggtaagggggtaacgggtcgttagggtggtcgggtctacgtaacgttacgttagtacgtagtaggtaggtaactacgaactaagtaacgtcggtagtacggtcgtagggacggtaccgtagtcacctagtaccaccgagaaccgtacaaccgtaccaaagaccncgtattactactcgtagaacctaagtacgaacctgtaccgtaggaagtccggacggaggacccgtaacggtntggtaactttgttacgttntaccgtacgttaggttagggtaacttcggtacggaccccgtggaccgtacggtagggccggtaaacccgtacggaccccgtaggtaccccttccgcttaccccgg

SEQ ID NO: 285564 - DNA, 553 bp, Homo sapiens
  misc_feature: GYAE6OF01C1IDL.36.30.C08.1.454.CMB.1.raw
  modified_base (168)..(168): a, c, t, g, unknown or other
  misc_feature (168)..(168): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
  modified_base (480)..(480): a, c, t, g, unknown or other
  misc_feature (480)..(480): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (518)..(519): a, c, t, g, unknown or other
  misc_feature (518)..(519): n is a, c, g, or t
  modified_base (521)..(521): a, c, t, g, unknown or other
  misc_feature (521)..(521): n is a, c, g, or t
  modified_base (524)..(553): a, c, t, g, unknown or other
  misc_feature (524)..(553): n is a, c, g, or t
tcagtacgctgtctcacgaccggtgctcgatttagtctgacgtcaaagggaaaggggctggtgtgggtctcacgttattagtagtgagtgggacttacaacaactaatgtggagtccgtggaggccattcacatctacagagacaacgccaagaacacgtctgtatcngacaaaatgaacagtctaggacgacgacccggaaggtaccacgggtcttggtacgttaattgttggcgtacctaacgtttgggtatttagggtcggaaccgacgcgataaggtcggggaccaacggggtacccctggtcctacccgttctcccgttacagtccctaccgacgaacgggccctagtccgtcccttcccccgtagggcctcccgttcgaccgtccgaggacgtaccaccgtaccgagacgcctaacgcgtcggacccgtggctaggccctaggtacacggtactctacganaccngaccgttanggacggcggtcaggaccgaggccagtactagnancgannancgnnnnnnnnnnnnnnnnnnnnnnnnnnnnnn

SEQ ID NO: 285565 - DNA, 770 bp, Homo sapiens
  misc_feature: GYAE6OF01DIRAH.36.30.C08.1.454.CMB.1.raw
  modified_base (173)..(173): a, c, t, g, unknown or other
  misc_feature (173)..(173): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
tcagtacgctgtctcacgaccggtgctcgatttagtctgacgtcaaagggaaaggggccccagccctgggactcccagctgtttctgcttgctgatcaggactgcacacagagaactcacatggagtttggctgagtcttgggttttccttgtgtacctaagttttaaaaggngtcagtgtagaaatgcagcgtgggtggacggtcggggagtcgttggtcgacgggccggggtcnggagactcgtcngtcncgacgtcctgtcggtaccttccccgttagagtacgtactacgtaggatcgacgtacggtcggtccgacaacgcgcggagggaggtgtggtgtggtctacgagttagtacggtagtagtaggtaggtaagttaacaaccgtaagtagtagacgggtacggtcgggtagggtacggtaccactacccgacgtacgtacctacgaacgtaacgaaccgtaaccggaaccctaaacggaaaccgtaccgtacgtacttacggtacgttaacgaaacgtaaacgtggtaaaacgttaccgtacggtaacggaacggtaccggaccgggtaacggtaccggaacggtttacgttagggttagtttaagttccgttaggtacggttaacggtttaaccgggttaggttacggtttaaccgtaccgggtaaacccgtacggtaacggtaccgggtaaacgggtaccgggaaccccgggttaccggtaacccggttaccgtacccgtaaccccgttccgtaaccccg

SEQ ID NO: 285566 - DNA, 594 bp, Homo sapiens
  misc_feature: GYAE6OF01CLUWE.36.30.C08.1.454.CMB.1.raw
  modified_base (245)..(245): a, c, t, g, unknown or other
  misc_feature (245)..(245): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (518)..(518): a, c, t, g, unknown or other
  misc_feature (518)..(518): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
  modified_base (570)..(570): a, c, t, g, unknown or other
  misc_feature (570)..(570): n is a, c, g, or t
  modified_base (584)..(584): a, c, t, g, unknown or other
  misc_feature (584)..(584): n is a, c, g, or t
  modified_base (586)..(586): a, c, t, g, unknown or other
  misc_feature (586)..(586): n is a, c, g, or t
  modified_base (588)..(588): a, c, t, g, unknown or other
  misc_feature (588)..(588): n is a, c, g, or t
tcagtacgctgtctcacgaccggtgctcgatttagtctgacgtcaaagggaaagggctggtgtgggtctcacgtattagtagtgatgggagttacacaactaatgtggagtccgtggaggccgattcaccatctccagagacaacgccaagaacacgctgtatctgacaaatgaacagtctgagacgccgaggaccacggctgtgttattagttgtgctaacgtttggatttaggtcggaccgcncgcaagtcgggccacggacccgtggtccacccgtctcctcacgcctacccaccgacggccccacgttcggtccccttccccgcggcccgtccctacgtcctcccgacggacgacccgacccgtacgacggacgccaccgacggccggccgtcggcctccggcgtcggtaccgaacggtaccctacttacccgagtacacggccgtacgtaggacgggccgggtacgtaggaccggaacgggcggtaaccctaaggtcgngacngtcntagacncncncgacgtcgtgactgactagacgacgcgccgagcncgcgcncgcanagngcgacgcgtcgacncncncgcgcg

SEQ ID NO: 285567 - DNA, 585 bp, Homo sapiens
  misc_feature: GYAE6OF01DFULZ.36.30.C08.1.454.CMB.1.raw
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (365)..(365): a, c, t, g, unknown or other
  misc_feature (365)..(365): n is a, c, g, or t
  modified_base (387)..(387): a, c, t, g, unknown or other
  misc_feature (387)..(387): n is a, c, g, or t
  modified_base (540)..(540): a, c, t, g, unknown or other
  misc_feature (540)..(540): n is a, c, g, or t
  modified_base (548)..(548): a, c, t, g, unknown or other
  misc_feature (548)..(548): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (558)..(558): a, c, t, g, unknown or other
  misc_feature (558)..(558): n is a, c, g, or t
  modified_base (560)..(561): a, c, t, g, unknown or other
  misc_feature (560)..(561): n is a, c, g, or t
  modified_base (563)..(585): a, c, t, g, unknown or other
  misc_feature (563)..(585): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccattcaccatctcagagacaacgccaagacagctgtatctgcaaatgaacagcctgagagaccgaagacacggcttgttttattactggtcgacggagaggtagggcttacgtttttggagttggttatcgtccctttgactcgtggggccaacgggacctggtcctccgtctcctctntcctaccaccgacggcccctagttccccgtccttcccccnggccgtccctcgtcctccgaggcnccacccgtccgaagcgacaccncggccccgtccggtcgggtctcgtccgtacgggtaccgaaacggtcctttaacttccggaagtaaacccgtcgggtaaccgtttcggacgggtaacggtcccggggggtactaaccggggacgtaaccggggccggtaaaccgtagttaacgnacgcacgntcncnnacgnanngnnnnnnnnnnnnnnnnnnnnnnn

SEQ ID NO: 285568 - DNA, 821 bp, Homo sapiens
  misc_feature: GYAE6OF01CR8PL.36.30.C08.1.454.CMB.1.raw
  modified_base (258)..(258): a, c, t, g, unknown or other
  misc_feature (258)..(258): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgcctaagttttaaaaggtgtccagtgtgaaatgcagcgtgggtggaggtccgggggaggtcgttgggttccgagggcccggggggtcctgagtcctctcctgngcgagtcctcgtaggtcttcccttcagtcgtactacgtggtatcgaccgtacgtcggggtacccgacccgtaacggcccgtaccggaaggggtaaggggggtccttgggggttcggttacgggggttccttaccggtaacggtttaatttagggttaaggtggttaaggttaggggtaaactttaaccgaaacgtaaacgttaagttgggtacgggtacggtccgggttagggaccgggtaccgtacgttaccaccgtacttcgaccgaacgaacgaccgaaacgacccaaaggtaaccacgtaccgtacgttagtacgtacgtaactaaagtacgtaacgtacgtcgagtaacggacgtaccggaaggtaaccgtacggggacgttaggttggttaactttaggtttcggtacgttaaccgttaacggttttacgggtacggttttacgggttaccgggtaaacccgggtacggacccgggttaacgtaacggggttccgggaccccgggtaaacccggggaccccgttacggggtaacccctcccgggtcccttaccccgg

SEQ ID NO: 285569 - DNA, 727 bp, Homo sapiens
  misc_feature: GYAE6OF01BV09D.36.30.C08.1.454.CMB.1.raw
  modified_base (717)..(717): a, c, t, g, unknown or other
  misc_feature (717)..(717): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagcgttgggttttccttgttgcctaattttaaaaggtgtccagtgtagaaatgcagcgtgggtgggacgggtccgggggatggtcgtttggttcgacggggcccggggggttccctggacgaccttcctccgtgtcgcacgtcctcgtcgtaccttccctcgtagtcactacgtggatcgacacgtcggccgtaccgacgcctcggagggggacgggtcgtggtggtcggtcgtcgtagttattagttaggtagtaggtacgggtacttaacgacgttaacgtaagttcggtaggtaccgtcgggtacgggtacggtaccgtacttacccacctacgtacctaccgtacgaacgaacccgtaacccggaacaaaccggaaccgaccgttacgttacgtactaccgtaaggaactaaagtaaccggaacttacggttccgaggaacggtacggaaccggacggtcgaacgttcgttagttagttacttgacggtacgtaccggttagtttaggtaacgtttcgggaccgacccgagtcgacggtccgggacggaccggtaacccggtcctcggttaccccncccgttaccg

SEQ ID NO: 285570 - DNA, 662 bp, Homo sapiens
  misc_feature: GYAE6OF01DU4TC.36.30.C08.1.454.CMB.1.raw
  modified_base (391)..(391): a, c, t, g, unknown or other
  misc_feature (391)..(391): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (630)..(662): a, c, t, g, unknown or other
  misc_feature (630)..(662): n is a, c, g, or t
tcagtacgctgtctcacgaccggtgctcgatttagtctgacgtcaaaggggaaggggctggtgtgggtctcacgtattagtagtgatgggagttacaacaactaatgtggagtccgtggagggccgattcaccatctcagagacaacgccaaagaacacgctgtatctgcaaatgaaccagtctgagacgccggaggacacggctgtgtattattgtgacttaacgtttcgggaatttacggttcggaacccgacggtcggactaaagggtccgggggacccaaacgggggtaaccccgttgggtacccacccggttcctccctacgaccgtacccctaccgaaccgaacggggcccccttaagtccccggttccccctttaccccccggngggcccccgtaccccggttcgacccgttacccggaaagggtccaccccgtacccgtaccggaaggtacgacccgaaccgcggtccccggtcccggtcgggtacttccgggaccgttacggtaacccgaaaagggttacccctttaccttaacccggagaccgtaccggtacgttaaaccggcgggtacggggccgggtccgtacgggaaccgacggggcctacgtaagtgntngttacnnnnnnnnnnnnnnnnnnnnnnnnnnnnnnnnn

SEQ ID NO: 285571 - DNA, 639 bp, Homo sapiens
  misc_feature: GYAE6OF01BECXA.36.30.C08.1.454.CMB.1.raw
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (598)..(599): a, c, t, g, unknown or other
  misc_feature (598)..(599): n is a, c, g, or t
  modified_base (603)..(603): a, c, t, g, unknown or other
  misc_feature (603)..(603): n is a, c, g, or t
  modified_base (608)..(613): a, c, t, g, unknown or other
  misc_feature (608)..(613): n is a, c, g, or t
  modified_base (615)..(639): a, c, t, g, unknown or other
  misc_feature (615)..(639): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccattcaccatctccagagacaacgccaaagaacacgctgtatctgacaaatgaacagtcgtagagacggccggaggtaccgacggtcttgttagttatttagttgtacgacttaacgttttcggggaatttacggttaccgggaacccgacgtccggacgaagggtcggggaccgaacggggtaccccgttaggtccctacccggtaccttccctacgaccgtcccgtacccgaaaccgaaccgggcccctacgtttcccgggtcccctttccccccgggcgacccggtccccttacggtccctaaccgacgggtaccgacccgtacccctaccggagaccgtaccgacccgtaccggcccggccggtcggcctacggtccgtcgtaaccgacggtaccttaccgtaccgacgtacgcggtacgtacgtcggcgggcggtcgtaaccgggcgtaacggcctagagtacncncagnnctangcagnnnnnngnnnnnnnnnnnnnnnnnnnnnnnnn

SEQ ID NO: 285572 - DNA, 789 bp, Homo sapiens
  misc_feature: GYAE6OF01A8G7M.36.30.C08.1.454.CMB.1.raw
  modified_base (491)..(491): a, c, t, g, unknown or other
  misc_feature (491)..(491): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagcttgggttttccttgttgcctagttttaaaaggtgtccagtgtagaaatgcagctggtggaggtcggggagcgttggtcgaggccgggggtcctgagactctccgtgtgcagtcctcgtggtacttccccttacgacggtcgtacctacgtggtactacgcgtaaccgtcggggtcccgaccgtaaacggtccgtacccggaagggggtaacgggggtccgttaggggttcggttcggggttaccttacgtacgtttagttaaggtagtggtaacgtgggtaacttaacgaacgtaacgtaagtgtagggtaacggtccggtagggaacgggtccgtaagttcccaaccgtnttaccggtaccaaggacgtaaccgaaccgtaccgaaaacgacaaccgtcttacggtaatcctaagaaccgtaaattcggaaactacgttccgaggaaacggtacggacccgggaaggaccgtacgggtcctagggttaactttaacggttatttcgggtacgtaccgtttaaacgggtttcgggtaaagtttttaccgggacgggtacccgggtagacggttacgaacgggtttaccgggggaacccgtacggggttaaacccccttggggtaccccttacccggttcctacccccgg

SEQ ID NO: 285573 - DNA, 936 bp, Homo sapiens
  misc_feature: GYAE6OF01AWL3E.36.30.C08.1.454.CMB.1.raw
  modified_base (614)..(614): a, c, t, g, unknown or other
  misc_feature (614)..(614): n is a, c, g, or t
  modified_base (851)..(851): a, c, t, g, unknown or other
  misc_feature (851)..(851): n is a, c, g, or t
tcagtacgctgtctcacgaccggtgctcgatttagtctgacgtcaaaagggaaagggggccccagccctgggactcccagctgtttctgcttgctgatcaggactgcacacagagaactcaccagtggtagtttgggctgacgtcgtttcgggtttttccttgttcgtaccttaagtttttaaaaggtcgtacctagtgtagtaaatcgcgagtcggtggtcgggacgggtccggggtaggtcgttcgggtcggaccggggtccgggggtccctaggacgtaccgtctccgtgtcgctacgtccttcgtaccggttacctttccccgtacgtacggttacgtaccgtttacggtaggtaagtcgacccggttaaccggttccgggtacccgaaccgtaaccgggtcccggtaaccgggggtaagggggttcggtcgggttagggttcgggtacgttaccgttaacggtttaacgttaggtaggttacggtagttaagggtacgttaaactaacgtaacgttaaacgtggttccggtaaacggttcggggtaacgggtacccggacccggttacttaaccgacccgttaacgtacccgaaccgtaaaccgggtanaacccgggtaaaacccgaaccgtaaacccgaaaccggttaccggtaaccttacgggttaacgttaccgtaaccggtaaacgtaaaacggtacccgtaaaagttaccgggtacgtaaacggtaacggaaccgacggtaaccgggacgttaaaccgtggtttacgttaggttaagtttacgttacgtacggttacggttaacgtttacggttcggttagttaaccggtccgggacgttnaacccggggttaacggcccggggtaccggtaacccgggtaacccggttacccggttcgtacccccttcggttcccccgaacccgg

SEQ ID NO: 285574 - DNA, 565 bp, Homo sapiens
  misc_feature: GYAE6OF02I2T6H.36.30.C08.1.454.CMB.1.raw
  modified_base (414)..(414): a, c, t, g, unknown or other
  misc_feature (414)..(414): n is a, c, g, or t
  modified_base (456)..(456): a, c, t, g, unknown or other
  misc_feature (456)..(456): n is a, c, g, or t
  modified_base (470)..(470): a, c, t, g, unknown or other
  misc_feature (470)..(470): n is a, c, g, or t
  modified_base (514)..(514): a, c, t, g, unknown or other
  misc_feature (514)..(514): n is a, c, g, or t
tcagtacgctgtctcacgaccggtgctcgatttagtctgacgtcaaagggaaaggggccccagccctgggactcccagctgtttctgcttgctgatcaggactgcacacagagaactcaccatggagtttgggctgagcgtggtttcgtgtagccatttaaaggtgtcagtgtgaaatgcagctggtggagtccggggaggcttggttcgagccggggggtcccgtgagactctcctgtgcacgcctctggacttccccttccagtgactactggatgcactggtccgccaagctccagggaaggggcgtggtggtgggtctcacgtattagtagtgagtgggagtacacaactaatgtggagtccgtgggagggccgattcaccatctccagagacaacgccaaagaacacgntgtatctgacaaatgaaacagtctgagagccgagactacggntgtgttattattgngctaactttcggggatttaggttcgggaacccgaacgtccgganaaaggttcggggggaccaacgggggaaccccttgggtccacccggtctccc

SEQ ID NO: 285575 - DNA, 419 bp, Homo sapiens
  misc_feature: GYAE6OF02G2G0H.36.30.C08.1.454.CMB.1.raw
  modified_base (415)..(419): a, c, t, g, unknown or other
  misc_feature (415)..(419): n is a, c, g, or t
tcagtacgctgtctcacgaccggtgctcgatttagtctgacgtcaaagggaaagggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggaccagggaaccctggtcaccgtctcctcagcctccaccaagggcccatcggtcttccccctggcgccctgctccaggagcacctccgagagcacagcggccctgggctgcctggtcaaggactacttccagacagcgtactgagcgggctggcaaggcgcatagnnnnn

SEQ ID NO: 285576 - DNA, 458 bp, Homo sapiens
  misc_feature: GYAE6OF02JPYC6.36.30.C08.1.454.CMB.1.raw
  modified_base (448)..(458): a, c, t, g, unknown or other
  misc_feature (448)..(458): n is a, c, g, or t
tcagtacgctgtctcacgaccggtgctcgatttagtctgacgtcaaagggaaggggctggtgtgggtctcacgtattagtagtgatgggacttacacaactaatgtggagtccgtggagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccagggtcaccgtctcctcagcttccaccaagggcccatccgtctcccctggccgccctgctcccaggacgcacctccgagagccacagcccgcctgggctgcctggtcaaggacctacttccagacagcgtactgacgcggctggcaaggcgcagtagnnnnnnnnnnn

SEQ ID NO: 285577 - DNA, 417 bp, Homo sapiens
  misc_feature: GYAE6OF02IK3X7.36.30.C08.1.454.CMB.1.raw
  modified_base (415)..(417): a, c, t, g, unknown or other
  misc_feature (415)..(417): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggcccatcggtcttccccctggcgccctgctccaggagcacctccgagagcacagcggccctgggctgcctggtcaaggactacttccagacagcgtactgagcgggctggcaaggcgcatagnnn

SEQ ID NO: 285578 - DNA, 418 bp, Homo sapiens
  misc_feature: GYAE6OF02GEJC7.36.30.C08.1.454.CMB.1.raw
  modified_base (414)..(418): a, c, t, g, unknown or other
  misc_feature (414)..(418): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggcccatcggtcttccccctggcgccctgctccaggagcacctccgagagcacagcggccctgggctgcctggtcaaggactacttccagacagcgtactgagcgggctggcaaggcgcatagnnnnn

SEQ ID NO: 285579 - DNA, 548 bp, Homo sapiens
  misc_feature: GYAE6OF02F6VEE.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggaggcttggttcagccggggggtccctgagactctcctgtgcagcctctggattccccttcagtgactactggatgcactgggtccgccaagctccagggaaggggctggtgtgggtctcacgtattagtagtgatgggagttacacaactaatgtggagtccgtggagggccgattcaccatctccagagacaacgcaaagaacacgctgtatctgcaaatgaacagtctgagagccgaggacacggctgtgtattatgtgctaactttcgggattaggttgggaaccgacggcgtaacgtaggccggacgaaccgggtacgtcggaccgtaccgtcctaccg

SEQ ID NO: 285580 - DNA, 424 bp, Homo sapiens
  misc_feature: GYAE6OF02JI5RF.36.30.C08.1.454.CMB.1.raw
  modified_base (411)..(411): a, c, t, g, unknown or other
  misc_feature (411)..(411): n is a, c, g, or t
  modified_base (416)..(424): a, c, t, g, unknown or other
  misc_feature (416)..(424): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattatgtgcaactttcgggattagttggaccgacgcgcaatggggccagggaaccctggtcaccgtctcctcagcctccaccaagggcccatcggtcttcccctggcgccctgctccaggagcacctccgagagcacagcggccctgggctgcctggtacaaggactacttccagacagcgtactgagcgggctgggcaaggcgtnatagnnnnnnnnn

SEQ ID NO: 285581 - DNA, 418 bp, Homo sapiens
  misc_feature: GYAE6OF02HF9EW.36.30.C08.1.454.CMB.1.raw
  modified_base (413)..(418): a, c, t, g, unknown or other
  misc_feature (413)..(418): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaagtggggccagggaaccctggtcaccgtctcctcagcctccaccaagggcccatcggtcttcccctggcgccctgctccaggagcacctccgagagcacagcggccctggctgcctggtcaaggctacttccagacagcgtactgagcgggctggcaaggcgcatagnnnnnn

SEQ ID NO: 285582 - DNA, 417 bp, Homo sapiens
  misc_feature: GYAE6OF02GGAG5.36.30.C08.1.454.CMB.1.raw
  modified_base (414)..(417): a, c, t, g, unknown or other
  misc_feature (414)..(417): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccaggggaaccctggtcaccgtctcctcagcctccaccaagggcccatcggtcttccccctggcgccctgctccaggagcacctccgagagcacagcggccctgggctgcctggtcaaggctacttccagacagcgtactgagcgggctggcaaggcgcatagnnnn

SEQ ID NO: 285583 - DNA, 458 bp, Homo sapiens
  misc_feature: GYAE6OF02HMSWL.36.30.C08.1.454.CMB.1.raw
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (449)..(458): a, c, t, g, unknown or other
  misc_feature (449)..(458): n is a, c, g, or t
tcagtacgctgtctcacgaccggtgctcgatttagtctgacgtcaaagggaaggggcgtggtggtgggtcgtcacgtattagtagtgatgggagttacacaactaatgtggagtccgtggagggccgattcaccatctccagagacaacgccaagaacacgctgtatctgcaaatgaacagtctgagagccgaggacacggctgtgtattatgtgcaaatttcggggattagttggaccgacgcgcaatggggccaaggggtaaccctggtcaccgtctccgtcagcctccaccaagggcccctatcggtccttcccccctggccgcccctcgccttaccagggacnccgaccctccgagagcacacgcggtcccnggctgccctggtcaaaggctaacgttcccaagacagtcacgtgagcgggctggccgaaggccgctataggcannnnnnnnnn

SEQ ID NO: 285584 - DNA, 424 bp, Homo sapiens
  misc_feature: GYAE6OF02H1DC3.36.30.C08.1.454.CMB.1.raw
  modified_base (417)..(424): a, c, t, g, unknown or other
  misc_feature (417)..(424): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggatttagttggaccgacgcgcaatggggccagggaaccctggtcaccgtctcctcagcctccaccaagggcccatcggtcttccccctggcgccctgcctccaggagcacctccgagagcacagcggccctgggctgcctggtcaaggactacttccagacagcgtactgagcgggctggcaaggcgcatagnnnnnnnn

SEQ ID NO: 285585 - DNA, 608 bp, Homo sapiens
  misc_feature: GYAE6OF02HTUDO.36.30.C08.1.454.CMB.1.raw
  modified_base (184)..(184): a, c, t, g, unknown or other
  misc_feature (184)..(184): n is a, c, g, or t
  modified_base (260)..(260): a, c, t, g, unknown or other
  misc_feature (260)..(260): n is a, c, g, or t
  modified_base (337)..(337): a, c, t, g, unknown or other
  misc_feature (337)..(337): n is a, c, g, or t
  modified_base (454)..(454): a, c, t, g, unknown or other
  misc_feature (454)..(454): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagcgtggttttcgtgttagccatttaaaaggtgtcagtgtgaaatgnagctggtggagtcggggagcttggttcaggccggggggtcctgagactctcctgtgcagcctctggcttccccttnagtgactactggatgcacgtgggtccgaccaagctccgaggggaacggggctgggtgtgggtctcgagtatagtagngagtgggaattacacaaactaatggtaggagtccgtgggacggccgaattcacgattctccgaagacaccgaaccgccgaaaagaaccacgcgtagtatactgaacaaaatgaaacngtacagacgagaccgagaccgaggtctagtgtacttattggagtacttaacgttcggggtatttacgggttacgggaacccgtcggacgacgtaacggttcgggggcccgtaaacgggtaccccgttgggtacctccccgggtcttaaccccgg

SEQ ID NO: 285586 - DNA, 579 bp, Homo sapiens
  misc_feature: GYAE6OF02GY83W.36.30.C08.1.454.CMB.1.raw
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggaggtccgggggaggcgttggttcaggccgggggggtccctgagactctcctgtgcagcctctggacttcccccttcagtgactactggatgcactgggtcccgccaagcctccgaggggaaggggctgggtgtgggtctcgacgtattagtagtgagtgggagttacacaactaatggtggagtccggtgggagggccgtattcaccatctccagacgacaacgccaaagaacacgctgtatctagacaaatgaaacngtcngagagccgaggacacggctgtagtattagttgtcacgtaagtttcgggatttaggttcgggaaccgacgcgacgaaggtggggacccacggggaacccttgggtacctacccggtctacccg

SEQ ID NO: 285587 - DNA, 420 bp, Homo sapiens
  misc_feature: GYAE6OF02HZEXD.36.30.C08.1.454.CMB.1.raw
  modified_base (328)..(328): a, c, t, g, unknown or other
  misc_feature (328)..(328): n is a, c, g, or t
  modified_base (415)..(420): a, c, t, g, unknown or other
  misc_feature (415)..(420): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggcccatcggtcttccccctggcgccctgctccaggngcacctccgagagcacagcggccctgggctgcctggtcaaggactacttccagacagcgtactgagcgggctggcaaggcgcatagnnnnnn

SEQ ID NO: 285588 - DNA, 787 bp, Homo sapiens
  misc_feature: GYAE6OF02IQXH7.36.30.C08.1.454.CMB.1.raw
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
tcagtacgctgtctcacgaccggtgctcgatttagtctgacgtcaaagggaaagggggccccgagccctgggactcccagctgtttctgcttgctgatcaggactgcacacagagaactcaccatggagtttgggctgagctgggttttccttgttgcctattttaaaaggtgtccagtgtgaaatgcagcgtggtggaggtccgggggaggtcgttggttcgaggccggggggtcctgagtactctctgtgcagcctcgtggtacttccccttnagtgactacgtggatgcacgtcgggtccncaagctcgagggagggcgtggtggtcgggtctctacgtagttagtagtgtagtgggagttacaactaactaagtggtaggacgtccgggtagggacgggacgtacttaccgaaccgtagttcccgtaccgaacggacgaaccgaaaccggacccgtaaaagaaacccgtaacggtcctttagggtaacttaccgtacggaacttaaaaagtggaaaaccttaggttccgaacgggaaggtaaaccggacccggtaaaagggaccccgtaacgggtcccgtttagggttaacggtttaaacgtttacgtttaggtacggtaacccgttttaaaacggggttttccggggtaaagtttttaccggggttaccgggaaacccggtaccggtaaccggtaaccggttaaagggtaccggggggaccccttaaccggggggtaaacccctttcgggggttaccctacccccgggtttctaaccccggg

SEQ ID NO: 285589 - DNA, 488 bp, Homo sapiens
  misc_feature: GYAE6OF02F85A3.36.30.C08.1.454.CMB.1.raw
  modified_base (418)..(418): a, c, t, g, unknown or other
  misc_feature (418)..(418): n is a, c, g, or t
  modified_base (446)..(446): a, c, t, g, unknown or other
  misc_feature (446)..(446): n is a, c, g, or t
  modified_base (448)..(452): a, c, t, g, unknown or other
  misc_feature (448)..(452): n is a, c, g, or t
  modified_base (455)..(455): a, c, t, g, unknown or other
  misc_feature (455)..(455): n is a, c, g, or t
  modified_base (457)..(457): a, c, t, g, unknown or other
  misc_feature (457)..(457): n is a, c, g, or t
  modified_base (459)..(460): a, c, t, g, unknown or other
  misc_feature (459)..(460): n is a, c, g, or t
  modified_base (462)..(488): a, c, t, g, unknown or other
  misc_feature (462)..(488): n is a, c, g, or t
tcagtacgctgtctcacgaccggtgctcgatttagtctgacgtcaaagggaaaggggctggtgtcgggtctccacggtatttagtagtgtatgggagttacacaactaatgtggagtccgtggagggccgattcaccatctccagagacaacgccaagtaacacgctgtattctgcaaatgaacagtctgagagccgaggacacggcgtgtgtattattgtgcgaactttgggattagttggaccgacgcgcaagtggggccagggaaccccttggtcaccgtctcctcagcctccaccaagggcccagtccggtcttccccctggccgcccgtggcctccgaggacgccacctccgagagcgacgagcgggccctgggcctgcctggtccaaggacctacttccagacaggcgtacngagccgggctggcaacggcacagtacgnannnnnagncngnncnnnnnnnnnnnnnnnnnnnnnnnnnnn

SEQ ID NO: 285590 - DNA, 424 bp, Homo sapiens
  misc_feature: GYAE6OF02I8P4W.36.30.C08.1.454.CMB.1.raw
  modified_base (329)..(329): a, c, t, g, unknown or other
  misc_feature (329)..(329): n is a, c, g, or t
  modified_base (340)..(340): a, c, t, g, unknown or other
  misc_feature (340)..(340): n is a, c, g, or t
  modified_base (408)..(408): a, c, t, g, unknown or other
  misc_feature (408)..(408): n is a, c, g, or t
  modified_base (414)..(424): a, c, t, g, unknown or other
  misc_feature (414)..(424): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggatttagttggaccgacgcgcaagtggggccaggggaaccctggtcaccgtctcctcagcctccaccaaggcccatcggtcttcccctggcgccctgctccaggngcacctccganagcacagcggccctggctgcctggtcaaggactacttccagacagcgtactgagcgggctggcaggcncatagnnnnnnnnnnn

SEQ ID NO: 285591 - DNA, 420 bp, Homo sapiens
  misc_feature: GYAE6OF02FMQL4.36.30.C08.1.454.CMB.1.raw
  modified_base (416)..(420): a, c, t, g, unknown or other
  misc_feature (416)..(420): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggcccatcggtcttccccctggcgccctgcctccaggagcaccctccgagagcacagcggccctggctgcctggtcaaggactacttccagacagcgtactgagcgggctggcaaggcgcatagnnnnn

SEQ ID NO: 285592 - DNA, 805 bp, Homo sapiens
  misc_feature: GYAE6OF02IPM05.36.30.C08.1.454.CMB.1.raw
tcagtacgctgtctcacgaccggtgctcgatttagtctgacgtcaaaggggaaagggggcccccagccctgggactcccagctgtttctgcttgctgatcaggactgcacacagagaactcaccatggagtttgggctgagcttgggttttccttgttgcctaattttaaaaggtgtccagtgtagaaatgcagctgggtgggaggtccggggggaggtcttgggttcgagggccgggggggtccctggagactctcctgtgcacgcctctggacttcccctcagtgactactggatgcacgtcgggtcccgccaagctccgaaggggaggggctgggtggtggggtctcgacgttattaggtagtgagtgggaattacaacaacttaagtggtaggacgttccggtagggaacgggccgtaattccgaaacctacttaccgtacccgaagggtaacgaaaccgaaaccgacccgaaaaacggtaaaccgaacggtacttaggttaactaccgttaggaacctaaaaagtacggaaaactaggttccgtaaggaagtaacggcccgggtaaagggaacccgaaccggggtcgtaaggttagtttaacgtttaaacgttttcgggtacggtaacccgttaaacggtttttacgggggtaactttttaacggggtttccggggaaaaccccggtaccgggtaccgggtaaccgttaaaacggggtttccgggggggaccctaaaacccgggggggtaaccccctttacgggggttaaccccgtaaccccggttccgttaacccccgg

SEQ ID NO: 285593 - DNA, 431 bp, Homo sapiens
  misc_feature: GYAE6OF02G5KS1.36.30.C08.1.454.CMB.1.raw
  modified_base (412)..(412): a, c, t, g, unknown or other
  misc_feature (412)..(412): n is a, c, g, or t
  modified_base (419)..(431): a, c, t, g, unknown or other
  misc_feature (419)..(431): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggccccatcggtcttccccctggcgcccctgcctccaggagcacctccgagagcacagcggccctgggctgcctggtcaaggactacttccagacagcgtactgagcgggctggcaagggcncgatagnnnnnnnnnnnnn

SEQ ID NO: 285594 - DNA, 455 bp, Homo sapiens
  misc_feature: GYAE6OF02HS2Q1.36.30.C08.1.454.CMB.1.raw
  modified_base (332)..(332): a, c, t, g, unknown or other
  misc_feature (332)..(332): n is a, c, g, or t
  modified_base (439)..(439): a, c, t, g, unknown or other
  misc_feature (439)..(439): n is a, c, g, or t
  modified_base (445)..(455): a, c, t, g, unknown or other
  misc_feature (445)..(455): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggatttaggttggaccgaacgcgacaaagtggggccaaggggaacccctggtcaccgtctcctcagccctaccaccaaagggccccaatccggtccttccccctggccncccctgcctccgaggacgccacctccgagacgcaacagccggccctcgggctcgcctggtacaaggacctacttccagacagcgtactgagcgggctggcgaaggcncatagnnnnnnnnnnn

SEQ ID NO: 285595 - DNA, 559 bp, Homo sapiens
  misc_feature: GYAE6OF02IIGCG.36.30.C08.1.454.CMB.1.raw
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (475)..(475): a, c, t, g, unknown or other
  misc_feature (475)..(475): n is a, c, g, or t
tcagtacgctgtctcacgaccggtgctcgatttagtctgacgtcaaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggaggcttggttcagccggggggtccctgagactctcctgtgcagcctctggattccccttcagtgactactggatgcactgggtccgccaagcctccgaagggaaggggctggtgtgggtctcacgtattagtagtgatgggagttacacaaactaatgtggagtccgngaggccattcaccatcnccagngacaacgccaaagaacagctgtaanctgacaaaatgaaacngtctgaganccgaggaccacggctagtgtaattattgngcaaactttcggagttaggtttggaaccggtacgcgtacaacgtaggggcctaaggggaaaccctgggttacacccgtctcccg

SEQ ID NO: 285596 - DNA, 427 bp, Homo sapiens
  misc_feature: GYAE6OF02FYYUK.36.30.C08.1.454.CMB.1.raw
  modified_base (417)..(427): a, c, t, g, unknown or other
  misc_feature (417)..(427): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggcccatcggtcttccccctggcgccctgcctccaggacgcacctccgagagcacagcggccctggcctgcctggtcaaggctactccagacagcgtactgagcgggctgggcaagggcgcatagnnnnnnnnnnn

SEQ ID NO: 285597 - DNA, 464 bp, Homo sapiens
  misc_feature: GYAE6OF02GEUET.36.30.C08.1.454.CMB.1.raw
  modified_base (318)..(318): a, c, t, g, unknown or other
  misc_feature (318)..(318): n is a, c, g, or t
  modified_base (400)..(400): a, c, t, g, unknown or other
  misc_feature (400)..(400): n is a, c, g, or t
  modified_base (436)..(464): a, c, t, g, unknown or other
  misc_feature (436)..(464): n is a, c, g, or t
tcagtacgctgtctcacgaccggtgctcgatttagtctgacgtcaaagggaagggggctggtgtgggtctcacgtattagtagtgatgggagttacacaactaatgtggagtccgtggaggccgattcaccatctccagagacaacgccaagaacacgctgtatctgcaaatgaacagtctgagagccgaggacacggctgtgtattagttgtgctaacgtttcgggattagttggaccgacgcgcaatcggggccagggaaccctggtcaccgtctcctcagccttaccaccaagggccccatccggtcttcccccnggccgcccctgcctcccgaggagccaccgtccgagacgcacaggcgaccctgggctgcctggacaaggactacgtccagacngccgtactgagcggctggacgaaggcacgatacgannnnnnnnnnnnnnnnnnnnnnnnnnnnn

SEQ ID NO: 285598 - DNA, 428 bp, Homo sapiens
  misc_feature: GYAE6OF02HH38N.36.30.C08.1.454.CMB.1.raw
  modified_base (421)..(428): a, c, t, g, unknown or other
  misc_feature (421)..(428): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaagtggggccagggaaccctggtcaccgtctcctcagcctccaccaagggcccatcggtcttcccctggccgccctgcctccaggagccaccctccgagagccacagccggccctgggctgcctggtcaaggactacttccagacagcctatgagcgggctggacaaggcgcatagnnnnnnnn

SEQ ID NO: 285599 - DNA, 722 bp, Homo sapiens
  misc_feature: GYAE6OF02H061V.36.30.C08.1.454.CMB.1.raw
  modified_base (292)..(292): a, c, t, g, unknown or other
  misc_feature (292)..(292): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagcgtggtttcgtgtagcatttaaaggtgtcagtgtgaatgcagctggtggaggtccggggagcttggttcaggccggggggtcctgagactctcctggtgcagcctcgtcggacttccccgtcagtcgactacgtggatgccacgtgggtcccnccgaagccgtaccggagggaacggggctgggtggttggggtcctacgtacggttagttaggtagtgtaagttgggaacgtttaaccactaaacgttaagtcgggtagggtaccgggtacgggttacgggaccggtacgttaaccgttaccaacgtactaccgtacgaacggtaaccgaaacgtacccgaaacggaaacgtaaccgcgttactacgtacgtagtacgtaaagtaaacgtacgtaaccgttagaccgtaggaacgtaccggacggacgaacggccgttaagttcgttaacgttagtttagttcgtacgttaaccgttacggttagttacgttacgggtaccggaccggtaccggtacgtacgggtaaccggggcgaacccgggttaaccggtaccggtccgtaaccgttcccgtcgtacccg

SEQ ID NO: 285600 - DNA, 557 bp, Homo sapiens
  misc_feature: GYAE6OF02GLKDZ.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggagcttggttcaggccggggggtccctgagactctcctgtgaagcctctggattcacctttgacaagtgtgccatgacctgggtccgccaggctccgagggaaggggctgggagtgggtctcgagttattaggtggtagtggtagtagcacagattacgcagactcgtagaagggccggttcaccatctccagagacaactccaacagcacgctgtatttgcacatgaacagcctagagagaccgaggacacggccatatattattgtagacgtaacttcctttagacttggttattacttccctagtcgtacctacgtcggggaccctacgggacccttcggtcctacccgg

SEQ ID NO: 285601 - DNA, 483 bp, Homo sapiens
  misc_feature: GYAE6OF02H1EPE.36.30.C08.1.454.CMB.1.raw
  modified_base (209)..(209): a, c, t, g, unknown or other
  misc_feature (209)..(209): n is a, c, g, or t
  modified_base (342)..(342): a, c, t, g, unknown or other
  misc_feature (342)..(342): n is a, c, g, or t
  modified_base (458)..(458): a, c, t, g, unknown or other
  misc_feature (458)..(458): n is a, c, g, or t
  modified_base (460)..(483): a, c, t, g, unknown or other
  misc_feature (460)..(483): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattnttgtgcaactttcgggatttaggttggaccgacgcgcaagtcggggccagggaccctggtccaccgtctcctcacgcctccaccaagggcccatccggtccttcccccgtggccgcccctgcctccgaggacnccaccctccgagacgaccacacggccggccccgtgggcctcggcctgggtcaacgggaccttaccttaccagaccagcgtacgtggacgcgggcgtgggcgaaggcgtacagtagngnnnnnnnnnnnnnnnnnnnnnnnn

SEQ ID NO: 285602 - DNA, 476 bp, Homo sapiens
  misc_feature: GYAE6OF02G7OH0.36.30.C08.1.454.CMB.1.raw
  modified_base (457)..(476): a, c, t, g, unknown or other
  misc_feature (457)..(476): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaacgtttcgggattaggttggaccgacgcgcaagtcggggccaggggaacccctggtccaccgtctcctcacgcctccaccgaacgggcccatccggtccttccccctgggccgcccctgcctcccgaggacgccaccgtccgagacgcacaggccggcccgtgggctcgccgtggtacgaaggcttactccagacagcgtactggacggcgggcgtcgggacgaagggccgacgagtacgnnnnnnnnnnnnnnnnnnnn

SEQ ID NO: 285603 - DNA, 629 bp, Homo sapiens
  misc_feature: GYAE6OF02FS3A8.36.30.C08.1.454.CMB.1.raw
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgccattttaaaaggtgtccagtgtgaaatgcagctggtggagtccgggggaggcttggttcaggccggggggtccctgagactctcctgtgcagcctctggacttccccttcagtgactactggatgcacgtcgggtcccgccaagcctacccgaggggaaggggtctggtgtggggtcctcgacggttattagtagtgagttgggattacacaactaagtggtaggagtccgtgggacggcgtatcaccntcctcgagacgacaacgccaaagaaccncgcttagtactcgtagacaaatcgaaacngttacgngaaggacgccgggaaggaccgacggtcgtagttagttaactttgttagtgtaccttaacgtttcggggatttagggtcggtaacccggcggccgtacgaacggtccgggggtacccgaaggggtaaccccctttgggtccccgtaccggttcctccccg

SEQ ID NO: 285604 - DNA, 478 bp, Homo sapiens
  misc_feature: GYAE6OF02IWLPC.36.30.C08.1.454.CMB.1.raw
  modified_base (464)..(478): a, c, t, g, unknown or other
  misc_feature (464)..(478): n is a, c, g, or t
tcagtacgctgtctcacgaccggtgctcgatttagtctgacgtcaaagggaaggggctggtgtgggtctcacgtattagtagtgatgggagttacacaactaatgtggagtccgtggagggccgattcaccatctccagagacaacgccaagaacacgctgtatctgcaaatgagcaacctgagagttgaggacacggctgtgtattactgtgcgtcccccctgggggatacaggtgtggtcaactggatcttgactacgtggggccagggaaccctggtccaccgtctcctcacgcctccaccagggcccatcggtcctccccctggccacccctcctccaagcgccacctcgtggggcacgacggccggcccgtggggcctcggcccgtgggtaccaaacgggtacctaccgttcccaggaccagtcgtactggaggcgggcgtggcgaagggcgcagtagnnnnnnnnnnnnnnn

SEQ ID NO: 285605 - DNA, 812 bp, Homo sapiens
  misc_feature: GYAE6OF02JQ8TR.36.30.C08.1.454.CMB.1.raw
tcagtacgctgtctcacgaccggtgctcgatttagtctgacgtcaaagggaaagggggccccgagccctgggactcccagctgtttctgcttgctgatcaggactgcacacagagaactcaccatggagtttgggctgagcttgggttttccttggttgcctaattttaaaaggtgtccagtgtgaaatgcagctggtgggacggtccggggggagtcgttggttcgacggggcccgggggggttccctggagaccttccgtccgttggtcggccacgtcccgttcgtgggtacctttccccccttagaggtacggtaaccttaaccgtgggaacttcggccgtacggttccgggggttccccgaccgaaacggtcccgttacccggaaggggggtaacggggggtcttggggtggttcggggtcctaccgtaacggttagttagtaggtggtagttggggtaacttaccaacgtaaacgttaagtgggtgggtaacggttccgggtaggggtacgggaccgttacttacccgaacccgtagtccgttacccgaaggtaaccgtaaaccaaccgggtaaccccgtaaagaaacccgacgtccgtgttaacgtcctaacggaactaaaggtaccgaaacgtcgttacgtgggaacgcggacccggtaaggacgtacggtcgttagttagttacgtttagtcggttacgaccgtttaaggtttcgggatttagggtaccggaccgacggacgtagtaagggtacccggggtaccggtaacggtacccggttcggtacccgtaccttcccgtccg

SEQ ID NO: 285606 - DNA, 464 bp, Homo sapiens
  misc_feature: GYAE6OF02FOYM3.36.30.C08.1.454.CMB.1.raw
  modified_base (449)..(464): a, c, t, g, unknown or other
  misc_feature (449)..(464): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaacgttttcgggatttagttggacccgacgcgcaagtggggccaggggaaccctggtccaccgtctcctcagcctccaccaagggccccagtccggtccttccccccgtggcccgcccctcgcctccgaggacgccacccgtccgagacgcacgagccggcccgtgggctcgccgtggtcaaggactacttccgagacagtcgtacgtgagcgggctgggacaaggcgcagtgnnnnnnnnnnnnnnnn

SEQ ID NO: 285607 - DNA, 437 bp, Homo sapiens
  misc_feature: GYAE6OF02FU8E8.36.30.C08.1.454.CMB.1.raw
  modified_base (313)..(313): a, c, t, g, unknown or other
  misc_feature (313)..(313): n is a, c, g, or t
  modified_base (416)..(437): a, c, t, g, unknown or other
  misc_feature (416)..(437): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaccctggtcaccgtctctcatcctccaccaaggcccatccggtcttcccctggccnccctgcctccaggacgcacctccgagagccacagcgccctgggctgcctggcaaggtactactccagcagcgtactgaggcggctggacgaagggcacatagnnnnnnnnnnnnnnnnnnnnnn

SEQ ID NO: 285608 - DNA, 433 bp, Homo sapiens
  misc_feature: GYAE6OF02IZM5G.36.30.C08.1.454.CMB.1.raw
  modified_base (421)..(421): a, c, t, g, unknown or other
  misc_feature (421)..(421): n is a, c, g, or t
  modified_base (423)..(423): a, c, t, g, unknown or other
  misc_feature (423)..(423): n is a, c, g, or t
  modified_base (426)..(433): a, c, t, g, unknown or other
  misc_feature (426)..(433): n is a, c, g, or t
tcagtacgctgtctcacgaccggtgctcgatttagtctgacgtcaaagggaaaggggctggtgtgggtctcacgtattagtagtgatgggagttacacaactaatgtggagtccggtggagggccgattcaccatctccagagacaacgccaagaacacgctgtatctgcaaatgaacagtctgagagccgaggacacggctgtgtattattgtgctaactttcgggattagttggaccgacgcgcaagtggggccagggaaccctggtcaccgtctcctcagcctccaccaagggcccatcggtcttcccctggccgccctgcctccaggacgccacctccgagacgccacacgcggcccgtggctgcccgtggtcaaaggactacttccagacagcgtactgagcgggctggcaaggcnanagnnnnnnnn

SEQ ID NO: 285609 - DNA, 786 bp, Homo sapiens
  misc_feature: GYAE6OF02HV00L.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccatggagttgggctgagcttgggttttccttgttgcctattttaaaggtgtccagtgtagaaatgcagcgtgggtggaggtccgggggagtcgttggttcgagggccggggggtcctgaggtacttcgtccgtgtcgcgacgccgttcgtcggtacctttcccccttctaggttacgacttacgtgggatcggccgtaccggtcgggtcccgacccgtaacggtccgtacccggaggggggtaacgggtcggttcggggttcgggttacgggttccgttaccgtaacggttacgtttaagggttaggtacggtaaggttcgggtaacgttaaccgaaacgtaaaccgttaaagttgggttacgggtacgggttaccggggttaggggaacgggtaccggtaacgttaccgtaaccgtacttacccgtacgtaacggaacgaacccgtaaaccggacccgaaaggtaaacccgtcggtaactacggttaacttcgtaacggaacgtaaacgttacgaaaccgtaggtcgtaagaacgggtaaccgccggaacgaccggtaccggtgttcgttagttattacgtgtacgacttaggttcggatttacggcgaaccggagcgtacgtaggcgggtccgaacggtaccgttcggactcccgtgtacccg

SEQ ID NO: 285610 - DNA, 597 bp, Homo sapiens
  misc_feature: GYAE6OF02GD99S.36.30.C08.1.454.CMB.1.raw
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
  modified_base (471)..(471): a, c, t, g, unknown or other
  misc_feature (471)..(471): n is a, c, g, or t
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggtttttccttgttgccattttaaaaggtgtccagtgtgaaatgcagctggtggagtccgggggaggcttggttcaggccggggggtccctgagactctcctgtgcagcctctggacttccccttcagtgactactggatgcactgggtcccgccaagctccgaggggaagggctggtgtgggtctcgacgtattagtagtgagtgggattacacaactatgtggagtcgtgggaggccgtatcacatctcagagacaacgccaaagacacgntagtatcgtagacaaatcgaaacngtactagagagccgaggaccacgggctaggtnttaatttagttgtacgtacgttaacgttttcgggatttaacggtcgggaacccggaacggtcgacctaagggttcgggggaccctaacggggaacccccttgggtaccctacccggttcctacccg

SEQ ID NO: 285611 - DNA, 559 bp, Homo sapiens
  misc_feature: GYAE6OF02FFVOJ.36.30.C08.1.454.CMB.1.raw
tcagtacgctgtctcacgaccggtgctcgatttagtctgacgtcaaaggggaaaggggggcccccagccctgggactcccagctgtttctgcttgctgatcaggactgcacacagagaactcaccatggagtttgggctgagctgggttttccttgtttgccatttttaaaaaggtgtccagtgtgaaatgcagctggtggagtccgggggaggcttggttcagccgggggggtccctgagactctcctggtgcagcctctggattcccccttcagtgactactggatgcactgggtccgccaagctccaggggaggggctggtgtggtctcacgtattagtagtgatgggagttacacaactatgtggagtccgtgggaggccgtatcaccatctccagacgacaacgccaaagaacacgctgtatctagcaaatgaaacagtctagagagccgaggacacggcttagtgttaatttatgtagctaacgtttgggtattaggtggaccgacgccgacaagtggggaccgagggaacccgtggacctaccggtcctccg

SEQ ID NO: 285612 - DNA, 563 bp, Homo sapiens
  misc_feature: GYAE6OF02G293U.36.30.C08.1.454.CMB.1.raw
  modified_base (523)..(523): a, c, t, g, unknown or other
  misc_feature (523)..(523): n is a, c, g, or t
  modified_base (526)..(526): a, c, t, g, unknown or other
  misc_feature (526)..(526): n is a, c, g, or t
  modified_base (529)..(563): a, c, t, g, unknown or other
  misc_feature (529)..(563): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaaagaacacgctgtatctgcaaatgaacagtccgagacgccgaaggacacggctgtgttattattgtgactaacgtttcgggaatttagttcgggaccgacgcgacaagtcggggccacggggaccctggtccaccgtctcctcacgccctccaaccgaacgggcccacgtccggtcccttcccccgtggcccgccctcgcctcccgacggcgaccacccgtccggaagacgaccaccgacggcccgggccccgtcggggccttcggccgttggtaaccgaaagggtacccttaccgttacccgagaaccgacggtaccgtaccggtggaacggccgggggtcgtacgggacgaaacgggcgacgtaagtcgncgncgnnnnnnnnnnnnnnnnnnnnnnnnnnnnnnnnnnn

SEQ ID NO: 285613 - DNA, 517 bp, Homo sapiens
  misc_feature: GYAE6OF02HLXUJ.36.30.C08.1.454.CMB.1.raw
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (483)..(483): a, c, t, g, unknown or other
  misc_feature (483)..(483): n is a, c, g, or t
  modified_base (485)..(517): a, c, t, g, unknown or other
  misc_feature (485)..(517): n is a, c, g, or t
tcagtacgctgtctcacgaccggtgctcgatttagtctgacgtcaaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgctaactttcgggatttaggttggaccgacgcgcaagtggggccagggaaccctggtcaccgtctcctcagcctccaccagggcccatcggtccttcccccgtggccgcccctgcctccgaggacgccacccgtccgagacgccacgacggccggcccgtgggcctcgcccgtggtaccaaagggaccttacgttccaagaccaggtccgtaactcggacggcggggctacgggacgtaacgggccgacgaagttaacgcancgagncngnnnnnnnnnnnnnnnnnnnnnnnnnnnnnnnnn

SEQ ID NO: 285614 - DNA, 807 bp, Homo sapiens
  misc_feature: GYAE6OF02FP8SA.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccatggagtttgggctgagctgggttttccttgttgcctaattttaaaaggtgtccagtgtgaaatgcagctgggtgggaggtccgggggaggtcgttgggttcgagggcccgggggggtcctgagtactcctcctgtgcagtcctctggaccttcccctcagtgactacgtggatgctacggttcgggtcccgacctaaggcctaccggagggggtaacgggggcgttggggtcgggttcgggttccttacgaacggtttagttaaggtagtggtaggtgggtaagttaacaaccgtaaataagttggtacggggtacgtccgggtaggggacgggtaccgtaagttacccgaactactccgtaccgaacgggtaacgaaacccgtaaaccggaaccctaaaacggaacccgtaaccgtacgttaacgtagtttaacccggtaaggaaaccttaaaaacgttccggaaaacgtacgttttaaccggaacggggagaaccccggtaccgggaagggaaacccgttaacggggtcttaggggttactttaggtttaacttggttaaccgtaccgtttaacgggtttggttaagtttccgggacggttacccgacgggtcgttaacgaagggttaccggggtaccgaccgggttaaacccgttggaaccccgtccgttacccgtccccg

SEQ ID NO: 285615 - DNA, 947 bp, Homo sapiens
  misc_feature: GYAE6OF02GP9AK.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccagtggagtttgggctgagcgtttcgggtttttccttggtttcgaccgtaaagttttttaaaaaggtcggttacctaaggttgtaaggtaaaacgtttggaccgaacggtcgttgggtacgggtacgggttacccggggggaggttccgtttcgggttccggacggggtccccggggggggttccctggacgtaccgttccgttccgttgtcgaccgtacgcccgttcgtacggttaccctttcccccgttagacggttacgtaccgttacggtacgggtacttcggacccgtaacggttccggggttccccgaccgtaaacggcccgttaccgggaacggggggtaacgggggtcgttggggttacggttcggggttacctaccgtaaggttagtttaacggtaggttacggtacgggttagggttaacgttaacgaaacgtaaacgttaaaggtttgggtaacgggttacgggttaccgggtaggggtaaccggggtacccgttaagtttacccgaaccgttacgtacccggttaacccgaaggtaaccggaaaacctacccggaaacccgaaacggtaaacccgaacggtcgtttaacgtacgttactaaccgaacgtaaacgtaacggtaacgtacgttacgtacggaagggtaccgaccggaacgggaccgtaacgtcgtttagttcgttaagtttgtacgttacgtacgtttaacggttcggttaagtttaccggacggtaaccgtaccggtacgtaacggttaacggtaccgggacggtaacccggtccggtacggtacccttaccggtaccctcccgg

SEQ ID NO: 285616 - DNA, 924 bp, Homo sapiens
  misc_feature: GYAE6OF02HIAXZ.36.30.C08.1.454.CMB.1.raw
tcagtacgctgtctcacgaccggtgctcgatttagtctgacgtcaaagggaaaggggccccagccctgggactcccagctgtttctgcttgctgatcaggactgcacacagagaactcaccatggagtttggctgagctggttttccttgttgcctattttaaaggtgtccagtgtgaaatgcagctggtggagtccggggagcttggtcgaggccgggggtcctgagactcgtcctgtgcacgcctctggtacttccccgttcgagtgacctactggattgccgtacgtgggtaccccgtaccgaaaggtccgtacccggaaggggtaaacgggggccgttaggggttcggttcggggttaccgtaccggtaaccggtttaagtttaacggttaacggttaggtaacggttacggggtaaacgttttaaccgtaaacccgtaaaacgtttaaacggttacggttacgggggtaaacggttcccggttacgggggaacgggtacccggtaaacgtttacccggtaaacccgtaaccgtttacccgttacccgaacgggtaaccggtaaacccgtaaaacccggtacccgtaaaacggaaaacccggtaccggtaccgttaacggttaacctacggttacgtaaccgtaaaagttacgaaaaccgttagtaccgttaggaacggacggtacccggaaacgggtaaccgaaccgggttcttacgggttaacgttacgtttaacgttttcgggtaacgttaaccgttaaccggtttttaccggggtacgttttaacgggttttacgggaaacccccgggttacgggtaccccgggtaacgttaaacgggtcccggggggtaacccggtaaccgggggtaacccccgttccgggtaacccgttaaccccggttacgttaaccccccgg

SEQ ID NO: 285617 - DNA, 463 bp, Homo sapiens
  misc_feature: GYAE6OF02JD2BK.36.30.C08.1.454.CMB.1.raw
  modified_base (421)..(421): a, c, t, g, unknown or other
  misc_feature (421)..(421): n is a, c, g, or t
  modified_base (439)..(463): a, c, t, g, unknown or other
  misc_feature (439)..(463): n is a, c, g, or t
tcagtacgctgtctcacgaccggtgctcgatttagtctgacgtcaaagggaaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgctaacttttcgggattagttggaccgacgcgcaagtggggccagggaaccctggtcaccgtctcctcacgcctccaccaagggccccatcggtccttcccccgtggccgcccttcgcctccgaggacgtccacctccgagacgcacaggccggtccctgggcctgccgtggtacaaggactacttcagacacgcgtactgagcgggntggcaaggcgcagtacgnnnnnnnnnnnnnnnnnnnnnnnnn

SEQ ID NO: 285618 - DNA, 744 bp, Homo sapiens
  misc_feature: GYAE6OF02JQTX7.36.30.C08.1.454.CMB.1.raw
tcagtacgctgtctcacgaccggtgctcgatttagtctgacgtcaaagggaaaggggccccagccctgggactcccagctgtttctgcttgctgatcaggactgcacacagagaactcaccagtggagtttgggctggagtcgttcgggtttttccttgttgtaccttaagtttttaaaaggtcgtccagttgtagaaagtgcgagtcgtgggtgggacgggtccgggggagtcgtttcgggttcgacggggtcccgggggtccctaggacgactccgtcgtgtcgccacgtccttcgtcggtacctttccccgttgtacgtacgtactacgttggatcgacgtcggttcggtacccgcgtacgccgtcggaaggggtacgggcgttggtggtcggtcgtacgtacgtttagtagtgagaggttaggtaactaccaacgtaacgtagtggtaggtaccgttaccgggagggtaccggtcctacgtttaccgacctcgttaccgtacggaacgaaccgtacgaaccgtacgaaagtaaccgcgttacgtacgtacgtacccgagtaacaagttacgactacgttcgaggaacgaccggaccggagtaccggtcgtacgtggttacttagttccgtagtcggttaaaccgttgggtttactaggtttacggcggtacccggagttcggacgttaacggtccgggacggtaacccggtacgttcggtacccctacgttcccgtaccg

SEQ ID NO: 285619 - DNA, 705 bp, Homo sapiens
  misc_feature: GYAE6OF02IQP3L.36.30.C08.1.454.CMB.1.raw
tcagtacgctgtctcacgaccggtgctcgatttagtctgacgtcaaagggaaagggggccccagccctgggactcccagctgtttctgcttgctgatcaggactgcacacagagaactcaccatggagtttggctgagctgggttttccttgttgcctatttaaaaggtgtccagtgtgaaatgcagctggtggaggtccggggggaggtcttgggttcgaggccgggggggtcctgagactctccgtgtgcagcctctggacttccccttcagtgacttactggactgcacgtcggtccgcaacgctacgagggaggggcgtggtggtgggtctcgacgtagttagtagtgagtgggattacaacaacgtaatgtcggtagtccggtaggacgggccgtattcaccacgtcctaccgaggaacgaacgaaccgaccaaaacggtaaccaccgacttaggttaactcgtagtaacaaaagttacgaaacgtacggtaccgtaaggaagtacggaccggacggaacgaccgggtgttaggttacggtttaagtttacgttaggtcgttaaccgttaacggttttaagggtcgtttaagggtttaccggtaacccggtacggaccggtaaccgtaacgggttacccgggggaccgtaaaccgggggaaccccgttggggaccccgtacccggttccccttaccccgg

SEQ ID NO: 285620 - DNA, 569 bp, Homo sapiens
  misc_feature: GYAE6OF02GPFXZ.36.30.C08.1.454.CMB.1.raw
  modified_base (143)..(143): a, c, t, g, unknown or other
  misc_feature (143)..(143): n is a, c, g, or t
  modified_base (527)..(528): a, c, t, g, unknown or other
  misc_feature (527)..(528): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (536)..(569): a, c, t, g, unknown or other
  misc_feature (536)..(569): n is a, c, g, or t
tcagtacgctgtctcacgaccggtgctcgatttagtctgacgtcaaagggaaaggggctggtgtgggtctcacgtattagtagtgatgggagttacacaactaatgtggagtccggtggagggccgattcaccatctccaganacaacgcaagaacacgctgtatctgcaaatgaacagtctgagagccgaaggacacggctgttgtatttattcgtgctaacgttttcgggatttaggttcggacccgagcgcaaagtgggggaccaggggaacccctggtaccaccgtctcctcgacgcctccaaccgacggtcccgagttccgtaccttcccccgtggacctacccctcctccaagtcgcctaccgtcgtcggggaccacgaacggtccggccgtcgggtcctccggccgttacgggtaccgaaacgggtaacctttaccgtacccgtagaaccgcgtaccggtaacgttcggacggacccgggtcgtacggacggaacggacccgcgacggttaagccgattnncgngncgnnnnnnnnnnnnnnnnnnnnnnnnnnnnnnnnnn

SEQ ID NO: 285621 - DNA, 725 bp, Homo sapiens
  misc_feature: GYAE6OF02FTRZY.36.30.C08.1.454.CMB.1.raw
  modified_base (218)..(218): a, c, t, g, unknown or other
  misc_feature (218)..(218): n is a, c, g, or t
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
  modified_base (445)..(445): a, c, t, g, unknown or other
  misc_feature (445)..(445): n is a, c, g, or t
  modified_base (481)..(481): a, c, t, g, unknown or other
  misc_feature (481)..(481): n is a, c, g, or t
  modified_base (571)..(571): a, c, t, g, unknown or other
  misc_feature (571)..(571): n is a, c, g, or t
  modified_base (714)..(714): a, c, t, g, unknown or other
  misc_feature (714)..(714): n is a, c, g, or t
tcagtacgctgtctcacgaccggtgctcgatttagtctgacgtcaaagggaaagggggccccagccctgggactccagctgtttctgcttgctgatcaggactgcacacagagaactcaccatggagtttgggctgagcttgggttttcctgttgacctaagttttaaaggtgtaccaggtgtagaaatgcagtcgtcgggtaggaggtaccgggggngtcgttagggttcgacggggtccggggggttccnggacgtacctcgtcgtgtcncgacgtcctcgtaggtcccttcctcgagtacacgtacgngatcgctcgtcggccacacgcctacggagggtaggtcggtgtaggttcgactgacgttagtagtgtacgngtcgggttactaacacgttaagtagtcggagtacggttcggagggacggtacctactcgaacgntaccgacgaacgacgtaaccgacacgaaacgtaacnccgtagttacgtatcgtacaactaaggtcgtaacgtactacggaggaacgcgtaacggaccgtacggacgttggttactttaaacggttntttacgtcggtaccgtttaacgttaaggtttcgttaagggtttaccggtacgggaacccgtaacgggttaccggtaccgtaacgggggtccgggtaaccccggttaacgggtacccggttacgtaccccggttaccccgggtnttaaccccggg

SEQ ID NO: 285622 - DNA, 666 bp, Homo sapiens
  misc_feature: GYAE6OF02G2B3M.36.30.C08.1.454.CMB.1.raw
  modified_base (612)..(612): a, c, t, g, unknown or other
  misc_feature (612)..(612): n is a, c, g, or t
  modified_base (618)..(618): a, c, t, g, unknown or other
  misc_feature (618)..(618): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
  modified_base (633)..(635): a, c, t, g, unknown or other
  misc_feature (633)..(635): n is a, c, g, or t
  modified_base (637)..(638): a, c, t, g, unknown or other
  misc_feature (637)..(638): n is a, c, g, or t
  modified_base (640)..(642): a, c, t, g, unknown or other
  misc_feature (640)..(642): n is a, c, g, or t
  modified_base (644)..(646): a, c, t, g, unknown or other
  misc_feature (644)..(646): n is a, c, g, or t
  modified_base (650)..(650): a, c, t, g, unknown or other
  misc_feature (650)..(650): n is a, c, g, or t
  modified_base (652)..(658): a, c, t, g, unknown or other
  misc_feature (652)..(658): n is a, c, g, or t
  modified_base (660)..(662): a, c, t, g, unknown or other
  misc_feature (660)..(662): n is a, c, g, or t
  modified_base (664)..(666): a, c, t, g, unknown or other
  misc_feature (664)..(666): n is a, c, g, or t
tcagtacgctgtctcacgaccggtgctcgatttagtctgacgtcaaaagggaaaggggctggtgtgggtctcacgtattagtagtgatgggagttacacaactaatgtggagtccgtggagggccgattcaccatctccagagacaacgccaagaacacgctgtatcctgacaaatgaacagtctagagaggccgaggacacggctggtagtatttattgtgtactaacgttttccgggatttaggttcgggaacccggacgccgacaaagtcggggggcccaacggggtaaccccttggcacccggtacctcccgttccacgaccctccctaaccccgaaacggggacccccaacgttccgggttcctttacccccccgttggggccgtacccccgtcggtcccgtcccgaagggaacgccgtacccccttaccgggaaccggacggacccgaccgaaccggtccgggacccccgtcggggtcctacggtcccgttcggggtaccgaaacggtaccgttaaccgtttacccgaacgtaccgacggtacccgtacgttacggacgggtaccgggtcgtcggggtacgaaacgggccggacgtaaacgtagcncgtagntggcagtcatngncnnngnnannnannnagcngnnnnnnncnnntnnn

SEQ ID NO: 285623 - DNA, 173 bp, Homo sapiens
  misc_feature: GYAE6OF01D682K.4.57.F02.1.454.CMB.1.raw
  modified_base (173)..(173): a, c, t, g, unknown or other
  misc_feature (173)..(173): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatagn

SEQ ID NO: 285624 - DNA, 172 bp, Homo sapiens
  misc_feature: GYAE6OF01C8FWK.4.57.F02.1.454.CMB.1.raw
  modified_base (170)..(172): a, c, t, g, unknown or other
  misc_feature (170)..(172): n is a, c, g, or t
tcagagcactgtagcacgaccggtgctcgatttagctcgatatagttgggttggggaagaggaagactgacggtccccaggagttcaggtgctgggcacagcggccctgggctgcctggtcaaggactacttccctacagtgctctgagcgggctggcaaggcgcatagnnn

SEQ ID NO: 285625 - DNA, 170 bp, Homo sapiens
  misc_feature: GYAE6OF01CWS5I.4.57.F02.1.454.CMB.1.raw
  modified_base (170)..(170): a, c, t, g, unknown or other
  misc_feature (170)..(170): n is a, c, g, or t
tcagagcactgtagcacgaccggtgctcgatttagctcgatatagttgggttggggaagaggaagactgacggtccccaggagttcaggtgctgggcacagcggccctgggctgcctggtcaaggactacttccctacagtgctctgagcgggctggcaaggcgcatagn

SEQ ID NO: 285626 - DNA, 171 bp, Homo sapiens
  misc_feature: GYAE6OF01BCBDO.4.57.F02.1.454.CMB.1.raw
  modified_base (171)..(171): a, c, t, g, unknown or other
  misc_feature (171)..(171): n is a, c, g, or t
tcagagcactgtagcacgaccggtgctcgatttagctcgatatagttgggtttggggaagaggaagactgacggtccccaggagttcaggtgctgggcacagcggccctgggctgcctggtcaaggactacttccctacagtgctctgagcgggctggcaaggcgcatagn

SEQ ID NO: 285627 - DNA, 484 bp, Homo sapiens
  misc_feature: GYAE6OF01CU6PP.4.57.F02.1.454.CMB.1.raw
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaacaggaaagccctaagctcctgatctatgctgcatccagtttacaaagtgggtccatcaagattcagtggcagtggatctgggacagatttcactctcacatcagtagtctacaacctgaagtattttgactaacttactaactgtcaacagagttacgactaccctccgctcactttcggcgtaggaccaaggtgagatcaaacgactgtgctgnacntctcg

SEQ ID NO: 285628 - DNA, 496 bp, Homo sapiens
  misc_feature: GYAE6OF01CC9ZC.4.57.F02.1.454.CMB.1.raw
  modified_base (361)..(361): a, c, t, g, unknown or other
  misc_feature (361)..(361): n is a, c, g, or t
  modified_base (493)..(493): a, c, t, g, unknown or other
  misc_feature (493)..(493): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagatcagtgcagtggatctggacagatttcactctnaccatcagtagtctaacaactgaagtattttgactaacttactactgtacaacagtagttacgaactacccctcgactcactttcggacggagggaccaaggtcgagatcaaacgaatgtacggactgcacntcg

SEQ ID NO: 285629 - DNA, 481 bp, Homo sapiens
  misc_feature: GYAE6OF01BJLOC.4.57.F02.1.454.CMB.1.raw
  modified_base (457)..(457): a, c, t, g, unknown or other
  misc_feature (457)..(457): n is a, c, g, or t
  modified_base (479)..(479): a, c, t, g, unknown or other
  misc_feature (479)..(479): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaaattggtatcagttcaaaccagggaaagcccctaagctcctgatctatgctgcatccagtttacaaagtgggtccatcaagattcagtgcagtggatctggacagatttcactctcaccatcagtagtctacaacctgaagtattttgctaacttactactgtcaacagagttacgataccctcgctcactttcgcgaggaccaggtganatcaaacgactgtgctagcacntc

SEQ ID NO: 285630 - DNA, 484 bp, Homo sapiens
  misc_feature: GYAE6OF01DQHJF.4.57.F02.1.454.CMB.1.raw
  modified_base (479)..(479): a, c, t, g, unknown or other
  misc_feature (479)..(479): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgataccctcgctcacttcgcggaggaccaaggtggagatcaaacgaactgtgctgcaccntctcg

SEQ ID NO: 285631 - DNA, 496 bp, Homo sapiens
  misc_feature: GYAE6OF01C91J7.4.57.F02.1.454.CMB.1.raw
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagttacaaagtgggtccatcaagattcagtgcagtggatctgggacagatttcactctcaccatcagtagtctacaacctgaatattttgctaactttactactgtactaacagtacgttacgatacccctccgactctactttcggcgacgggaccgaaggtcggagactcaaacgatgtggctgcncntcg

SEQ ID NO: 285632 - DNA, 172 bp, Homo sapiens
  misc_feature: GYAE6OF01DA1V7.4.57.F02.1.454.CMB.1.raw
  modified_base (172)..(172): a, c, t, g, unknown or other
  misc_feature (172)..(172): n is a, c, g, or t
tcagagcactgtagcacgaccggtgctcgatttagctcgatatagttgggtttgggggaagaggaagactgacggtccccaggagttcaggtgctgggcacagcggccctgggctgcctggtcaaggactacttccctacagtgctctgagcgggctggcaaggcgcatagn

SEQ ID NO: 285633 - DNA, 492 bp, Homo sapiens
  misc_feature: GYAE6OF01D0XIL.4.57.F02.1.454.CMB.1.raw
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaagtgggtcccatcaagattcagtggcagtggatctgggacagatttcactctcaccatcagtagtctacaacctgaagtattttgcaactttactactgtcaacagagttacgatacccctcgctcactttcggacggacgggaccaaggtggagatcaaacgactgtggctgcnccntcg

SEQ ID NO: 285634 - DNA, 495 bp, Homo sapiens
  misc_feature: GYAE6OF01ADGQD.4.57.F02.1.454.CMB.1.raw
  modified_base (479)..(479): a, c, t, g, unknown or other
  misc_feature (479)..(479): n is a, c, g, or t
  modified_base (489)..(489): a, c, t, g, unknown or other
  misc_feature (489)..(489): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaagtgggtcccatcaagattcagtggcagtggatctgggacagatttcactctcaccatcagtagtctacaacctgaagtattttgctaacttactactgtacaacagtagttacgacttacccctccgctcacttcggcggaggaccaggtggagatcgaaacgactgnggctgacacngtctcg

SEQ ID NO: 285635 - DNA, 497 bp, Homo sapiens
  misc_feature: GYAE6OF01DMS2U.4.57.F02.1.454.CMB.1.raw
  modified_base (440)..(440): a, c, t, g, unknown or other
  misc_feature (440)..(440): n is a, c, g, or t
  modified_base (491)..(491): a, c, t, g, unknown or other
  misc_feature (491)..(491): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgtatctgtgggagacagagtcatcatctcttgccgggcaagtcagagtgttagtatttatttaaattggtatcagttcaaaccaggaaagcccctaagctcctgatctatgctgcatccagtttacaaaagtgggtcccatcaagattcagtggcagtggatcgtgggacagtatttcactctcaccatcagtagtctacaacctgagtatttgcaacttactactgtacaacagagttacgatacccctccgctcncttcggcggaggaccaaggtggagatacaaacgaactgcggtctagcaccntctacg

SEQ ID NO: 285636 - DNA, 518 bp, Homo sapiens
  misc_feature: GYAE6OF01BYZEC.4.57.F02.1.454.CMB.1.raw
  modified_base (479)..(479): a, c, t, g, unknown or other
  misc_feature (479)..(479): n is a, c, g, or t
  modified_base (513)..(513): a, c, t, g, unknown or other
  misc_feature (513)..(513): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagtattcagtggcagtggatctgggacagtatttcactctcaccatcagtagtactacaacctgaagtatttgactaacttactactgtcaacagtaagttacgactaccccttcgctacgtactttcgggacggtacgggaccaagggtgganagtacgaaacgtacgtagtggactagcctaacgnttccg

SEQ ID NO: 285637 - DNA, 488 bp, Homo sapiens
  misc_feature: GYAE6OF01AK8IR.4.57.F02.1.454.CMB.1.raw
  modified_base (483)..(483): a, c, t, g, unknown or other
  misc_feature (483)..(483): n is a, c, g, or t
tcagagcactgtagcacgaccggtgctcgatttagctcgatatagttgggtttggggccagtctcagtcaggacacagcatggacatgagggtcccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgatacccctcgctcactttcggcgagggaccaaggtggagatacaaacgaactgtgctgacaccntctcg

SEQ ID NO: 285638 - DNA, 173 bp, Homo sapiens; identical to SEQ ID NO: 285623
  misc_feature: GYAE6OF01DKRIT.4.57.F02.1.454.CMB.1.raw
  modified_base (173)..(173): a, c, t, g, unknown or other
  misc_feature (173)..(173): n is a, c, g, or t

SEQ ID NO: 285639 - DNA, 534 bp, Homo sapiens
  misc_feature: GYAE6OF01EQNOS.4.57.F02.1.454.CMB.1.raw
  modified_base (98)..(98): a, c, t, g, unknown or other
  misc_feature (98)..(98): n is a, c, g, or t
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
tcagagcactgtagcacgaccggtgctcgatttagctcgatatagttggtttgggagccagtctcagtcaggacacagcatggacatgaggtccccgntcagctcctgggctcctgctactctggctccgagatgccagatgtgacacccagatgacccagtctccatcctcctgtctgcatctgtgganacagagtcatcatctcttgccggnaagtcagagtgtagtatttattaaatggtatcagttcaaacgtaggaactccctaagctcctgactcgtatgctgctagtctagtttacaagtcggtaccatcaagtcttcgagtcgactagtcggtatcgtaggactagtactttacacttcgtacactatcaagtacgtacctacgtaaccgtgtaacgtatttacgactaacttacgtactcgtacaacgtagtacgttaccgtactaccctacgactacgtacgttcggacgtacggactaggtcgagactacgaacgtacgtcgtacggactagactcgtagtcg

SEQ ID NO: 285640 - DNA, 495 bp, Homo sapiens
  misc_feature: GYAE6OF01DSULM.4.57.F02.1.454.CMB.1.raw
  modified_base (196)..(196): a, c, t, g, unknown or other
  misc_feature (196)..(196): n is a, c, g, or t
  modified_base (492)..(492): a, c, t, g, unknown or other
  misc_feature (492)..(492): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttattaaatggtatcagttcaaacagggaagccctaagctcctgatctatgctgcatccagtttaacaaagtcgggtccatcaagattcagtgcagtgatctggacagatttcactctcaccatcagtagtctaacaacctgaaagtattttgactaacttactactgtacaaacagagtttaacgattaacccctcgctcgactttcggcggaggaccaagggtgagatacaaacgatgtggactgacactntac

SEQ ID NO: 285641 - DNA, 579 bp, Homo sapiens
  misc_feature: GYAE6OF01CYRV4.4.57.F02.1.454.CMB.1.raw
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (358)..(358): a, c, t, g, unknown or other
  misc_feature (358)..(358): n is a, c, g, or t
  modified_base (576)..(576): a, c, t, g, unknown or other
  misc_feature (576)..(576): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgaccccaggtctccagtccgtcccggtgttcggtcgaacggacgtccgtagttagggagacaggagtcatcatctcttggaccggcaagcagagtgttatattattaaatggtaatcagttacaaccagggaaacnccctaagctcgtnatctatgctagcatctagttacaagtcgggtccagtcaaagtntcgagtgnagtgatcggtagatagtattcactctactactatacgtagtacgtactaactaacgtagtaagttacgttactactaacttacgtactacgtacaacgtacgtacgttaaccgtaccgttacccgtacgtacctacgtaccgttacgggacggtaacgggtaacgtacggtacggagtacgtaacggaacgtacgtgtacggtactagaccgtacgtntcg

SEQ ID NO: 285642 - DNA, 173 bp, Homo sapiens; identical to SEQ ID NO: 285623
  misc_feature: GYAE6OF01C83CM.4.57.F02.1.454.CMB.1.raw
  modified_base (173)..(173): a, c, t, g, unknown or other
  misc_feature (173)..(173): n is a, c, g, or t

SEQ ID NO: 285643 - DNA, 505 bp, Homo sapiens
  misc_feature: GYAE6OF01COJB2.4.57.F02.1.454.CMB.1.raw
  modified_base (499)..(499): a, c, t, g, unknown or other
  misc_feature (499)..(499): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaagcccctaagctcctgatctatgctgcatccagtttacaaagtgggtccatcaagattcagtggcagtggatctgggactagtatttcactctcaccatcagtagttctaacaacctgaagtattttacgactaacttactactgtaccaacagtaagttaccgaactacccctccgcttactactttcggcggaggaccaggtgagatacaaacgactgtgctagcacntcttcg

SEQ ID NO: 285644 - DNA, 178 bp, Homo sapiens
  misc_feature: GYAE6OF01ERS2F.4.57.F02.1.454.CMB.1.raw
  modified_base (173)..(178): a, c, t, g, unknown or other
  misc_feature (173)..(178): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatagnnnnnn

SEQ ID NO: 285645 - DNA, 536 bp, Homo sapiens
  misc_feature: GYAE6OF01CTO2Q.4.57.F02.1.454.CMB.1.raw
  modified_base (221)..(221): a, c, t, g, unknown or other
  misc_feature (221)..(221): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtattatttaatgtatcagttacaacaggaagccctaagctctgatctatgctgcatccagtttacaaaggtgggtccatcaagtattcagtggcagtggatcgtaggactagtattcacttctcacctatcagttagtactacaacctagaatattttgactaacttactactgtacaactagtacgttacactacccctcgtactcgtaccgttcgggacggacggaaccgaagggtacgtaaggacttaacggaaaccgtaactcgggttacggaccttaggaccaccgtagttcccg

SEQ ID NO: 285646 - DNA, 631 bp, Homo sapiens
  misc_feature: GYAE6OF01CA80Y.4.57.F02.1.454.CMB.1.raw
  modified_base (276)..(276): a, c, t, g, unknown or other
  misc_feature (276)..(276): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattttatttaaattggtatcagttacaaaccagggaaancccctaagctcctgatctatgctgcatcctagttacaaaggtcgggtacccatacaaagtattcgaggtggacagtggatcgtagggacagtatttccactctacaacctatctagttaacgtcctaaacctaactagtaaagttattttacgacctaactttaacctatacgtacaaacgtaaggtacgtttaacccgaccttaacccccgtcgtaccttccgtaaccgttttccggggaccggaaacggggtaacccgtaaaggggtacgggtaagtaaccgttaaccggaaaaaccggtaccgtttacgggtacggggaccttaccggaccgtaaacccgttcgtttaccgg

SEQ ID NO: 285647 - DNA, 566 bp, Homo sapiens
  misc_feature: GYAE6OF01C1ZIY.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttacaaacagggaaagcccctaagcctcctgatctatgctgcatcctagtttacaaaggtgggtacccatcaaagtattcagtggcaggtggatcgtgggacagatttcactctcaccatcagtagtactaacactgaagtattttgactaactttactactgtacaaacagtaagttaccgacttacccctaccgtcctccgtacgttttccgggaccgggtaacgggtacccgaaaggggttcggaaggtaacgttacgaaaaccggtaacgtacggttacgggtactaggaccaccgtattaccg

SEQ ID NO: 285648 - DNA, 500 bp, Homo sapiens
  misc_feature: GYAE6OF01CL4B0.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaagtggggtccatcaagattcagtggcagtggatctgggacagatttcactctcaccatcagtagtctacaacctgaagtattttgactaacttactactgtacaactagagttacgactacccctccgtctcactttcggcggaggaccaaggtggacgatacgaaacgactgtcgctgcacatcttacg

SEQ ID NO: 285649 - DNA, 173 bp, Homo sapiens; identical to SEQ ID NO: 285623
  misc_feature: GYAE6OF01BWAI4.4.57.F02.1.454.CMB.1.raw
  modified_base (173)..(173): a, c, t, g, unknown or other
  misc_feature (173)..(173): n is a, c, g, or t

SEQ ID NO: 285650 - DNA, 548 bp, Homo sapiens
  misc_feature: GYAE6OF01CEOXL.4.57.F02.1.454.CMB.1.raw
  modified_base (221)..(221): a, c, t, g, unknown or other
  misc_feature (221)..(221): n is a, c, g, or t
  modified_base (358)..(358): a, c, t, g, unknown or other
  misc_feature (358)..(358): n is a, c, g, or t
  modified_base (542)..(542): a, c, t, g, unknown or other
  misc_feature (542)..(542): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttaatttaaattggtatcagttcaaaccagggaaagccctaagctcctgatctatgctgcatccagtttaacaaagtcgggtccatcaaagtatcaggtggcagtggatcgtgggaacngatttacactctcaccatcagtacgtactaacaacctgaagtattttacgactaactttactacttagtacaaacgagtaacgttaaccgacttaccccctcgccttctaaccgtttcgggacggtacgggacctaagggtcgaagactacgaaacgtaacgtgtacggactaggcctaaccgnttaccg

SEQ ID NO: 285651 - DNA, 507 bp, Homo sapiens
  misc_feature: GYAE6OF01D8DYT.4.57.F02.1.454.CMB.1.raw
  modified_base (196)..(196): a, c, t, g, unknown or other
  misc_feature (196)..(196): n is a, c, g, or t
  modified_base (501)..(501): a, c, t, g, unknown or other
  misc_feature (501)..(501): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacaggaaagccctaagctcctgatctatgctgcatccagtttacaagtcgggtccatcaagattcagtggcagtggatcgtgggacagatttcactctcaccatcagtagtactacaacctgaagtatttgactaacttactactgtacaacagtagttacgacttacccctcgctctacgttcggacggtacgggacagggtggagagtacaaacgatagtcggactagcctaccgnttaccg

SEQ ID NO: 285652 - DNA, 175 bp, Homo sapiens
  misc_feature: GYAE6OF01BE2S9.4.57.F02.1.454.CMB.1.raw
  modified_base (173)..(175): a, c, t, g, unknown or other
  misc_feature (173)..(175): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatagnnn

SEQ ID NO: 285653 - DNA, 676 bp, Homo sapiens
  misc_feature: GYAE6OF01DMA8U.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggcaagtcagagtgttagtatttatttaaattggtatcagttcaacaggaagccctaagctcctgatctatgctgctatcctaagtttaacgaaaggttcgggtaccctaataccgaaagtacttacgtaaggtcggacgtaggtaggtacttccggttagggaacctagttacttttacaccttcctacaacctatacgtaagttaacgttacctaacgtaaccttagtaaagtttatttttacgaaccttaaaccgtttaccttaacgttacgtaacctaaacgtaacggttacgtttaaccgaacccttacccccgttacccgtaccttaccgttaaccgttttcccggggaccgggtaaacggggtaacccgtaaaggggttcgggaaacgtaacgttacccgaaaaacggtacgttcggtacgggacttacggaccctaaccgtagtttacccg

SEQ ID NO: 285654 - DNA, 498 bp, Homo sapiens
  misc_feature: GYAE6OF01C6IGA.4.57.F02.1.454.CMB.1.raw
  modified_base (196)..(196): a, c, t, g, unknown or other
  misc_feature (196)..(196): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacagggaaagccctaagctcctgatctatgctgcatccagtttacaaagtgggtccatcaagatcagtgcagtggatcgtgggacagtatttcactctcaccatcagttagtctaacactgaagtatttagctaaactttactatgtactaaacagtagttaacgactacccctcgctcactttcggcggagggaccgaaggtggananacaaacgaatgtcggctgccacatcg

SEQ ID NO: 285655 - DNA, 527 bp, Homo sapiens
  misc_feature: GYAE6OF01AYT69.4.57.F02.1.454.CMB.1.raw
  modified_base (411)..(411): a, c, t, g, unknown or other
  misc_feature (411)..(411): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagatcagtggcagtggatcgtgggacagatttcactctcaccatcagtatctacaacctgaagtatttgactaactttactacttntactaacagtacgttacgtaacctacccctccgtactctacgtttccgggcggtacgggaccaagggtggaacgatacgaaaccgaacgtggtcggtctcgaccactagtcgtacg

SEQ ID NO: 285656 - DNA, 490 bp, Homo sapiens
  misc_feature: GYAE6OF01CB62V.4.57.F02.1.454.CMB.1.raw
  modified_base (390)..(390): a, c, t, g, unknown or other
  misc_feature (390)..(390): n is a, c, g, or t
  modified_base (487)..(487): a, c, t, g, unknown or other
  misc_feature (487)..(487): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctggacagatttcactctcaccatcagtagtctacaacctgaagtnttttgctaactttactactgtacaacagagttacgatacccctcgcctcactttcggcggacggacaaggtgagatcgaaacgactgtggctgcacntcg

SEQ ID NO: 285657 - DNA, 520 bp, Homo sapiens
  misc_feature: GYAE6OF01C0L5I.4.57.F02.1.454.CMB.1.raw
  modified_base (411)..(411): a, c, t, g, unknown or other
  misc_feature (411)..(411): n is a, c, g, or t
  modified_base (506)..(506): a, c, t, g, unknown or other
  misc_feature (506)..(506): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctcttgccgggcaagtcagagtgttagtatttattaattggtatcagttcaaacaggaaagcccctaagctcctgatctatgctgcatccagtttacaaagtgggtaccatacaagattcagtggcagtggatctgggacagtatttcactctcacatcagtagtctaacaacctgaacgtattttgactaacttactactntacaacagaagttaccgactacccctaccgctaccgtactttccgggacggtacgggacccaagggtggaagatacaaacgacgtgtacggctanaccaccatcttacg

SEQ ID NO: 285658 - DNA, 496 bp, Homo sapiens
  misc_feature: GYAE6OF01BILSD.4.57.F02.1.454.CMB.1.raw
  modified_base (493)..(493): a, c, t, g, unknown or other
  misc_feature (493)..(493): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaagtgggtcccatcaagattcagtggcagtggatcgtgggacagtatttcactctcaccatcagtagtctacaacctgaagtattttgactaacttactactgtacaacagagttacgactaccctcgctcactttcggcggaggaccgaaggtggagatcgaaacgacgtgtgctagctaccntcg

SEQ ID NO: 285659 - DNA, 172 bp, Homo sapiens
  misc_feature: GYAE6OF01B1648.4.57.F02.1.454.CMB.1.raw
  modified_base (137)..(137): a, c, t, g, unknown or other
  misc_feature (137)..(137): n is a, c, g, or t
  modified_base (169)..(172): a, c, t, g, unknown or other
  misc_feature (169)..(172): n is a, c, g, or t
tcagagcactgtagcacgaccggtgctcgattagctcgatatagttgggttggggaagaggaagactgacggtccccaggagttcaggtgctgggcacagcggccctgggctgcctggtcaaggactacttccctanagtgctctgagcgggctggcaaggcgcatagnnnn

SEQ ID NO: 285660 - DNA, 545 bp, Homo sapiens
  misc_feature: GYAE6OF01AFHRG.4.57.F02.1.454.CMB.1.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaattggtatcagttcaaacaggaancccctaagctcctgatctatgctgcatcagtttacaaagtcgggtcccatcaagattcagtggacagtggatcgtggacagtatttcactctcacctatcagtacgtctaacaactagagtatttgactaattacctactagtacaacgagtacgttacgacttacccctcgtaccttaccgtacgtttcgggacggtacgggtaccgtaaagggtcggaacgtactacgaaacgtaacgtacggtcggtacctacggactacccgtagtcgttacg

SEQ ID NO: 285661 - DNA, 516 bp, Homo sapiens
  misc_feature: GYAE6OF01BN2O6.4.57.F02.1.454.CMB.1.raw
  modified_base (409)..(409): a, c, t, g, unknown or other
  misc_feature (409)..(409): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
  modified_base (510)..(510): a, c, t, g, unknown or other
  misc_feature (510)..(510): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttacaaaccgagggaaacgccctaaagctcctagatctatgctgcatacctagtttacaaaggtcgggtaccatacaagtattcgagtggacaggtggatcgtggacagtatttcacttctcacctatcagtacgtctaacactgtaagtntttagactaacttactatgtacaaacagtacgttacactacccctcgtctactacgtttcggcggaggacaaggtganactacaacgtanggtcactagcntctacg

SEQ ID NO: 285662 - DNA, 173 bp, Homo sapiens; identical to SEQ ID NO: 285623
  misc_feature: GYAE6OF01E0W1V.4.57.F02.1.454.CMB.1.raw
  modified_base (173)..(173): a, c, t, g, unknown or other
  misc_feature (173)..(173): n is a, c, g, or t

SEQ ID NO: 285663 - DNA, 747 bp, Homo sapiens
  misc_feature: GYAE6OF01CD92R.4.57.F02.1.454.CMB.1.raw
  modified_base (185)..(185): a, c, t, g, unknown or other
  misc_feature (185)..(185): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtcttnctctgtggaggacacgagtctatactatactcttcgtccgggccggacgtacgtacgagtagttagttaagtttaattttaaatttaaggttagttactagttacgtaaaccgaaacgggaaaggaaccccgtaaccgtaacgtccttacgtagtactacttagtcgtcgtcgactacctacgtttaacgttaaacgtaacggggttcccggtaacctacgtaacgtaagttactacggtagggtacgacgtaggtagtactcgggtacggtacgtagtttacttaccgtacttccaaccaactactacgtaagtttaccgtaaccaaacctggtaagtaatttttacgtaccgaaacctttaactttactacgtacaaactaaggtaacgtttaaccgtaaccttaaccccccgttcccgtccgttaccttaccgtttaccggggtacgggaacgggggtaacccgtaaaagggttaggggtacgaaattaacccgtaaaaaccggaaaccggttaggttcgggacccggttacgaccgaacccctaacgttgtttaccgg

SEQ ID NO: 285664 - DNA, 505 bp, Homo sapiens
  misc_feature: GYAE6OF01BG1XZ.4.57.F02.1.454.CMB.1.raw
  modified_base (195)..(195): a, c, t, g, unknown or other
  misc_feature (195)..(195): n is a, c, g, or t
  modified_base (501)..(501): a, c, t, g, unknown or other
  misc_feature (501)..(501): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctctgccgggcaagtcagagtgttagtatttattaaattggtatcagttcaaacaggaaagccctaagctcctgatctatgctgcatcctagtttacaaagttgggtcccatcaagattcagtggcagtgatcgtggacagtatttcactctacacatcagtagtactaacaaccttgaagtattttcgactaacttactactgtacaacagtagtacgtacctaccctcgtacctcgtacttcggcggacggacgaggtcggagactacgaaacgatagtcgctgcctacgnttcg

SEQ ID NO: 285665 - DNA, 498 bp, Homo sapiens
  misc_feature: GYAE6OF01D9RWA.4.57.F02.1.454.CMB.1.raw
  modified_base (493)..(493): a, c, t, g, unknown or other
  misc_feature (493)..(493): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattttatttaaattggtatcagtttcaaaccagggaaagcccctaaagctcctgatctatgctgcatccagtttacaaagtgggtcccatcaagattcagtgcagtggatctgggacagatttcactctcaccatcagtagtctacaacctgaagtattttgctaacttactactgtacaacagagttacgatacccctccgctcactttcggcgaggaccaaggtggagatacgaaacgaactggagctgcacctntctcg

SEQ ID NO: 285666 - DNA, 506 bp, Homo sapiens
  misc_feature: GYAE6OF01A74SZ.4.57.F02.1.454.CMB.1.raw
  modified_base (498)..(498): a, c, t, g, unknown or other
  misc_feature (498)..(498): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttcaaaccagggaaagcccctaagctcctgatctatgctgcatccagtttacaaagtgggtcccatcaagattcagtgcagtggatctgggacagatttcactctcactatcagtagtctacaacctgaagtatttgctaacttactactgtacaacagagttacgactacccctcctctcactttccggcggacggacccgaagggtcggagtatacgaaacgaactgtcggctgaccacnctcgttcg

SEQ ID NO: 285667 - DNA, 503 bp, Homo sapiens
  misc_feature: GYAE6OF01DA7WD.4.57.F02.1.454.CMB.1.raw
  modified_base (498)..(498): a, c, t, g, unknown or other
  misc_feature (498)..(498): n is a, c, g, or t
tcagagcactgtagcacgaccggtgctcgatttagctcgatatagttgggtttggggccagtctcagtcaggacacagcatggacatgagggtcccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccaggaaagcccctaagctcctgatctatgctgcatccagtttacaaagtgggtccatcaagattcagtggcagtggatcgtgggacagtatttcactctcaccatcagtagtctaacaacctgaagtattttgactaacttactactgtacaactagacgttacgacttacccctccgcctctactttcggcggaggaccgaaggtggagatacaaacgaactgtaggctagcaccntctcg

SEQ ID NO: 285668 - DNA, 554 bp, Homo sapiens
  misc_feature: GYAE6OF01A6WWD.4.57.F02.1.454.CMB.1.raw
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccgggnaagtcagagtgttagtatttatttaaattggtatcagttcaaaccagggaaacgcccctaagctcctgatctatgctgcatcctagtttacaaagtcgggtcccatacaagtattcagtggctagttggatcgtgggacagtatttcactctacaccatctagtacgtactaacaactagaagtatttgactaacttactactagtacaactagtaacgttaccgaccttaccccgtccgtccttacgtaccgtttcgggcgggtaacgggaccgaagggtggaacgtagtaacgaaacggtacgttggtcggctacgaccacctatccgttacg

SEQ ID NO: 285669 - DNA, 585 bp, Homo sapiens
  misc_feature: GYAE6OF01D6YTW.4.57.F02.1.454.CMB.1.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctctgccggcaagtcagagtgttagtatttatttaaattggtatcagttcaaacagggaaancccctaagctctgatctatgctgcatccagtttacaaagtcgggtcccatcaagattcagtggcagtggatcgtgggactagtatttcactctcaccatcagtagtactaacaactagaagtattttgactaacttactactgtacaactagtaacgttaccgaacttacccccttccgtcctacctaccgtttaccgggacgggtaacgggtaacccgtaaaggggtacggtaacggaagttacccgaaaaccggtaaccgttagggtacgggtaccgttacgacccgtaaccccgttagttccgttaccgg

SEQ ID NO: 285670 - DNA, 191 bp, Homo sapiens
  misc_feature: GYAE6OF01E5HA7.4.57.F02.1.454.CMB.1.raw
  modified_base (173)..(191): a, c, t, g, unknown or other
  misc_feature (173)..(191): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatagnnnnnnnnnnnnnnnnnnn

SEQ ID NO: 285671 - DNA, 173 bp, Homo sapiens; identical to SEQ ID NO: 285623
  misc_feature: GYAE6OF01CI5TT.4.57.F02.1.454.CMB.1.raw
  modified_base (173)..(173): a, c, t, g, unknown or other
  misc_feature (173)..(173): n is a, c, g, or t

SEQ ID NO: 285672 - DNA, 497 bp, Homo sapiens
  misc_feature: GYAE6OF01D31B3.4.57.F02.1.454.CMB.1.raw
  modified_base (218)..(218): a, c, t, g, unknown or other
  misc_feature (218)..(218): n is a, c, g, or t
  modified_base (392)..(392): a, c, t, g, unknown or other
  misc_feature (392)..(392): n is a, c, g, or t
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctcctgtctgcatctggtgggagacagagtcatcatctctgccggnaagtcagagtgttagtatttatttaaattggtatcagttcaaacaggaaacgccctaagctcctgatctatgctgcatccagtttacaaaggtcgggccatacaagattcagtgcagtgatcgtggacagtatttcactctcaccatacagttacgtctaactaacctgaagtntttgactaacttactactgtacaacagtactacgactacccctcgtctactacttcggcggacggacaggtgacatacaaacgacgtgnggctagcacntcgtcg

SEQ ID NO: 285673 - DNA, 558 bp, Homo sapiens
  misc_feature: GYAE6OF01ED7Z6.4.57.F02.1.454.CMB.1.raw
tcagagcactgtagcacgaccggtgctcgatttagctcgatatagttgggtttgggggccagtctcagtcaggacacagcatggacatgagggtccccgctcagctcctgggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaagccctaagctctgatctatgctgcatcagtttacaagtgggtcccatacaagatcagtgcagtgatcgtggacagatttcactctcacatcagtagtctacacctagaatatttgactaacttactactacgtacaactacgaagtttaccgaacttaccccctccgtccttacctaccgttttacgggcgggtaaccgggtaccgaaacggggttgggaacgtaacgtaaccgtaaaacggtaacgttaggtacgggtcgtacgacccaaccgtacgtcgtttacccgg

SEQ ID NO: 285674 - DNA, 553 bp, Homo sapiens
  misc_feature: GYAE6OF01CVCXZ.4.57.F02.1.454.CMB.1.raw
  modified_base (197)..(197): a, c, t, g, unknown or other
  misc_feature (197)..(197): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcttgccgggcaattcagagtgttagttattaatttaaattggtatctagttacaaaccgaggaaacgccctaagcctctgatctatgctgactatacctagtttacgaaacggtcgggtaccatacaagtatcagtgctagtgatcgtaggacagtattcactctacaccatcagtagtactaactactagtaagtatttcgactaacttacttatcgtactaacagtacgttacgtactaccctctacctacgtacgtttcggacggacggtaccgaagggtacgtagacgtaaccgaaacggtaacgtacggtagacctaggaccctacgtatttaccg

SEQ ID NO: 285675 - DNA, 553 bp, Homo sapiens
  misc_feature: GYAE6OF01DL1D3.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacaccagatgacccagtctccatcctccctgtctgcatctggtggganacagagtcatcatctcttgccggnaagtcagagtgttagtatttattaaattggtatcagttacaaactaggaaacgccctaaagctcctgatctatgactgcatccagtttacaaagtcgggtaccatcaagattcgagtggctaggtggatcgtgggacagtatttcgactctcacatcagtagtactaacaacctagtaagtatttgactaaaccttataactgtacaacgtgtaacgttacaacttaccccctccgacttacgtaccgtttcggcggtaacgggaccctaaagggtggaacgtattacgaaaacggtacgttaggtcggtactcgacctcctaagtccgttacg

SEQ ID NO: 285676 - DNA, 594 bp, Homo sapiens
  misc_feature: GYAE6OF01BORYE.4.57.F02.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatcctccctgtctgcatctggtggganacagagtcatcatctcgttgccgggnaagtcagagttgttagttattttaatttaaattggtatctagttacaaaccgaggaaacgcccctaagcctcctagatctatcgctgctattccgtaagtttaacaaacgggttcgggtacccaatacgaaagtactttacgaaggtcggactaggtaggtactcgtaggggactagtactttcacttctacacctatcagtacgtctaacactagtaagtatttcgactaacttactactagtacaacgagtaacgtacctactacccctcgtactacgtacgttccgggaccggtacggtaaccgagggtcggaagtactaacgaaaccgttcgtacgggtacgtaccgtagaccctacgtcttaccg

SEQ ID NO: 285677 - DNA, 568 bp, Homo sapiens
  misc_feature: GYAE6OF01DPQQD.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctcttgccgggcaagtcagagtgttagtatttaatttaaattggtatcagttacaaacaggaaacgcccctaagctcctagatcatgctgcatccagtttaacaaagtgggtccatcaagattcagtgcagtggatctgggacagtatttcactctcaccatcagtagtctacaaccttggaatattttgactaaacttaactacgtagtacaaacagaacgttaacaccttaacccctcccgcttacctacgtttaccgggacgggtaacgggaacctaaaagggttcgggaagaagttaaacaaaacggtaaccgtaggttcgggaccttaggaaccctaaccctaattccgttcgg

SEQ ID NO: 285678 - DNA, 540 bp, Homo sapiens
  misc_feature: GYAE6OF01BM8EN.4.57.F02.1.454.CMB.1.raw
  modified_base (102)..(102): a, c, t, g, unknown or other
  misc_feature (102)..(102): n is a, c, g, or t
  modified_base (273)..(273): a, c, t, g, unknown or other
  misc_feature (273)..(273): n is a, c, g, or t
  modified_base (534)..(534): a, c, t, g, unknown or other
  misc_feature (534)..(534): n is a, c, g, or t
tcagagcactgtagcacgaccggtgctcgatttagctcgatataggttgggtttggggagccagtctcagtcaggacacagcatggacatgagggtccccgntcagctcctggggctcctgctactctggctccgagatgccagatgtgacacccagatgacccagtctccatcctcctgtctgcatctgtgggagacagagtcatcatctctgccgggcaagtcagagtgttagtatttattaaattggtatcagttcaaaccagggaaacncccctaagcctcctgactctatgctgcatccagtttaacaaaggtcgggtccatcaaagtacttcagtggcaggtggatcgtgggacagtattcactctacaccatcagtatctaacaacctgaagtatttgactaactttactactgtacaacgagtacgttacgtactacccctcgactactaccgtttcggacggacgggtaaccgaagggtggaagaactacgaaaacgtacgttggtacggacttagcctaccgtnttcccg

SEQ ID NO: 285679 - DNA, 499 bp, Homo sapiens
  misc_feature: GYAE6OF01CMC7Y.4.57.F02.1.454.CMB.1.raw
  modified_base (274)..(274): a, c, t, g, unknown or other
  misc_feature (274)..(274): n is a, c, g, or t
  modified_base (386)..(386): a, c, t, g, unknown or other
  misc_feature (386)..(386): n is a, c, g, or t
  modified_base (493)..(493): a, c, t, g, unknown or other
  misc_feature (493)..(493): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagtagtgttagtatttatttaaattggtatcagttcaaaccagggaaanccctaagctcctgatctatgctgcatccatttacaaagtgggtcccatcaagattcagtgcagtgatcgtgggacagatttcactctcaccatcagtagtctacaactgaanattttgactaacttactactgtacaactagacgttacgactaccctccgctctacttcggcggacggaccgaaggtacggagatacgaaacgactgtcgtctgcacntcgtcg

SEQ ID NO: 285680 - DNA, 504 bp, Homo sapiens
  misc_feature: GYAE6OF01A2PFY.4.57.F02.1.454.CMB.1.raw
  modified_base (497)..(497): a, c, t, g, unknown or other
  misc_feature (497)..(497): n is a, c, g, or t
  modified_base (500)..(500): a, c, t, g, unknown or other
  misc_feature (500)..(500): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtgcagtggatctgggacagatttcactctcacatcagtagtctacaacctgaagtattttgactaacttactactgtacaacagtaagttacgactacccctccgctactacttcggcggacggaccaaggtcgagattacaaacgtaactgtcggctgacacngtntacg

SEQ ID NO: 285681 - DNA, 539 bp, Homo sapiens
  misc_feature: GYAE6OF01AKO7I.4.57.F02.1.454.CMB.1.raw
  modified_base (532)..(532): a, c, t, g, unknown or other
  misc_feature (532)..(532): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaacgcccctaagctcctgatctatgctgcatcagttacaaagtcgggtcccatacaagtattcagtggcaggtggatcgtgggactagtatttcactctcacatcagtacgtctaacaacctagaagtattttcgactaacttactactgtactaacagtacgttacgacttaccccgtcctctactaccgtttcggacggacgggtaccgtaagggtaggacgagtacgaaacggtaactggtacggtctacgaccaacctntcgttcg

SEQ ID NO: 285682 - DNA, 548 bp, Homo sapiens
  misc_feature: GYAE6OF01C1TDM.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctcttgccgggcaagtcagagtgttagtatttattaaattggtatcagttacaaacgaggaacgcccctaagctcctgatctatgctgcactcctaagtttacaaagttcgggtaccagtcaagtattacagtgctagtggatcgtaggactagtacttcactctccacctatcagtacgtacctactaaacctgaacgtatttcgactaacttatactgtacaactagtagttaccgactaccctcgtcctactacgttcggacggtaacggaccgtaagggtcggaacgaagtaacgaaaaccgtacgttagtacggcttacgacaacctgtcgttacg

SEQ ID NO: 285683 - DNA, 508 bp, Homo sapiens
  misc_feature: GYAE6OF01CE83S.4.57.F02.1.454.CMB.1.raw
  modified_base (503)..(503): a, c, t, g, unknown or other
  misc_feature (503)..(503): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtgggtaccatcaagattcagtggcagtggatcgtggacagtatttcactctcacctatcatagtctacaacctgaatattttgctaactttactactgtacaacagacgttacacttacccctcgctctacgtttcggacggtaggaaccgaagggtgagaactcgaaacgactggtaggctagccactnttccg

SEQ ID NO: 285684 - DNA, 174 bp, Homo sapiens
  misc_feature: GYAE6OF01AZIWY.4.57.F02.1.454.CMB.1.raw
  modified_base (173)..(174): a, c, t, g, unknown or other
  misc_feature (173)..(174): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatagnn

SEQ ID NO: 285685 - DNA, 493 bp, Homo sapiens
  misc_feature: GYAE6OF01CCVJ9.4.57.F02.1.454.CMB.1.raw
  modified_base (196)..(196): a, c, t, g, unknown or other
  misc_feature (196)..(196): n is a, c, g, or t
  modified_base (490)..(490): a, c, t, g, unknown or other
  misc_feature (490)..(490): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctgggacagatttcacttctcaccatcagtagtctacaacctgaagtattttgctaacttactactgtacaactagtagttacgactacccctccgctcactttcggcggaggaccaaggtgagatcaaacgatgtggactgcacntcg

SEQ ID NO: 285686 - DNA, 499 bp, Homo sapiens
  misc_feature: GYAE6OF01EUBDX.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagtattttgctaacttactactgtcaacagaattacgactaccctccgctcactttcggcggaggaccgaaggtggagatacaaacgaactgtaggctgacaccatcgttcg

SEQ ID NO: 285687 - DNA, 657 bp, Homo sapiens
  misc_feature: GYAE6OF01DGR1W.4.57.F02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgaccacccagatcgacccagtcctccatccctcctgtctgcatcgtggnggganacagagtcatcattctcgttggccggacaagtcaggtagttgttagttatttaatttaagttggtatctagtacaaaccgaagggaacncccctaagtcctctgacttctatgctcgactactacctaagttacgaaacggtcgggtaccaagtacgaagtacgttacgaggtcgacgtaggtaggtacttcggagggtactagttacttacgaccttctacactactacgtagttacgtacctaactaaccgtagtaacttacgtttacgaacttaaccttacgttaacgttcgtaactaacgtacgtaaccgttaccgtaacccttacccccgtcgtaccttaccgtaccggtttaccgggacgggtaaccggaacggtaacgggtacggtaacgtaacgtaacgaaacggtaaccgtacggtacggacgttaccgacctaccgtcgttcccg

SEQ ID NO: 285688 - DNA, 518 bp, Homo sapiens
  misc_feature: GYAE6OF01B3XNR.4.57.F02.1.454.CMB.1.raw
  modified_base (442)..(442): a, c, t, g, unknown or other
  misc_feature (442)..(442): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtcgggtccatacaagattcaggtgcagtggatcgtggacagtatttcactctacaccatcagtatactacaacctgagtatttcgactaacttactatgtacaacagtagtacgtaactacccctccnctctacgtttcggacggacggaaccgaagggtcggagactacgaaacgtactcggtaggctggcaccgtagttccg

SEQ ID NO: 285689 - DNA, 567 bp, Homo sapiens
  misc_feature: GYAE6OF01DTFZW.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (340)..(340): a, c, t, g, unknown or other
  misc_feature (340)..(340): n is a, c, g, or t
  modified_base (415)..(415): a, c, t, g, unknown or other
  misc_feature (415)..(415): n is a, c, g, or t
  modified_base (560)..(560): a, c, t, g, unknown or other
  misc_feature (560)..(560): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnagtcagagtgttagttattttatttaaattggtatcagttacaaacgtagggaacgacccctaagcctcctgatctatgctgctatcctagtttaacaaaggtcgggtccatcaaagtnttacgaggtgctagtggatcggtaggactagtacttttcacttctcacctatcagttagtctacaacctgaattntttgactaactttactacttgtacaactaagtacgttaacgtaccttacccctcgtaccttactaccgtttcggacgggtaaccggaccgtaaagggtcggataagtaaccgaaacgtacgttagtacgggacctagcctaacgngttcccg

SEQ ID NO: 285690 - DNA, 715 bp, Homo sapiens
  misc_feature: GYAE6OF01DJ9TE.4.57.F02.1.454.CMB.1.raw
  modified_base (279)..(279): a, c, t, g, unknown or other
  misc_feature (279)..(279): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcattctcttggccggacaagtcagagttgttaagttattttatttaaattggtatcagttcaaacgaggaacnccctaagctcctgatctatgctgctactacctaagtttaacgaaaggttcgggtacccattaccgaaagtactttacgaggtcggacgtagggtaggtacgttccggtaggggaactaaggttactttttaccaccttaccttaccaaacctagtttaaccgtaaggtttaaccgttaacccttaaaccgtaaaccccgttagaaaacgtttactttttcgaaccctttaaaccttttacttacgttacgtaccgaaaacgtacggtaacgtttacccgtaacccgtttacccccttacccgtcttacccgttaccgtttaccggggaccgggtaacgggtaacccgtaaggggttacggaaggttaaacttaacccgaaaaaccgggtaccgttagggttaccgggtactagaacccttaccgtactttacccgg

SEQ ID NO: 285691 - DNA, 492 bp, Homo sapiens
  misc_feature: GYAE6OF01AP7A9.4.57.F02.1.454.CMB.1.raw
  modified_base (408)..(408): a, c, t, g, unknown or other
  misc_feature (408)..(408): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaatggtatcagttcaaaccagggaaagcccctaagctcctgatctatgctgcatccagtttacaaagtgggtccatcaagattcagtggcagtggatctgggacagatttcactctcaccatcagtagtactacaactgaagtattttgactaacttactactntacaacagtaagttacgactaccctccgctctacttcggcggaggaccaggtgacgatacaacgactgnggtcngcacntctcg

SEQ ID NO: 285692 - DNA, 522 bp, Homo sapiens
  misc_feature: GYAE6OF01D0AOQ.4.57.F02.1.454.CMB.1.raw
  modified_base (193)..(193): a, c, t, g, unknown or other
  misc_feature (193)..(193): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctcctgtctgcatctgtggganacagagtcatcatctcttggccgggcaagtcagagtgttagtattttaatttaaattggtatcagttcaaaccaggaaagcccctaagctcctgatctatgctgcatcctagtttacgaaagtcgggtccatcaagtatcagtgcagtggatcgtggacagatttcactctcacatcagtatctaacactagaatatttagactaacttactactctacaacagtaacgttacgaacttacccctcctactctacgttcggcggtaagggaccgaaggtcggaacgtatacgaaacgaacgttggcggtctacgacacctgtcgttacg

SEQ ID NO: 285693 - DNA, 569 bp, Homo sapiens
  misc_feature: GYAE6OF01BF3KX.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagttattttaatttaaattggtatctagttacaaacgagggaaacgccctaagctcctgatctatgctgcatcctaagtttaacgaaaggttcgggtaccaagtacaagtattcgagtggacaggtggatcgtggacagtattcactctacactatcagtacgtctaacactagaagttatttagactaacttactactagtacaacgtagtaacgttacgtacctacccctcgtaccttaccgtaccgtttcgggaccggtaacgggaaccgtaagggtcggtaacgactaacgaaacgtacgtacggtacgactaggactaccgtagttaccg

SEQ ID NO: 285694 - DNA, 604 bp, Homo sapiens
  misc_feature: GYAE6OF01DK241.4.57.F02.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (437)..(437): a, c, t, g, unknown or other
  misc_feature (437)..(437): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcgttgccgggacaagtcagtagtgttagtatttatttaatggtatcagttacaaacgaggaacnccctaagcctctgatctatgctgctactacctaagtttaacgaaaggttcgggtacctaatacgaaagtacttacgagtacggtacaggttggacttcggtagggactagtactttccgactctaccgaccattcaagtactactaactaacctagaattntttacgactaactttactactatacaaacgagttaaccgttaccgaaccttacccccgtcgtaccttaccgttaccgtttcgggacggaacgggtaaccgaacgggtagaacgtacgtaacgaaaaccggtagttacggtcggtactacgacctaacgtcgttaccg

SEQ ID NO: 285695 - DNA, 510 bp, Homo sapiens
  misc_feature: GYAE6OF01CHX5P.4.57.F02.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
  modified_base (324)..(324): a, c, t, g, unknown or other
  misc_feature (324)..(324): n is a, c, g, or t
  modified_base (502)..(502): a, c, t, g, unknown or other
  misc_feature (502)..(502): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctccctgtctgcatctgtggganacagagtcatcatctcttgccggnaagtcagagtgttagtatttatttaaattggtatcagttcaaacagggaaacnccctaagctcctgatctatgctgcatcagtttacaaagtgggtaccatcaagnttcagtggcagtggatcgtggacagtatttcactctcactatcagtactctacaactgaatatttagactaacttactactagtacaactagtattacgacttccctctctctacgttcggacggacggaccgtaggtacggacgtataacgaacgacgtggtcgtactacgacactntcgttacg

SEQ ID NO: 285696 - DNA, 493 bp, Homo sapiens
  misc_feature: GYAE6OF01BP7XA.4.57.F02.1.454.CMB.1.raw
  modified_base (271)..(271): a, c, t, g, unknown or other
  misc_feature (271)..(271): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggcaagtcagagtgttagtatttatttaaattggtatcagttcaaacaggaaancccctaagctcctgatctatgctgcatccagtttacaaagtgggtccatcaagattcagtgcagtgatcgtgggacagtatttcactctcaccatcagtagtactacaacctagaagtattttgactaacttactactgtacaacagtattacgactacccctcgctcacttcggcggacggacaaggtgagatacaaacgactgngtctgacacntcgtcg

SEQ ID NO: 285697 - DNA, 570 bp, Homo sapiens
  misc_feature: GYAE6OF01DV2T7.4.57.F02.1.454.CMB.1.raw
  modified_base (275)..(275): a, c, t, g, unknown or other
  misc_feature (275)..(275): n is a, c, g, or t
  modified_base (562)..(562): a, c, t, g, unknown or other
  misc_feature (562)..(562): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggcaagtcagagtgttagtattttattaaattggtatcagttacaaacagggaaacnccctaagctcctgatctatgctgcatcctagtttaacgaaaggtcgggtaccatacaagtattcagtggctagtggatcgtgggacagtactttcacttctacaccatctagttacgtactaacaactagaagttatttacgactaactttactacttagtacaactagtacgttaaccacttacccctcgtctaccgtacgtttccgggacggtacgggaacccgtaagggtacggaagtacgtaacgaaaacggtaacgttcggtacggactaggcctaaccgtnttacccgg

SEQ ID NO: 285698 - DNA, 520 bp, Homo sapiens
  misc_feature: GYAE6OF01BIO28.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgtcagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagtattttgactaacttactactgtacaactagagttacgactacccctccgccttcacgtttcggcgggacgggaccgaagggtcggagtatacgaaacgaacgtgtcggtctacgacacctattcgttacg

SEQ ID NO: 285699 - DNA, 649 bp, Homo sapiens
  misc_feature: GYAE6OF01DX2KA.4.57.F02.1.454.CMB.1.raw
  modified_base (198)..(198): a, c, t, g, unknown or other
  misc_feature (198)..(198): n is a, c, g, or t
  modified_base (286)..(286): a, c, t, g, unknown or other
  misc_feature (286)..(286): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctcgagatgccagatgtgacacccagatgacccagtctccatccctccctgtctgcatcgtgtggganacagagtcatcattctctggccgggacaagtcagtagttgttaagttaattttaatttaattggtatctagttacaaacgagggaacnccctaagctctagtactctagtcgtctgactataccgtaagtttaacgaaggtccggtacctaagtaccgaaagtacttcgaggttggcgtaaggtggtactcggtagggactaacggtacttttccgaccttctaccgaacctattacgtaagttacgtaacctaaccgtaaccgttagtaagtttactttagaaccttaacctttacgtaacttcgtaaccgtaacgtaagtaccgttaacctacccgttaaccccttcgtacccttacgtaccggtttacgggaccggtaacgggaaccgtagggtacgaagttaccaacggtaaacgtacgtggtcgtacgtacgtacctacgtcttcg

SEQ ID NO: 285700 - DNA, 506 bp, Homo sapiens
  misc_feature: GYAE6OF01BG9AO.4.57.F02.1.454.CMB.1.raw
  modified_base (195)..(195): a, c, t, g, unknown or other
  misc_feature (195)..(195): n is a, c, g, or t
  modified_base (500)..(500): a, c, t, g, unknown or other
  misc_feature (500)..(500): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaaattggtatcagttcaaacaggaagcccctaagctcctgatctatgctgcatccagtttacaagtgggtacccatacaagattcagtcggcagtggatcgtgggacagatttcactctcaccatcagtagtctaacaactagaatatttgactaacttactactgtacaactagtacgttacgactacccctcgtctactacgttacggcggagaccgaaggtggacagtacaaacgacgtgaggtctacacactntcgtcg

SEQ ID NO: 285701 - DNA, 538 bp, Homo sapiens
  misc_feature: GYAE6OF01D11J3.4.57.F02.1.454.CMB.1.raw
  modified_base (221)..(221): a, c, t, g, unknown or other
  misc_feature (221)..(221): n is a, c, g, or t
  modified_base (441)..(441): a, c, t, g, unknown or other
  misc_feature (441)..(441): n is a, c, g, or t
  modified_base (526)..(526): a, c, t, g, unknown or other
  misc_feature (526)..(526): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttaatttaaattggtatcagttacaaacaggaaagccctaaagctcctgatctatgctgcatcctagtttaacaaaaggttgggtacccatacaagtattcagtggacagtggatcgtagggacagtatttcaactctacacctatacaagtagtactacaacctagtaagttatttacgactaacttactactagtacaanagtacgtactacctacccctctactctacgtcggacggacgaacgtaaggtgaagtataacgaaacgtaacgtggtacgcgtacncctacgcttacg

SEQ ID NO: 285702 - DNA, 611 bp, Homo sapiens
  misc_feature: GYAE6OF01AQG89.4.57.F02.1.454.CMB.1.raw
  modified_base (281)..(281): a, c, t, g, unknown or other
  misc_feature (281)..(281): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctcctgtctgcatctgtgggagacagagtcatcatctcgttcgccgggcaagtcagtagttgttagttattttaattaagttgtatacagttacaaaccgaggaacncccctaagcctctgtattctatgctgactataccgtaagttaacgaaggttcgggtaccatacgtaaagtattacgaggtggacgtagtaggtactcggtaggtactagtactttaccacttcctaccacctagtactaagttactacctaacctaacgtaggttaaacgttatttacgaacttaaccgtttactacgtagtacaaacgtacgttaacgtaccgtaacctaccccctcgtccttaccgtaccggttcggacggtacgggtaccgtaagggtggaagtactaacgaaacgtacgtggtacgtctacggacctacgtgttcg

SEQ ID NO: 285703 - DNA, 527 bp, Homo sapiens
  misc_feature: GYAE6OF01EA3SK.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaagcccctaagctcctgatctatgctgcatcagtttacaaagtgggtacccatcaagattcagtggcaggtggatcgtgggacagtatttcactctacacctatctagtagtctaacaactagaagtatttgactaacttaactacttagtacaactagtaagttacgaccttacccctccgtcctctaccgtttacgggcggtacgggaccgaaggtggacgatacgaaacgaacgtgcgtctagacaccatcgttcg

SEQ ID NO: 285704 - DNA, 544 bp, Homo sapiens
  misc_feature: GYAE6OF01AP1N6.4.57.F02.1.454.CMB.1.raw
  modified_base (194)..(194): a, c, t, g, unknown or other
  misc_feature (194)..(194): n is a, c, g, or t
  modified_base (348)..(348): a, c, t, g, unknown or other
  misc_feature (348)..(348): n is a, c, g, or t
  modified_base (408)..(408): a, c, t, g, unknown or other
  misc_feature (408)..(408): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaaccagggaaagcccctaagctcctgatctatgctgcatccagtttacaagtgggtcccatcaagattcagtggcagtgatctggganagtatttcactctcaccatcagtatctacaacctagaagtatttgactaacttactactntacaactagtaacgttaccgacttaccccctccgtccttacctaccgtttaccgggcggtacgggacccgtaagggtcggaacgtagtaaccgaaacggtaacgtggtacggaccttagacccacctagtcttacg

SEQ ID NO: 285705 - DNA, 585 bp, Homo sapiens
  misc_feature: GYAE6OF01BJ110.4.57.F02.1.454.CMB.1.raw
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtcctccatccctccctgtctgcatctggtggganacagagtcatcatctcttgccggcaagtcagtagtgttagtatttatttaaattggtatcagttcaaacaggaaancccctaagctctgatctatgctgcatctagtttacaaagtcgggtacccatacaagtattcgagtggcagtggatcgtggacagtatttcactctacactatcgaagttacgtcctaacaacctagaacgtattttacgactaaccgttactacgttagtacctaactacgtaacgtttaaccggaccttacccccgtccgtaccttactaccgtttaccgggacggtaacgggacccgtaaagggtacggagtaacgtaccgaaaacggtacgttagggtacgtcgtacgacctacctagtccgttacg

SEQ ID NO: 285706 - DNA, 533 bp, Homo sapiens
  misc_feature: GYAE6OF01ER2KN.4.57.F02.1.454.CMB.1.raw
  modified_base (530)..(530): a, c, t, g, unknown or other
  misc_feature (530)..(530): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttacaaacaggaaagccctaagctcctgatctatgctgcatcctagtttacaaaggtcgggtccatcaagattcgagtggcagtgatcgtgggacagatttcactctcacatcagtagtactacaacctgaagtattttagactaacttactactgtacaacagtacgttacgactaccccttccgacttacctacgtttcggacggacgggtaacccgtaagggtcggaagacgtaccgaaaacgaacgtaggtacggtacgtagcaccgntcg

SEQ ID NO: 285707 - DNA, 753 bp, Homo sapiens
  misc_feature: GYAE6OF01DBSSB.4.57.F02.1.454.CMB.1.raw
tcagagcactgtagcacgaccggtgctcgatttagctcgatatagttgggtttggggagccagtctcagtcaggacacagcatggacatgagggtccccgctcagctcctgggactcctgctactctggctccgagatgccagatgtgacacccagatgacccagtctccatcctcctgtctgcatctggtgggagacagatcatcatctctggccggcaagtcagagttgttaagttatttaattttaaagttggttatctagttacaaaaccgagggaaacgcccctaagcctactgtatctatcgctgactatcctaagtttaacgaaggtcgggtacctagtacaaagtacttcgaggttcggacgtaggtaggtacgttacggtaggggtaactaaggttacttttaccgtaaccttacctacccgtaaccctacgttacgtaacggtttaacgtttaacctaaacctaaacccgttaggtaaaggtttaacttttacggaaccctttaaaccttttaaccttaacgttacgttaaccgtaaaccgtaacggtttaacggtttaaacccgtaacccgtttaacccccgttcccgttaccttacccggttaaccggtttttcccgggggaaccgggtaaaccggggtaaacccggaaaggggtttacgggaacgtaacggttaaaccggaaaacccggttaacggttacgggtccgggtacgttaggaccctaaccgtacgtttacccg

SEQ ID NO: 285708 - DNA, 511 bp, Homo sapiens
  misc_feature: GYAE6OF01D8TY0.4.57.F02.1.454.CMB.1.raw
  modified_base (269)..(269): a, c, t, g, unknown or other
  misc_feature (269)..(269): n is a, c, g, or t
  modified_base (505)..(505): a, c, t, g, unknown or other
  misc_feature (505)..(505): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaacaggaancccctaagctcctgatctatgctgcatccagtttacaaagtgggtccatcaagattcagtggcagtggatcgtagggacagatttcactctacaccatcagtagtctaacaacctgaagtattttgactaactttactacttgtacaacagtagttacgacttacccctcgcctctacgttcggcggaggaccgaaggtacggagatacgaaacgaacgtgtacggctagacaccntcttcg

SEQ ID NO: 285709 - DNA, 596 bp, Homo sapiens
  misc_feature: GYAE6OF01A2XIY.4.57.F02.1.454.CMB.1.raw
  modified_base (273)..(273): a, c, t, g, unknown or other
  misc_feature (273)..(273): n is a, c, g, or t
  modified_base (341)..(341): a, c, t, g, unknown or other
  misc_feature (341)..(341): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcgttgccgggcaagtcagagtgttagtatttatttaaattggtatcattcaaacaggaaacncccctaagctcctgatctatgctgctatccaagtttacaaaggtcgggtaccatcaagattcagtgcngtagatcgtagggacagtactttcgacttctacgacctatccgtaagttacgtaccttaacgaaaccttaggtaacgttattttacgacttaaaccgtttactacttagtaccaagtagtaacgttaacgaccttaccccctccgtcttacctacggtttaccgggacggtaaccgggaaccgtaagggtacggtaagacgttaaccgaaacgttaacgtggtacggtactcggacctaacctgttcccgttacg

SEQ ID NO: 285710 - DNA, 495 bp, Homo sapiens
  misc_feature: GYAE6OF01BL4L1.4.57.F02.1.454.CMB.1.raw
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctcttgccgggcaagtcagagtgttagtatttatttaaattggtatcagttcaaaccagggaaagcccctaagctcctgatctatgctgcatccagtttaacaagtggggtccatcaagattcagtgcagtggatctgggacagactttcactctcaccatcagtatctacaaccgtgaatatttcgactaacttactactgtacaacagtagttacgactacccctccgctctacgttcggcggaggaccgaggtgagatacgaagactgtacgcngcacntcg

SEQ ID NO: 285711 - DNA, 640 bp, Homo sapiens
  misc_feature: GYAE6OF01CH4SK.4.57.F02.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgganagtcagagtgttagtatttatttaaattgtatctagttacaaacgaggaacnccctaagctcctagactctatgtctgctactcctaagtttaacgaaaggttcgggtaccctaagtacaaagtacttacgaggtcggactaggtggactcggtagggactaggtactttcaacttcctacacctaattcgaagttacgtactaaaccaaccgttagtaagttacttttacgaaccttaaacctttacttacgtacgttaacaaacgtaaggttacgttaacccgtaccttaacccccgtccgtaccttacctacggtttccgggacgggtacgggtaaccgtaagggtcggaagtacgtaaaccggtaaaacggtacgttacgggtacggtacctacggaccctaaccgtgtttacccg

SEQ ID NO: 285712 - DNA, 507 bp, Homo sapiens
  misc_feature: GYAE6OF01D65QA.4.57.F02.1.454.CMB.1.raw
  modified_base (270)..(270): a, c, t, g, unknown or other
  misc_feature (270)..(270): n is a, c, g, or t
  modified_base (502)..(502): a, c, t, g, unknown or other
  misc_feature (502)..(502): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaancccctaagctcctgatctatgctgcatccagtttacaaagtgggtcccatcaagattcagtggcagtgatcgtgggacagtatttcactctcaccatcagtagtctaacaacctgaagtattttgactaacttactactgtacaacagtagttacgactacccctcgcttcacgtttcggcggacggaccaaggtcggagatacgaaacgaactgtcggtctagaccacctntctcg

SEQ ID NO: 285713 - DNA, 634 bp, Homo sapiens
  misc_feature: GYAE6OF01DF58O.4.57.F02.1.454.CMB.1.raw
  modified_base (204)..(204): a, c, t, g, unknown or other
  misc_feature (204)..(204): n is a, c, g, or t
tcagagcactgtagcacgaccggtgctcgatttagctcgatatagttggggtttggggagccagtctcagtcaggacacagcatggacatgagggtcccccgctcagctcctggggctcctgctactctggctccgagatgccagatgtgaccacccagatcgacccagtcctccatccctccctgtctgcatcgtggtggganacagagtcatcattctcttcggccggacaagtcagtagttagttagttatttaatttaattggtatcagttacaaccgaggaactccctaagcctctagatctatgctgctatccgtaagttaacaaggtcgggtaccaagtacaaagtacttacgagtggacgtaggtcggagttccggtagggaactacggttactttacctaaccgtccttaccaacctatacgtaagttactacctaacacgtagtaacgtttattcgtaacttaacttactaactcgtaacaacgtagtaacgttaccgtacctaccccgtcgtacttaccgtaccggtttacgggccgggaaacgggtaccgtaagggtacgaacgtaacgtaaccgaaacggtacgttacggtacggtacctggaaccctccgtagttacccg

SEQ ID NO: 285714 - DNA, 502 bp, Homo sapiens
  misc_feature: GYAE6OF01AVSA9.4.57.F02.1.454.CMB.1.raw
  modified_base (496)..(496): a, c, t, g, unknown or other
  misc_feature (496)..(496): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagatcagtggcagtggatctgggacagtatttcactctcaccatcagtagtctacaactgaagtattttgctaacttactactgtacaacagtagttacgacttacccctcgctcacctttcggcggacgggaccaggtaggacgatacgaacgaactgtcggctgacacngtctcg

SEQ ID NO: 285715 - DNA, 538 bp, Homo sapiens
  misc_feature: GYAE6OF01AX4ZC.4.57.F02.1.454.CMB.1.raw
  modified_base (274)..(274): a, c, t, g, unknown or other
  misc_feature (274)..(274): n is a, c, g, or t
  modified_base (414)..(414): a, c, t, g, unknown or other
  misc_feature (414)..(414): n is a, c, g, or t
  modified_base (495)..(495): a, c, t, g, unknown or other
  misc_feature (495)..(495): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaacagggaaacncccctaagctcctgatctatgctgcatcctagtttaacaaaggtcgggtaccatacaagtattcgagtggcgtagtggatcgtagggacagtactttcactctacaccatcaagtacgtctaacaactagaatactttanactaacttactactgtacacagtacttacacctaccctccgctacgtacgttcggacggacgggtaccagggtagacgtanacgtaaacgacgtagtacggcttacgacctactagttcgtacg

SEQ ID NO: 285716 - DNA, 546 bp, Homo sapiens
  misc_feature: GYAE6OF01DZVT4.4.57.F02.1.454.CMB.1.raw
  modified_base (539)..(539): a, c, t, g, unknown or other
  misc_feature (539)..(539): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaagcccctaagctctgatctatgctgcatccagtttacaaagtgggtccatcaagattcagtggcagtggatctggacagatttcactctcaccatcagtagtactacaacctgtaagtattttgactaacttactactgtacaacagagttaacgacttacccctccgacttccaacgtttccgggacggtacggggtacccaaagggttcgggaagtacgttaaccgaaaacgtaaacgttacggtacggactaggtaccaacccgtnttacccg

SEQ ID NO: 285717 - DNA, 485 bp, Homo sapiens
  misc_feature: GYAE6OF01EBAIY.4.57.F02.1.454.CMB.1.raw
  modified_base (480)..(480): a, c, t, g, unknown or other
  misc_feature (480)..(480): n is a, c, g, or t
  modified_base (482)..(482): a, c, t, g, unknown or other
  misc_feature (482)..(482): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaacaggaagccctaagctcctgatctatgctgcatccagttacaaagtgggtccatcaagattcagtgcagtgatctggacagtatttcactctcaccatcagtagtctaacaacctgaagtattttgctaacttactactgtacaacagtattacgactacccctcgctctacgttcggacggacggaccaaggtgagatacaaacgatgtcgctgcncntcg

SEQ ID NO: 285718 - DNA, 537 bp, Homo sapiens
  misc_feature: GYAE6OF01BGZ7D.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagccctaagctcctgatctatgctgcatccagtttacaaagtgggtccatacaagattcagtggcaggtgatctggacagattcactctacaccatcagtagtctacaacctgaagtatttgactaacttactactgtacaactacgtagttaacgacttacccctcgtactactacgtttccgggacggagggtaacccgtaagggttcggaagacgttacgaaaaccggtaaattcggtacggtctagccgtaaccaagttccg

SEQ ID NO: 285719 - DNA, 571 bp, Homo sapiens
  misc_feature: GYAE6OF01D0CTT.4.57.F02.1.454.CMB.1.raw
  modified_base (275)..(275): a, c, t, g, unknown or other
  misc_feature (275)..(275): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatcctcgtttccgggcaagtcagtagtgttagtatttatttaaattggtatcagttcaaacaggaaanccctaagctcctgatctatgctgcatccagttacaaagtcgggtccatcaagatcagtgcagtgatcgtggacagtatttcgactctacacctatcaagtacgtactaactaacctagaagttattttacgactaactttactacttagtacaactagtaacgttacgacttaccccctcgtaccttacgtaccgtttccgggacgggtaacgggaacccgtaaagggttcggaacgtaagtaccgaaaaacggtaacgtggtacggtacctagaccctacctagttctttaccgg

SEQ ID NO: 285720 - DNA, 593 bp, Homo sapiens
  misc_feature: GYAE6OF01ESQJJ.4.57.F02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccacccagatcgacccagtctccatcctccctgtctgcatctggtggganacagngtcatcatctcttggccggnaagtcagtgtgttagtatttattaaattggtatcattacaaacgaggaacncccctaagcctctgatctatcgctgcatcctaagtttaacaaggtcgggtacccatacaagtattcgagtggcaggtgactcgtggacagtattcactctcacatctagtatacctaacactagtaagttactttcgactaactttactactacgtacaactaacgtaacgttaaccgtaccttaccccctccggtacttaccgtaccggtttaccgggacgggtaacgggaaccgtaaggggttcggaacgtaacgtaaccgtaaaacggtaccgtagggtaccggtactacgtaacccgaacttacgtccttaacgg

SEQ ID NO: 285721 - DNA, 552 bp, Homo sapiens
  misc_feature: GYAE6OF01DOAMX.4.57.F02.1.454.CMB.1.raw
  modified_base (223)..(223): a, c, t, g, unknown or other
  misc_feature (223)..(223): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttggccgggnaagtcagagtgttagtatttatttaaattggtatcagttacaaacaggaacgccctaagctcctgatctatgctgcatccagtttacaaagtggggtccatcaagattcagtggcagtggatcgtgggacaggtatttcacttctcaacctatacagttagtactaacaaccctagaagtattttgactaactttactactgtacaaacagtaagttacgacttacccctccgcctctacgtttcggacggacgggacccgaagggtcggaagactaacgaaaaccggtaactacggttacggacttaggaccctaccgtattacccgg

SEQ ID NO: 285722 - DNA, 526 bp, Homo sapiens
  misc_feature: GYAE6OF01ECFT1.4.57.F02.1.454.CMB.1.raw
  modified_base (221)..(221): a, c, t, g, unknown or other
  misc_feature (221)..(221): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaacaggaaagccctaagctctgatctatgctgcatccagtttacaaagtgggtccatcaagattcagtggcagtggatctggacagtatttcactctcacatcagtagtctacaacctgaagtattttgactaacttactactgtcaaacagtagttacgactacccctcgacttctacgtttccgggacggtacgggacccgtaagggtacggaagtactaccaaaacgtaactcggtacggactagacctaccgagttaccg

SEQ ID NO: 285723 - DNA, 597 bp, Homo sapiens
  misc_feature: GYAE6OF01EP3EQ.4.57.F02.1.454.CMB.1.raw
  modified_base (227)..(227): a, c, t, g, unknown or other
  misc_feature (227)..(227): n is a, c, g, or t
tcagagcactgtagcacgaccggtgctcgatttagctcgatatagttggggtttggggagccagtctcagtcaggacacagcatggacatgagggtccccgctcagctcctggggctcctgctactctggctccgagatgccagatgtgacacccagatgacccagtctccatcctccctgtctgcatcgtgtgggagacagagtcatcatctcgttggcccggganaagtcagtagttgttagttattttaatttaaagttggtatacgtagttacaaaccgagggaaacgccctaagcctcctgactctatgctgctactctaagtttaacgaaaggtcgggtaccatacgaagtacttacgaggtggactaggtgtagtcgtaggactagtactttcactctacacctatactagtactactaactaaccgtagtaattattacgactaactttactacgtagtacaagtagtaacgttaccgtacctaccccgtccgtcttacctaccggttcgggaccgggtacgggaacccgtaagggtcggaagtacgtaacgaaacgtaagtcggtcggactacggacctactgttacg

SEQ ID NO: 285724 - DNA, 511 bp, Homo sapiens
  misc_feature: GYAE6OF01DHS77.4.57.F02.1.454.CMB.1.raw
  modified_base (196)..(196): a, c, t, g, unknown or other
  misc_feature (196)..(196): n is a, c, g, or t
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
tcagagcactgtagcacgaccggtgctcgatttagctcgatatagttgggtttggggagccagtctcagtcatgacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaaccagggaaagcccctaagctcctgatctatgctgcatccagtttacaagtggggtcccatcaagattcagtggcagtggatcgtgggacagtatttcactctacacatcagtagtctacaacctgaagtatttgactaacttactactgtacaacagtacgttacgactacccctcgtctcgtactttcgggacggagggaccgaaggtaggaganactaaacgaacttggtacgcgtcgcncgtac

SEQ ID NO: 285725 - DNA, 649 bp, Homo sapiens
  misc_feature: GYAE6OF01BIJAI.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatccctccctgtctgcatctggtgggagacagagtcatcatctcttgccgggcaagtcagtagtgttagttatttatttaaattggtatcagttacaaaccgagggaaacaccctaagctcctgatctatgctgcatcctaagtttaacgaaaggtcgggtacccaatacaaagtattcgagtggactaggtaggtatcgtagggaactagtactttacacttcctacacctatacgtagttacgtacctaactaaccgtagtaaagttatttacgtaaccttaactttattaacgttagtaacctaaactaacgttaacttttaaaagttaacgtttaaccgccgttaccgttacgtaaccggtttcgggaaccggggtaacgggaaaccggtaaagggtacggaagtaacgttaaaccggtaaaaccgtaacggttacggttacggaccttaggaaccctaaccgtacgtttaccg

SEQ ID NO: 285726 - DNA, 619 bp, Homo sapiens
  misc_feature: GYAE6OF01AIKZX.4.57.F02.1.454.CMB.1.raw
  modified_base (196)..(196): a, c, t, g, unknown or other
  misc_feature (196)..(196): n is a, c, g, or t
  modified_base (277)..(277): a, c, t, g, unknown or other
  misc_feature (277)..(277): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagttatttatttaaattggtatcagttacaaacgagggaaacnccctaagctcctgatctatgctgcatcctagtttacaaggtcgggtccaatcaagtatacgagtgcaggtggatcgtggactagtatttcactctaccacctatacgtagtacgtactaacaaccgtagtaacttagtttcgaaccttaactttactacttacgtaaccgtaaactacggttaacgttaaccctaccgttaccccccgtccgtacccttaccgttacggtttccgggaccgggtaaccgggtaaccgtaacgggttaggaacggtaacgttaaccgaaaaccgtaacggttacggtacgggtaccttacggaaccctaccgtagtttacccg

SEQ ID NO: 285727 - DNA, 620 bp, Homo sapiens
  misc_feature: GYAE6OF01CR2HX.4.57.F02.1.454.CMB.1.raw
  modified_base (221)..(221): a, c, t, g, unknown or other
  misc_feature (221)..(221): n is a, c, g, or t
  modified_base (271)..(271): a, c, t, g, unknown or other
  misc_feature (271)..(271): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaattgtatcagttacaaacaggaacnccctaagctcctgatctatgctgcatacctagtttaacgaaaggtcgggtacccatacgaaagtattcgagtggcagtggatcgtggactagtatttcacttctacacctatcaagttacgtactaacaccgttagaaagttacttttacgaccttaacctttaactacttacgttaactaacgtaaggtaaccgtttaaccgtaccttacccccttccgtcccttactaacccggttttccggggaaccgggtaacggggtaaccgtaacggggttacgggaagtaaacgttaccgaaaacggtaacgttacggtaccggacgtacggaccctaccgtagtttacccg

SEQ ID NO: 285728 - DNA, 606 bp, Homo sapiens
  misc_feature: GYAE6OF01BU8HW.4.57.F02.1.454.CMB.1.raw
  modified_base (434)..(434): a, c, t, g, unknown or other
  misc_feature (434)..(434): n is a, c, g, or t
tcagagcactgtagcacgaccggtgctcgatttagctcgatatagttggggttttgggggtaggccacgtctcagtcaggacacagcatggacatgagggtcccccgcctcagctcctggggctcctgctactctggctccgagatgccagatgtgacacccagatgacccagtctccatcctccctgtctgcatctgtgggagacagagtcatcatctcgtgccgggcaagtcagagtgttagttatttatttaaattggtatctagttactaaaccaagggaaacgacccctaacgctcctgatctatgtctgcactcctacgtttaacgaaagtcggggtcccatacaagtattcctagtgggtctaggtggatcgtggacagtatttcacctctacacctatactagtacgtcctaacaacctgtaagtnttttcgacctaacttacttactgtaccaaacgtacgtacgttaaccgtactaaccccccttccgcttacctaccgtttccgggccgggaacgggaacccgtaagggtgggtaacgacttaaccgaaaccggtaacgttcggtcggtaccttaggaccctaccgtctttaccg

SEQ ID NO: 285729 - DNA, 543 bp, Homo sapiens
  misc_feature: GYAE6OF01AMS9M.4.57.F02.1.454.CMB.1.raw
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccgaggaaanccctaagctcctgatctatgctgcatccagtttacaaagtcgggtccatcaagtattcagtggcagtggatcgtaggacagtatttcactctacacctatcagtacgtctaacaacctgaatatttagacaactttactactgtacaaactagtacgttaccgacttacccctccgtctctaaccgtttcggacgggtacgggaccgaaggtcggaagtagtaccgaaaacgtaacgttaggtacggactagacctaccgtagttaccg

SEQ ID NO: 285730 - DNA, 564 bp, Homo sapiens
  misc_feature: GYAE6OF01C8CU5.4.57.F02.1.454.CMB.1.raw
  modified_base (316)..(316): a, c, t, g, unknown or other
  misc_feature (316)..(316): n is a, c, g, or t
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
tcagagcactgtagcacgaccggtgctcgatttagctcgatatagttgggtttgggggccagtctcagtcaggacacagcatggacatgacgggtccccgctcagctcctggggctcctgctactctgggctccgagatgccagatgtgacacccagactcgacccagtcctccatccctccctgtcgtgccatcgtggtgggagacagagtctatcagtctcgttcgaccgggcaagtcagtagtgttagtatttattaattggtatctagtacgaaacgtaggaactaccgtaagcgtctagactactactcgntcgctactcctaagttacaaaggtcggtacagtactaagtattcgaggtgcgtagtggaatcgtggactagtactcactcgtacactgtactagtatacaacgaacgtagaacgttnttagactaattactacgtntacgaactaagagttaccgtactacccctcgctactcgttcggacggaggtacccgaaggtcgaagataacgaaacgtaacgtcgtacgtactagaccacgtacttgtaccg

SEQ ID NO: 285731 - DNA, 642 bp, Homo sapiens
  misc_feature: GYAE6OF01B4NTD.4.57.F02.1.454.CMB.1.raw
  modified_base (297)..(297): a, c, t, g, unknown or other
  misc_feature (297)..(297): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgaccacccagatcgacccagtcctccatccctccctgtcctgcatcgtggtgggagacagagtcatcatctcgttcggccgggacaagtcagtagttgttaagttatttaatttaagttggtatactagttacaaaccgaagggaaacncccctaagcctcctgtactctatgctgctatccgtagttaacgaaggtcggtaccagtacaagtacttcgaggtcgctaggtcggatcgtaggacagtacttcactctacactatacagttacgtactaacactagaattatttcgactaacgttactactacgtaacaacgtaacgtacgttaacccgtaccttacccccgtacgtaccgttaccgtacccggtttaccggggaccgggtaaacgggtaaaccgtaggggttacggaaagtaaccggttaaccgaaaaccggtaaggtttcggaacgggttccctaacggtacccgtaaaccgttcgtttaccg

SEQ ID NO: 285732 - DNA, 596 bp, Homo sapiens
  misc_feature: GYAE6OF01AS7EN.4.57.F02.1.454.CMB.1.raw
  modified_base (195)..(195): a, c, t, g, unknown or other
  misc_feature (195)..(195): n is a, c, g, or t
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagtagtgttagtatttatttaaattggtatcagttcaaaccagggaaancccctaagctcctgatctatgctgcatccagtttacaaagtgggtacccatcaagattcagtggcagtggatcngggacagatttcactctcaccatcagtacgtactacaacctgaagtatttcgactaacttactactgtacctaacgagtaacgttaaccgacttaccccctccgtaccttacctaccgttttaccgggaccgggtaacgggtaacccgtaaaggggttacgggaacgtaagttaacccgtaaaaaccggtaaaccgttaggttaacggggtccttacggaccctaacccgtacgtttccgtttaccgg

SEQ ID NO: 285733 - DNA, 492 bp, Homo sapiens
  misc_feature: GYAE6OF01EMYOD.4.57.F02.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
  modified_base (484)..(484): a, c, t, g, unknown or other
  misc_feature (484)..(484): n is a, c, g, or t
  modified_base (487)..(487): a, c, t, g, unknown or other
  misc_feature (487)..(487): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaacaggaagcccctaagctctgatctatgctgcatcctagtttacaaagtgggtcccatcaagattcagtggcagtggatcgtgggactagtatttcactctacaccatcagtagtctaacaacctgaatatttcgactaacttactactgtacaanagattacgatacccctcnctcacttcggcggacggacaaggtggatanacaagacgtgngctgacnctntctcg

SEQ ID NO: 285734 - DNA, 542 bp, Homo sapiens
  misc_feature: GYAE6OF01BVN0S.4.57.F02.1.454.CMB.1.raw
  modified_base (195)..(195): a, c, t, g, unknown or other
  misc_feature (195)..(195): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggcaagtcagagtgttagtatttattaattgtatcagttacaaaccgaggaacgccctaagctcctgatctatgctgctatacctagttaacaaaggtcgggtccatacaagtattacgagtggacgtagtggtatcgtggacagtattctactctcactactactagtatactaactaactagtaagtattagtactaactacttactatactaactagtagtacgtactaccctaccgtctactacttcggtacggaggaccccccccccgaggtacggagacgtacgaacgaacgtacggtcgtacgtacgactctagtacg

SEQ ID NO: 285735 - DNA, 537 bp, Homo sapiens
  misc_feature: GYAE6OF01A9VDC.4.57.F02.1.454.CMB.1.raw
  modified_base (222)..(222): a, c, t, g, unknown or other
  misc_feature (222)..(222): n is a, c, g, or t
  modified_base (274)..(274): a, c, t, g, unknown or other
  misc_feature (274)..(274): n is a, c, g, or t
tcagagcactgtagcacgaccggtgctcgatttagctcgatataggttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttattaaattggtatcagttacaaacaggaaacncccctaagctcctgactctatgctgctatcctagtttacaaaggtcggtaccatcaagtattcgagtggcaggtgatcgtggactagtattcactctcacatcgtaatacgtactaacaactagtaattatttacgactaacgttactactacgtacaactagtacgttacgacttacccctcgctaccgtacgtttcggacggtacggaaccgtaagggtcgaagtatacgaaacgtactggtcgactagactactgttacg

SEQ ID NO: 285736 - DNA, 587 bp, Homo sapiens
  misc_feature: GYAE6OF01DKO13.4.57.F02.1.454.CMB.1.raw
  modified_base (193)..(193): a, c, t, g, unknown or other
  misc_feature (193)..(193): n is a, c, g, or t
  modified_base (578)..(578): a, c, t, g, unknown or other
  misc_feature (578)..(578): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctcctgtctgcatctgtggganacagagtcatcatctctgccgggacaagtcagagttagttagttaattttaatttaaattggtatcagttacaaaccgaggaaacgcccctaagctcctagtatctatgctgcatacctaagtttaacaaaggtcgggtacccaatcaaagtattacaggtgacgtaaggtggaactcgtagggactagtactttacactctaccactatcaagtacgtactaacaaactgtaagttatttacgactaactttactactgtacaacgtaagtacgttaaccgtaccttacccctccgtcttaccgtacgtttcgggaccgggtaacggaccgaagggtggaaacgtactaacgaaaaccgagttggacggtctacgaccaacctnttcgttacg

SEQ ID NO: 285737 - DNA, 613 bp, Homo sapiens
  misc_feature: GYAE6OF01B6ZPJ.4.57.F02.1.454.CMB.1.raw
  modified_base (195)..(195): a, c, t, g, unknown or other
  misc_feature (195)..(195): n is a, c, g, or t
  modified_base (572)..(572): a, c, t, g, unknown or other
  misc_feature (572)..(572): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttcggccggcaagtcagagtagttagttattttaatttaaagttggtatctagttacaaaccgaggaaacgcccctaagcctcctagatctatcgctgctataccgtagtttaacgaaaggtcgggtacccagtacaagtacttcgaggtgacgtagtaggtatcgtagggtactagtactttaccacgttacctaccacctactacgtagttaacgttacctaaccgtaaccgttagtaagtttactttacgaaccttaactttactaactctaacaacgtagtaacgttacctaccgttacccctcgtaccttaccgtacggttacggacggtacgggaaccgtagggtacgacgtaanacggtaaacgtacgtgtcgacgtcgacctactgttcttacg

SEQ ID NO: 285738 - DNA, 546 bp, Homo sapiens
  misc_feature: GYAE6OF01BWLNA.4.57.F02.1.454.CMB.1.raw
  modified_base (195)..(195): a, c, t, g, unknown or other
  misc_feature (195)..(195): n is a, c, g, or t
  modified_base (269)..(269): a, c, t, g, unknown or other
  misc_feature (269)..(269): n is a, c, g, or t
  modified_base (538)..(538): a, c, t, g, unknown or other
  misc_feature (538)..(538): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttattaaattggtatcagttcaaacaggaaancccctaagctcctgatctatgctgcatcctaagtttacaaaggtcgggtaccatacaagtattcgagtgcaggtgatcgtgggacagtatttcactctacaccagtcagttagtactacaaacctgtaacgtatttacgacttaacttaactactagtaccaactagtaacgttaaccgactaccccctctaccttactacgtttccggacggacggaccgtaaagggtcgaagtactacgaaacgtaagtcgtaggctacggactacnttcgtacg

SEQ ID NO: 285739 - DNA, 854 bp, Homo sapiens
  misc_feature: GYAE6OF01CG1D7.4.57.F02.1.454.CMB.1.raw
  modified_base (290)..(290): a, c, t, g, unknown or other
  misc_feature (290)..(290): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgacacccagatgacccagtctccatccctcctgtctgcatcgtgtgggagacagagtcatcatctcgttggccgggacaagtcagtagttagttagttatttaatttaaagttggttatctagttacaaacgtagggaaacncccctaagctacctagactctatcgctagctactacctaagtttaacgaaaaggtcgggtaccctaagtacctaaagtagtttaccgaagggtttcgggaccgtaagggttaggggtaacgttacccgggttaaggggggtaaacccttaaagggtttaaccgtttttaacccgttaacccgtttaacccgttaacccctaaaacccccgttaaacggtttacccgtaaaacgggtttaaaccggtttaacccttaaaaccccgtaaaacccgtttaacggggtaaaaacgttttacgttttttaaccggaaaccctttaaaacccgttttaaacctttaaccgttaaaccggttaaccctaaaaccggttaaacggttaccggtttaaaacccgtaaccccttaaccccccgttccgtaacccgttaccgttaaccggttttaccggggaacggggtaaaccgggtaaaccgtaaacgggggtacggtaaacggtaacgtaaaccggtaaaaccgttaacggtcggtacgggtaccttacggaccctaaccgtacgtttaccg

SEQ ID NO: 285740 - DNA, 630 bp, Homo sapiens
  misc_feature: GYAE6OF01BTJHA.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagttattttattaaattggtatctagttacaaaccgagggaaacgcccctaagctcctgactctatgctgctactcctaagtttaacaaaggtcgggtaccatacgaaagtacttcgagtggcgtaggtggtatcgtagggactagtatttcacgttctactacctatcgtaagttacgtactaacaaccgttagtaaagttattttacgacttaactttactaactacgtacaacgtaagtacgttaacctacctacccccgttcgtaccttaccgtaaccggtttcgggaccgggtaaacgggtaacccgtaaggggttaggtaacgaacgttaaccgaaaaccgggtaaacgttcgggtacggaccgttagaccctaacccgtgtttacccgg

SEQ ID NO: 285741 - DNA, 542 bp, Homo sapiens
  misc_feature: GYAE6OF01AY98B.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccgggnaagtcagagtgttagtatttatttaattggtatcagttcaaacagggaaagcccctaagctcctgatctatgactgcatcagtttacaagtcgggccatcaagatcagtggcaggtggatcgtagggacagtatttcactctcaccatcagtatactacaacctgaagtatttgactaacttactacttagtacaacgtagtagttaaccgtacttacccccgtcgaccttacctacgtttccgggcggtacgggaaccgtaaggggtaggacgtaataccgaaacggtaactaggtacggtactagaccacctatcgttacg

SEQ ID NO: 285742 - DNA, 568 bp, Homo sapiens
  misc_feature: GYAE6OF01CLXGU.4.57.F02.1.454.CMB.1.raw
  modified_base (406)..(406): a, c, t, g, unknown or other
  misc_feature (406)..(406): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcgttgccgggacaagtcagagtgttagtatttatttaaattggtatcagttacaaaaccagggaaacgcccctaagcctcctgactctatgctgcatcctagtttacgaaagtcgggtaccatcaagtatcagtgcagtggatcgtggacagtatttcactctcaccatcagtatactaacacctagaagttntttacgactaacgttactactagtacaacgtagtaacgttaccgtacttaccccgtcctctaccgtacgtttccgggacgggtacgggtaaccgtaagggtcggaagtaacgtaccgaaaacggtaactcgggtacggacgtaggacccacctagttacccg

SEQ ID NO: 285743 - DNA, 616 bp, Homo sapiens
  misc_feature: GYAE6OF01CU59A.4.57.F02.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (281)..(281): a, c, t, g, unknown or other
  misc_feature (281)..(281): n is a, c, g, or t
  modified_base (372)..(372): a, c, t, g, unknown or other
  misc_feature (372)..(372): n is a, c, g, or t
  modified_base (388)..(388): a, c, t, g, unknown or other
  misc_feature (388)..(388): n is a, c, g, or t
tcagagcactgtagcacgaccggtgctcgatttagctcgatatagttgggttgggggccagtctcagtcaggacacagcatggacatgaggtccccgctcagctcctggggctcctgctactctggctccgagatgccagatgtgacacccagatcgacccagtcctccatccctccctgtctgcatcgtggtggganacagagtcatcatctcgtgccgganagtcagtagttgttagtattttaattaattggtatctagttacaaacgtagggaaacnccctaagctcctgatctatgctgcatcctaagtttacgaaaggtcgggtaccatacaagtactcgagtgacagtggatcgtaggactagtnttacgactctacactntacgtagtacgtacctaacgaccgttagaacttagtttacaaccttaaacttactacgttagtaaccaaacgtaggtaaccgttacccgtaacccttacccccgttacgccttaccgtaccggtttaccgggacgggttaaccgggacccgtaagggtacggtaacgtaacgttaaccggaaacgtaccgttggacggtaccgtacgaccctactacgttcgttaccg

SEQ ID NO: 285744 - DNA, 569 bp, Homo sapiens
  misc_feature: GYAE6OF01B5BZN.4.57.F02.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcttgccggnaagtcagngtgttagtatttatttaaattggtatcagttcaaaccagggaaancccctaagctcctgatctatgctgcatccagtttacaagtgggtcccatcaagattcagtggcagtggatcgtgggacagtatttcactctcaccatcagtacgtctaacaacctgaagtattttcgactaacttactactcgtacaactagtaacgttaacgacttacccccgtccgtcctaccgtacctttcgggaccgggtaacgggtacccgtaagggtcgggaacgtagtaaccggaaaaccggtaaccgtaggtacggaccgttagacccgaacctagttccgtttacg

SEQ ID NO: 285745 - DNA, 655 bp, Homo sapiens
  misc_feature: GYAE6OF01CYO07.4.57.F02.1.454.CMB.1.raw
  modified_base (227)..(227): a, c, t, g, unknown or other
  misc_feature (227)..(227): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccacccagatcgacccagtcctccatccctccctgtctgcatctggtgggagacagagtcatcatctcgtggccggganaaggtcagtagttgttaagttatttaatttaagttggtatctaagttacaaacgagggaacaccctaagtcctcctgtactcgtatcgactgactactaccgtaagtttaacgaaacgggtcgggtacctatacgtaagtactttacgaggttcggcgtaagggtggtacttcggtagggactagttacttacgaacttcctactactacgtacgtaagtacgtacctaacgtaaccttaggtaaacgttacgttttacgaacttaacctttacgttaacgtacttaaccgaaaccgtagtaacgttaacccgtaaccctaccccgtacctcttaccgtacgttccgggacggtaacggaccgtaaggacggtacgtaagtaaccgaaacggtagtcggtacgcgttacgacctactagtccgttacg

SEQ ID NO: 285746 - DNA, 528 bp, Homo sapiens
  misc_feature: GYAE6OF01ED6L6.4.57.F02.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (271)..(271): a, c, t, g, unknown or other
  misc_feature (271)..(271): n is a, c, g, or t
  modified_base (522)..(522): a, c, t, g, unknown or other
  misc_feature (522)..(522): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccgggnaagtcagagtgttagtattttattaaattggtatcagttcaaacaggaaanccctaagctcctgatctatgctgcatccagtttacaaagtcgggtccatcaagattcgagtggcagtggatcgtgggactagtatttcacttctcacatcagtagtactaacaacctagaagtattttgactaacctttactactgtacaacagtagttacgacttacccctcgactctacgtttccggcggtacgggaccaagggtcggaagtactacaaaaccgtacgtacgtcggctagaccaccgtnttaccg

SEQ ID NO: 285747 - DNA, 524 bp, Homo sapiens
  misc_feature: GYAE6OF01A9DRO.4.57.F02.1.454.CMB.1.raw
  modified_base (196)..(196): a, c, t, g, unknown or other
  misc_feature (196)..(196): n is a, c, g, or t
  modified_base (422)..(422): a, c, t, g, unknown or other
  misc_feature (422)..(422): n is a, c, g, or t
  modified_base (488)..(488): a, c, t, g, unknown or other
  misc_feature (488)..(488): n is a, c, g, or t
  modified_base (518)..(518): a, c, t, g, unknown or other
  misc_feature (518)..(518): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcttgccgggcaagtcagagtgttagtatttattaaattggtatcagttcaaacaggaagccctaagctccgtgatctatgctgcatcctagtttaacgaaaggtcgggtacccagtacaagtattcgagtggctaggtggatcgtagggactagtatttcactctacaccatcagtatctacaactagaatatttgactaacttactactntaccaacagtaagttacgacctacccctcgtctctacgttcggcggacgggacgaggtacgagtanacgaaacgacgtgtacggctacgacacctntcgtcg

SEQ ID NO: 285748 - DNA, 501 bp, Homo sapiens
  misc_feature: GYAE6OF01AYBH6.4.57.F02.1.454.CMB.1.raw
  modified_base (438)..(438): a, c, t, g, unknown or other
  misc_feature (438)..(438): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggcaagtcagagtgttagtatttatttaaatggtatcagttcaaaccagggaaagcccctaagctcctgatctatgctgcatccagtttacaaagtgggtcccatcaagatcagtggcagtggatcgtgggacagtatttcactctcacatcagtatctacaacctgaagtattttgactaacttacctactctacaacagtagttacgactacccgtccnctactacgttcggcggaggaccgaaggtcgtagatacaaacgactgtcgcngacacntctacg

SEQ ID NO: 285749 - DNA, 538 bp, Homo sapiens
  misc_feature: GYAE6OF01BDTI8.4.57.F02.1.454.CMB.1.raw
  modified_base (448)..(448): a, c, t, g, unknown or other
  misc_feature (448)..(448): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggacagtcagagtgttagttattttatttaaattggtatcagttacaaacgagggaaacgtccctaagctcctagatctatgctgcatcagttacaagtcgggtccatcaagtattcgagtggctaggtggtatcgtaggacagtattcactctacactatactagtactctaacactagatatttgactacttactactgtacaacgagtacgtacgtactcccctcnctacctacgttcgggaccggtacggtaaccgtagggtacggagtaataccgaaacgtacgtaggtacgtactagtaccaccgtgttaccg

SEQ ID NO: 285750 - DNA, 514 bp, Homo sapiens
  misc_feature: GYAE6OF01EVASH.4.57.F02.1.454.CMB.1.raw
  modified_base (420)..(420): a, c, t, g, unknown or other
  misc_feature (420)..(420): n is a, c, g, or t
  modified_base (508)..(508): a, c, t, g, unknown or other
  misc_feature (508)..(508): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattgtatcagttcaaacaggaagcccctaagctcctgatctatgctgcatccaagtttacaaagtgggtacccatacaagtattcagtggcagtggatcgtgggacagtatttcactctcaccatcagtacgtactaacaacctgaatatttagactaacttactactgtacaanagtacgttacgacttacccctcgctctacgtttcggcggtagggaccaaggtaggagtatacgaaacgacgtgtacgctagacacctntcgtcg

SEQ ID NO: 285751 - DNA, 551 bp, Homo sapiens
  misc_feature: GYAE6OF01DXER3.4.57.F02.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (280)..(280): a, c, t, g, unknown or other
  misc_feature (280)..(280): n is a, c, g, or t
  modified_base (544)..(544): a, c, t, g, unknown or other
  misc_feature (544)..(544): n is a, c, g, or t
tcagagcactgtagcacgaccggtgctcgatttagctcgatatagttggggtttgggggagccagtctcagtcaggacacagcatggacatgagggtccccgctcagctcctgggggctcctgctactctggctccgagatgccagatgtgacacccagatgacccagtctccatcctccctgtctgcatctggtggganacagagtcatcatctcttgccgggnaagtcagagtgttagtattttatttaaattggtatnagttacaaacgagggaacnccctaagctctgatctatgctgcatcctagtttaacaaggtcgggtccatacaagtattcagtggcaggtggatcgtgggacagtatttcactcctacaccatctagtagtactaacaacctgaatattttgacttaacttactactagtacaaactagtaacgttacgacttacccctcgtcctacgtacgtttcgggacggacgggtaccgaagggtggaagtactacgaaaacgacgttacggtcggactaggacctacgngttaccg

SEQ ID NO: 285752 - DNA, 666 bp, Homo sapiens
  misc_feature: GYAE6OF01DMRA1.4.57.F02.1.454.CMB.1.raw
  modified_base (203)..(203): a, c, t, g, unknown or other
  misc_feature (203)..(203): n is a, c, g, or t
tcagagcactgtagcacgaccggtgctcgatttagctcgatatagttgggtttggggagccagtctcagtcaggacacagcatggacatgagggtccccgctcaggctccgtggggctcctgctactctggctccgagatgccagatgtgaccacccagatcgacccagtcctccatccctcctgtctgcatcgtggtggganacagagtcatcatctcgtcggccggacaagtcagtagttgttagttaatttaatttaaagtggtatctagttacaaacgaggaactccctaagtcctctgactctatgctgactactacgtaagttaacgaaacggttcggtaccctaatacgaaagtacttaccgaggtcggtacgtaggttggacttcggtagggtaactaggttaacctttacctaccgttacctaccgtaaccgtagttacgtaacgttacgtaacctaacgtaaccgttagtaagtttacttttaccgaacttaactttacgtaactacgtaactaacggtaacgtacgttaacccgtaccttaccccgtacgtaccttaccgttaccggttaccgggacgggtaaccggtaacgtaacgggtcgaagtacgtaacgaaacgtacgtcggtacgtactagacccttacgtcgttaccg

SEQ ID NO: 285753 - DNA, 562 bp, Homo sapiens
  misc_feature: GYAE6OF01DD0U4.4.57.F02.1.454.CMB.1.raw
  modified_base (221)..(221): a, c, t, g, unknown or other
  misc_feature (221)..(221): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccggganaagtcagagtgtagtatttatttaaattggtatctagttcaaacaggaaacgccctaaagctcctgatctatgctgctatacctagtttacaaagtcggggtacccatacaaagtattcaggttaggcaggtggagtcgtgggaactaggactttcgacttcctcaccatacagtagtctaacacctagaagtatttgactaacgttactactntacaaanagacgttacgtactacccctcctactccacgtttaccggcgggaacgggacccgtaaagggtcggaaggtacgtacaaaaaccggtacttacggtaggtacctgaccaccgtattaccgg

SEQ ID NO: 285754 - DNA, 623 bp, Homo sapiens
  misc_feature: GYAE6OF01CUE72.4.57.F02.1.454.CMB.1.raw
  modified_base (195)..(195): a, c, t, g, unknown or other
  misc_feature (195)..(195): n is a, c, g, or t
  modified_base (268)..(268): a, c, t, g, unknown or other
  misc_feature (268)..(268): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttggccggcaagtcagagtgttagtatttattaattgtatcagttcaacgaggaacnccctaagctcctagatctatgctgcatcctagtttacaaaggtcgggtaccatacaagtattcgagtggacaggtggatcgtagggactagtattcactctacacctatctagtacgtactaactaacctagtaagttattttacgacctaactttacctacttagtaacctaacgtaagtaacgttaaccgtaccctacccccgttccgtaccttccgttaccgtttaccgggaccggggtaacggaaccggtagggtacgggtaaacgttaaccgtaaaccggtaaaacccggtacggttacggttacgggtccgtaaccgtaccgtaacccgttaccgttcgtttaacccgg

SEQ ID NO: 285755 - DNA, 538 bp, Homo sapiens
  misc_feature: GYAE6OF01ATX22.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagcagagtcatcatctcttgccgggcaagtcagagtgttagtatttatttaaattggtatcagttcaaaccagggaaacgcccctaagctcctgatctatgctgcatccagtttacaaagtgggtcccatcaagattcagtggcaggtggatcgtgggactagtatttcactctacaccatacagtagtcctaacaacctagaagtattttagacctaacttacctactagtaccaacagtaacgttacgacctaccccctccgtacttctaccgtttcggcggtagggacccgtaaggtcggagatacgaaacgtaccgtgtcggactgaccacctatcgttcg

SEQ ID NO: 285756 - DNA, 625 bp, Homo sapiens
  misc_feature: GYAE6OF01EZSTX.4.57.F02.1.454.CMB.1.raw
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (544)..(544): a, c, t, g, unknown or other
  misc_feature (544)..(544): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctcttgccgggcaagtcagagtgttagtatttatttaattgtatctagttacaaccaacggnaaaacgacccctaacgtactcctagtatacttatgtctcgactactacctacgtttaacgtaaacggtacgggtacccgtaactacgtaagtattacgtagtaggtacgtaggtaggtacgtacgtagggtacgtacgtacttactacctactaccacctactacattagtacntaancctaacccttacgaagtaatttttacgtacctaaacctttaaccttaactacgtacctaaccaacgtacgttaacgtacttacccctacccgtccntccgtaccgtttaccgggtccgggtacgggaacccgtaaacgggtacggtaacggaataccgtaaaccgtaaaccgtacgg

SEQ ID NO: 285757 - DNA, 696 bp, Homo sapiens
  misc_feature: GYAE6OF01E31AX.4.57.F02.1.454.CMB.1.raw
  modified_base (204)..(204): a, c, t, g, unknown or other
  misc_feature (204)..(204): n is a, c, g, or t
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtgaccacccagatcgacccagtcctccactccctccctgtctgcatcgtggtggganacagagtcatcattcctcgttcggccgggacaagtcagtagttagtttagttattttaatttaattggtatctagttacaaaccgaagggaaaccacccctaagtcctctagtactctagtcgctgactactactagtttaacgaaggtcggtaccatacgaagtatacgaggtcgacgtaggtagtacgtcggtaggtaactagttacgtttacctacgttacctacccaacctagttaccgtaacggttaacgtacctaaccgtaacctaggttaagttacttttacgaaccttaacctttacttacgttacgtaaccgtaacgtaacggttaccgttaaccgtaacccgttaaccccctcccgttaccttacccgtaccgggtttaccgggaccgggtaaaccgggtaaccggtaaagggtcggtaacgtaacgtaaccgaaaaccggtacgttcgggtacggtacctacgaccctaccgtcgttaccg

SEQ ID NO: 285758 - DNA, 500 bp, Homo sapiens
  misc_feature: GYAE6OF01E3ZD1.4.57.F02.1.454.CMB.1.raw
  modified_base (417)..(417): a, c, t, g, unknown or other
  misc_feature (417)..(417): n is a, c, g, or t
  modified_base (493)..(493): a, c, t, g, unknown or other
  misc_feature (493)..(493): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatcgtgggacagatttcactctcaccatcagtagtctacaacctgaagtattttgctaacttactacttgtcaacngtaagttacgacttacccctccgctcactttcggcggagggaccaaggtggagatacaaacgactgtgctgccacntcgttcg

SEQ ID NO: 285759 - DNA, 568 bp, Homo sapiens
  misc_feature: GYAE6OF01EJO37.4.57.F02.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
  modified_base (361)..(361): a, c, t, g, unknown or other
  misc_feature (361)..(361): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagatcatcatctcttgccgggnaagtcagagtgttagtatttaatttaattgtatcagttacaaacgaggaacncccctaagctctgatctatgctgcatacctagtttaacgaaaggttcgggtacccatacaagtattcgagtggcgtagtgatcgtgganagtattcactctacacctatacagtactacctaacaaccgttagaagttatttcgtactaactttactactgtacaacgtagtaacgttacgaccttaccctcctcctacgtaccggtttcggacggtaacgggaccgtaaggtcggaacgtagtaaccgaaacgtaacgtggtacggtacgtacgacccacgttacgtcgttaccg

SEQ ID NO: 285760 - DNA, 692 bp, Homo sapiens
  misc_feature: GYAE6OF01DAM0F.4.57.F02.1.454.CMB.1.raw
  modified_base (202)..(202): a, c, t, g, unknown or other
  misc_feature (202)..(202): n is a, c, g, or t
  modified_base (686)..(686): a, c, t, g, unknown or other
  misc_feature (686)..(686): n is a, c, g, or t
tcagagcactgtagcacgaccggtgctcgatttagctcgatatagttggggtttggggagccagtctcagtcaggacacagcatggacatgagggtccccgctcagctcctggggctcctgctactctggctccgagatgccagatgtgaccacccagatcgacccagtctccactccctcctgtctgcatcgtggtggganacagatcatcatctcgttcggccgggacaagtcaaggtagttagtttaagttattttaatttaaagttggttaactacgtaagttaaccaaaaccggtaagggaaaccgtacccctaaagtccttaccgtagtactactatcgtactgactactaccgtaagtttaaacgaacggtcggtaccaagtacgaaagtatcgaggtcggacgtaggtagtacgtcggaggactaacgtacttaccactcctacaacctatacgtaagttacgtaacctaaccgtaacgtaagtagttaactttcgaaccttaactttacctacgtacgtaactaaacgtaacggtaccgtttaacccgtacctacccccgttcctaccgttaccgttaccgggttaccggacgggtaaaccggaacggtaagggtcggtaaacgtaactaaacggaaaccggtagttacgggtacgacccgttagaaccctaccgtnttcccg

SEQ ID NO: 285761 - DNA, 690 bp, Homo sapiens
  misc_feature: GYAE6OF01BT8FB.4.57.F02.1.454.CMB.1.raw
  modified_base (197)..(197): a, c, t, g, unknown or other
  misc_feature (197)..(197): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatcgtgtggganacagagtcatcatctcttggccggacaagtcagtagttgttagttatttatttaaagttggtatctagttacaaacgaggaacgccctaagcctcctagactctatgctgactactacctaagtttaacaaacgggttcgggtacccatacgaaagtattacgaggtcggactaggtggtactcggtaggggaacctaggttactttaccgacttccgtacctaaccgtataccgtaaggtttaacgtaccctaaaccgtaacccgttagtaaacgttacgttttacgaaccttaaccgtttaacttaccgtaagttaaccaaacgtacggttaaccgttaaccgtaacccgttacccccttaccgtcccttaccgttaccggttaccggggaaccgggtaacgggaacccgtaagggtacgggtaagaacccgttaaccgaaaaccggttaacgtcggtacggtacctacgtacctaaccgtagtttaccgg

SEQ ID NO: 285762 - DNA, 563 bp, Homo sapiens
  misc_feature: GYAE6OF01D7NQI.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatgacccagtctccatcctcctgtctgcatctggtggganacagagtcatcatctcttgccgggnaagtcagagtgttagtatttatttaaatggtatcagttacaaacgaggaacnccctaagctctgatctatcgctgctatcctaagttacgaaaggtcgggtacccatacaagtattcgagtgacgagtggatcgtaggactagtatttcactctacactatactagttacgtacctaactaacctagtaagtattttacgacttaacttactactacgtacaactacgtaagtaccgtaactacccctccgtactaccgtacgtttcggacgggtacggaaccgaagggtcggaacgtatacgtaaacgtacgtaggtcggtactcgacctactgtcgttcg

SEQ ID NO: 285763 - DNA, 173 bp, Homo sapiens; identical to SEQ ID NO: 285623
  misc_feature: GYAE6OF01A3B56.4.57.F02.1.454.CMB.1.raw
  modified_base (173)..(173): a, c, t, g, unknown or other
  misc_feature (173)..(173): n is a, c, g, or t

SEQ ID NO: 285764 - DNA, 543 bp, Homo sapiens
  misc_feature: GYAE6OF01AVI0H.4.57.F02.1.454.CMB.1.raw
  modified_base (257)..(257): a, c, t, g, unknown or other
  misc_feature (257)..(257): n is a, c, g, or t
  modified_base (536)..(536): a, c, t, g, unknown or other
  misc_feature (536)..(536): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagtagtgttagtattttatttaaattggtatnagttacaaaccagggaaacgtcccctaagctcctgatctatgctgcatccagtttacaaagtcgggtcccatacaagtattcagttggcgtagtggtatcgtgggaacagtatttcactctcaccatcagttacgtacctacaacctagaacgttattttacactaacttactactgtacaacagtacttaacgactacccctccactctacgttcggacggtacggaccgtaagggaggacgagtaaccaacgtacgtggtcgtacgtacgacccacntcgttcg

SEQ ID NO: 285765 - DNA, 591 bp, Homo sapiens
  misc_feature: GYAE6OF01B8HJM.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtctccatccctccctgtctgcatctggtgggagacagagtcatcatctcttgccgggcaagtcagagtgttagtatttatttaaattggtatcagttacaaaccgaggaaagcccctaagcctcctgatctatgctgcatccagtttacaagtgggtccatcaagatcagtggcaggtgatcgtgggactagattcactctcaccatcagtagtactacaactgaagtacttttagactaacttactacttagtaccaacgagtaacgtttaaccgaaccttacccctacccgtaccttccgtaccgtttccgggtaccgggtaaggggtacccgtaaagggtgggtaacgaggttaacccgaaaacggttaaccggtaggttaccgggtaccgttacggaccgtaaccctcgttccgtttaccgg

SEQ ID NO: 285766 - DNA, 603 bp, Homo sapiens
  misc_feature: GYAE6OF01DIHBV.4.57.F02.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (221)..(221): a, c, t, g, unknown or other
  misc_feature (221)..(221): n is a, c, g, or t
  modified_base (278)..(278): a, c, t, g, unknown or other
  misc_feature (278)..(278): n is a, c, g, or t
  modified_base (339)..(339): a, c, t, g, unknown or other
  misc_feature (339)..(339): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacngagtcatcatctcttgccgggnaagtcagagttgttagtaattttattaaattggtattcagttacaaaccagggaacncccctaagctcctagatctatgctgctatcctaagttacaaaggtcggtaccagtcaagtnttacaggtggctaggtggtactcgtagggactagttactttacacgttactaccaccgtatacgtaagttacgtacttaaccaaaccgttaggtaacttacgttttcgaaccttaactttaccttactacgtaacaacgtaacgtacgttacctaccgtaccccttcgaccttcgttaccgttccgggaacggtaggtaacccgagggtacgtaacgtagtaaccgaaacgacgtgtacggcttacgcaaccgtattcggttac

SEQ ID NO: 285767 - DNA, 531 bp, Homo sapiens
  misc_feature: GYAE6OF01BG1CX.4.57.F02.1.454.CMB.1.raw
  modified_base (330)..(330): a, c, t, g, unknown or other
  misc_feature (330)..(330): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccaggaaagcccctaagcctcctgatctatgctgcatcctagtttacaaagtgggtcccatcaagtnttcagtggcaggtgatctgggacagtactttcactctacaccatcagtacgtactacaacctgaaagtattttgactaacttactacttagtacaacagtacgttacgactacccctcgtactaccgtccgttcgggacggtacgggaccaagggttcggacgatacgaaacggaacttggacgtctagccacgtattccg

SEQ ID NO: 285768 - DNA, 602 bp, Homo sapiens
  misc_feature: GYAE6OF01B572N.4.57.F02.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (377)..(377): a, c, t, g, unknown or other
  misc_feature (377)..(377): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnagtcagagtgttagttatttattaaatggtatctagttacaaaccgtaggaaacgccctaagcctaccgtgatctatcgctgctaactcctaagtttaacgaaacggttcgggtacccaagtaccaagtaacttcgagtggactaggttagattcggnggtactagtactttcactctcacatcagttacgtactaacaactagtaatatttagacttaactttactttactactactaaactagttacctttaaattaacgttacgaccgtaccttaccgtaccgtttccgggaccgggtaacgggtaacccgtaagggtcggaaagtacgttacgaaaaccggtaacgtacggtcggtactaggaccctaccgtattaccg

SEQ ID NO: 285769 - DNA, 540 bp, Homo sapiens
  misc_feature: GYAE6OF01DQQ49.4.57.F02.1.454.CMB.1.raw
  modified_base (269)..(269): a, c, t, g, unknown or other
  misc_feature (269)..(269): n is a, c, g, or t
  modified_base (445)..(445): a, c, t, g, unknown or other
  misc_feature (445)..(445): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccggcagtcagagtgttagtatttatttaaattggtatcagttacaacaggaacnccctaagctcctgatctatgctgctataccagtttaacaagtcgggtaccatacaagtattcaggtggctagtggatcgtgggacagatttcactctcacatcagtagtactacacctgaatatttgactaacttactactgtacaaactagtaacgttaaccgtacttacccccncgtccttctaaccgttttcgggaccggacgggtaccgaagggttacgaagtactaacgaaaaccgtacgcggttcggactcgacacctattcccg

SEQ ID NO: 285770 - DNA, 512 bp, Homo sapiens
  misc_feature: GYAE6OF01BN1F6.4.57.F02.1.454.CMB.1.raw
  modified_base (276)..(276): a, c, t, g, unknown or other
  misc_feature (276)..(276): n is a, c, g, or t
  modified_base (444)..(444): a, c, t, g, unknown or other
  misc_feature (444)..(444): n is a, c, g, or t
  modified_base (478)..(478): a, c, t, g, unknown or other
  misc_feature (478)..(478): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaattggtatcagttacaaccgagggaaacnccctaagctcctgatctatgctgcatcctagtttaacaaggtcgggtccatcaagattcagtgcagtggatcgtaggacagtattcactctcacatcagtatctacaactagaattatttagactaactttactactagtacaactagtacgttactactacccctcnctctacgttcggcggtacggaccgtagggtcganagtacaaacgtactggtcgctagccactgttccg

SEQ ID NO: 285771 - DNA, 638 bp, Homo sapiens
  misc_feature: GYAE6OF01EINCJ.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctcctgtctgcatctggtggganacagagtcatcatctcgttgccgggacaagtcagtagttagttaagttattttaatttaaagttggttactactaagttaccaaaccgaagggaaacgtccccgtaagcctcctgtactctatgctgctactccgtagtttaacgaagggttcgggtacccatacaagtattacgaggtggctaggtggacttcggtagggtaactaggttactttccacttcctaccacctatcgagacccacgaccctaacgacgtaccgttagtaagttcttttacgaacctttaatttacttacgtacgtaactaacgtacgttaactttaaattaaccgttacgaccgttaccttaccgttaccggttacggggacggtaacggtaaccgtagggtagaacggtactaacgaaacgtacgttggtacgtactacggaccctcgtacg

SEQ ID NO: 285772 - DNA, 520 bp, Homo sapiens
  misc_feature: GYAE6OF01EQZMP.4.57.F02.1.454.CMB.1.raw
  modified_base (294)..(294): a, c, t, g, unknown or other
  misc_feature (294)..(294): n is a, c, g, or t
  modified_base (447)..(447): a, c, t, g, unknown or other
  misc_feature (447)..(447): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaagccctaagctctgatctatggtncatccactttgacaaagtcgggtccatcaaggttcagcggcagtggatcgtagggacagtatttcactctacaccatcagcacgcctacacgcctagaagtattttgacctaactttattacttgtacaactagtacttaaattaattacgcnctctacgtttcggaccggagggaccgtaaggtaggagtacgtacgaaacgacgtagtggactgctaccgtacg

SEQ ID NO: 285773 - DNA, 675 bp, Homo sapiens
  misc_feature: GYAE6OF01BUB4E.4.57.F02.1.454.CMB.1.raw
  modified_base (209)..(209): a, c, t, g, unknown or other
  misc_feature (209)..(209): n is a, c, g, or t
  modified_base (216)..(216): a, c, t, g, unknown or other
  misc_feature (216)..(216): n is a, c, g, or t
  modified_base (270)..(270): a, c, t, g, unknown or other
  misc_feature (270)..(270): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggagacagatcatcatctntgccggnaagtcagagtgttagtatttattaaattggtatctagttacaaacgaggaaacnccctaagctcctagatctatgctgcatcctagttaacaaggtcgggtaccagtacgaagtattaccgagtcggactaggtagtacgtcgtagggtaactaaggttacttttcgaaccttccgtaccaaccttacttacgtagttaaccggttactaaaccgtaacccgttagtaaacgtttacgttttcgaaccttaactttaaccttacgtacgttaacgaaaaccgttaggtaacggtttaacctaaccgtttaccccccgttaccgtacccgttacctaacccggttttcggggaacccgggtaacgggtaaaccccgtaaaggggtacggtaaacggtaacgtaaacccgaaacggttaacggttcgggtacgtacgttacgacccgtactacgtttaccg

SEQ ID NO: 285774 - DNA, 520 bp, Homo sapiens
  misc_feature: GYAE6OF01CSLL8.4.57.F02.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggnagtcagagtgttagtatttatttaaattggtatcagttcaaaccaggaacgccctaagctcctgatctatgctgcatccagttacaaagtgggtccatcaagattcagtggcagtggatcgtggactagatttcactctcaccatcagtagtctaacaacctgtaagtatttgactaacttactactagtacaacgagtacgttaaccgtactacccctcgacttcaccgtttcgggacggacgggaccgtaagggtgaagactacgaaacgtactggtaggactagccacctagttccg

SEQ ID NO: 285775 - DNA, 920 bp, Homo sapiens
  misc_feature: GYAE6OF01DZZRY.4.57.F02.1.454.CMB.1.raw
  modified_base (140)..(140): a, c, t, g, unknown or other
  misc_feature (140)..(140): n is a, c, g, or t
tcagagcactgtagcacgaccggtgctcgatttagctcgatatagttgggtttgggggccagtctcagtcaggacacagcatggacatgagggtccccgctcagctcctggggccctcgtgactactgtcgctacgagtntcgacgagtagttggacgaacccaaccgagtagtacccgaacccgtcgtccctaacctccttcccctccgtgtcgtcgactcttcgtgggaggaacacgaggtactacactactcgttcctcggtccgggaccggaacgtacgtacgaaggttaggtttagtttaaattttaatttaaaagttttaggtgtactaccgttacgtaaaaccgaaaacggggacggtaacccctaaccgtacgtcccagtactaccttagtgccggtactcgaacttaaccgttacggtttaaacgtaaaaaccggttggggggtccccaactacgtaaacggtaaagtttccaaacgggttgggccaaggtttacgggtagttaccgttagggaccggtaaatgtttttaaccgccctaacttacccgtaacctaacgtaccgttaacggttaacgttaaccgttaacccgtaaaaccgttaccggtaaaggttaaccggtttttaacgttaacccgtaaaccggttttaaaccctttaacggtttaccgtaacgtaaaccctaaaacgggttaccggtttaaaccggtaacccccgtttaccccgttaccccccgttacggttacccggttaacccgtttaccggggttaacccggggtaaacggggaacccgggttaaacggtaacgggggttaacgtaaaccggttaaccgtaaaaccggaaacggttaccgggttaggaccggtaccgttacccggaaccctttaacgtccgttacggtttaccccg

SEQ ID NO: 285776 - DNA, 711 bp, Homo sapiens
  misc_feature: GYAE6OF01DX2IR.4.57.F02.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtcctccatcctccctgtctgctatcgtggtggganacagagtcatccacctcgttcggccgggacaagtcaggtagttagttagttatttaattaagttgtatctagtacaaacgtaggaactccctanctacctgtactctatcgtctagctacttactaagtttaacgaaacggttcgggtaccctagtacctaaaggtacttacggaggtacggtacgtaggtaggtacgttacggaggtaactacgttactttacctaccgtccttaaccaccttaataccgtaagttacgtaccttaaacgacctttaaggtaaactttatttaaccgtacgttaaacctttactaccgttacgtaactaaacgtacggtaaccgtttaaccgtaccccttacccgtacccgtccttaacccgttacggtacccgggacggtaaccgggtaaccgtaaagggtcggtaaacgttaaccgaacggtaaaccgtacgggtttagaccggaccgttaaccgaacgtaacccttagtcccgttacgtttaccccg

SEQ ID NO: 285777 - DNA, 588 bp, Homo sapiens
  misc_feature: GYAE6OF01BPRTQ.4.57.F02.1.454.CMB.1.raw
  modified_base (195)..(195): a, c, t, g, unknown or other
  misc_feature (195)..(195): n is a, c, g, or t
  modified_base (348)..(348): a, c, t, g, unknown or other
  misc_feature (348)..(348): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtattttatttaaattggtatctagttcaaaccagggaaagcccctaagctcctgatctatgctgcatcctagtttacaaagtcgggtcccatcaagattcagtgcagtggatcngggacagtatttcactctcacctatcagtagtactacaacctgaagtatttgactaacttactactgtacaacgagtaacgttacgacttaccccctccgtaccttccgtaccgtttccgggaccgggtaacgggtaacccgtaaagggttacgggtaacggtaacgttaaccggaaaaccggtaaaccgtagggttacgggtaccgtacggaccctaacccgtaagttccgtttaccgg

SEQ ID NO: 285778 - DNA, 642 bp, Homo sapiens
  misc_feature: GYAE6OF01BOY56.4.57.F02.1.454.CMB.1.raw
  modified_base (293)..(293): a, c, t, g, unknown or other
  misc_feature (293)..(293): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatccctccctgtctgcatcgtggtgggagacagagtcatcatctcgttcggccggacaagtcagtagttagttagttaatttaagtttaaattggttatactaagttacaaaccgaggaacnccctaagcctctgatctatcgctgtactatacctaagtttaacgaaagggttccgggacctagtacgaaagtacttacgaaggtcggacgtaggtaggtacgtcgtacgggaactaggttactttccgtactcctacgacctatacgtagtacgtactaacgtaaccgtagtaagttacgttacgaacctaacctttactaacgttagtaactaaacgtagtaaccgttaacgtacccttacccccgtctaccttaccgttaccggttcgggtaaccgggacggtaacggagggtacgaagtaactaccggaaacgtacgttaggtcgtcgacgtacctccgtattccg

SEQ ID NO: 285779 - DNA, 540 bp, Homo sapiens
  misc_feature: GYAE6OF01AXIV4.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaacaggaagcccctaagctcctgatctatgctgcatcagttacaagtgggtccatacaagattcagtggcaggtggatcgtggacagatttcactctcacatcagtagtactacaacctgtaagtatttagactaacttactacttgtacctaacgagtacgttacgaacctaccccctccgtaccttactaccgttccggacgggacgggtacccgaagggtaggacgaactacgaaaccgtacgttggtacgtacgtgaccacctagtcgttacgg

SEQ ID NO: 285780 - DNA, 721 bp, Homo sapiens
  misc_feature: GYAE6OF01EEHGQ.4.57.F02.1.454.CMB.1.raw
  modified_base (194)..(194): a, c, t, g, unknown or other
  misc_feature (194)..(194): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctccctgtctgcatctggtgganacagagtcatcatctctgcggcagtcagtgtgttagtattattaatggtatcatacaaacgaggaactcctaagctacctgatctatcgctgactactcctaagtttacgaaaggttcggggtacctagtacgaagtacttacgtaggtacgcgtaggtaggacgttacgtacgggtaaccgtaaggttaacttttacgaccgtttactacccgtaacctaacgttaccgtaaacggttacggttaaccttaaacccgtaaaccgttaaccgttaaaggttacgttttacggtaaccttaaaccttttaaccgtaacgtttaaccggttaaccaaaacgtaacggttaacgtttaaacccggtaacccgttaaccccccgttacccgtaccgttacccgttaaccgggttttccggggaacccggggtaaacgggtaacccggtaaaggggtaggtaaccggtaagtaaccgtaaaacggtaaccggttggtaacggtccgtacgtaccgaccgtactcgttacccg

SEQ ID NO: 285781 - DNA, 565 bp, Homo sapiens
  misc_feature: GYAE6OF01CV7L8.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccgggnaagtcagagtgttagtattttatttaaattggtatcagttacaaacaggaancccctaagctcctgatctatgctgcatcctagtttaacaaggtgggtcccatacaagtattcgagtggactagtgatcgtaggacagtacttcactctacacatcgatacgtctaacactagaagtatttcgactaacttagtactgtacaactagtaacgttacgaccttacccctccgtacttaccgtaccgtttacgggaccgggtaaccgggaccgtaaggggtacggtacgaacgtaaccgaaaacgtaacgtcggttacggcttagaccacctagttccgttaccg

SEQ ID NO: 285782 - DNA, 746 bp, Homo sapiens
  misc_feature: GYAE6OF01B183F.4.57.F02.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (740)..(740): a, c, t, g, unknown or other
  misc_feature (740)..(740): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatccctccctgtctgcatcgtggtgggagacagagtcatcatctcgttgccggganaagtcagtagttagttagttatttaatttaagttggtatctagttacaaaccgagggaaccnccctaagcctctagtactctatgctcgctactaccgtaagtttaaccgaaagggttccgggtacccagtaacgtaaacgttacgttaccggaaggtcgggacgtaagggtacgtacgttacggtacggggtaaacttacggtttaaccttttacccgaaccctttaccgtaccccgtaaaccgttacgttaaccggttaaaccggtttaaccggttaacccttaaaccggttaaacccgtttaagggtaaccgtttttaagtttaaccgtaaccctttaaacctttaccgttaacgttaccgtaacgtaaacgtacggttaaaccgttacccgttaaccccttaccccgttccgtaccgttaccgtaccggttccgggacgggtaaccggtaacgtaacgggtagaacgtactaaccggtaacgtagtcggtacgacgtacaccctacgtnttaccg

SEQ ID NO: 285783 - DNA, 669 bp, Homo sapiens
  misc_feature: GYAE6OF01CJ8YG.4.57.F02.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggnaagtcagngtgttagtattttaattaaattggtatctagttacaaaaccgagggaaacnccccgtaagtctccgtgatctatgtctgctatcctaagtttacaaagtcgggtaccatacaagattcagtggcagtggaatcgtaggacgagtacgtttcaacgttctaccaacctatacgaagttacgttacctaacctaaaccgtaggtaaacgttaagtttttagaccttaaacctttaacttaaccgttacgtacctaaacgtacggtaaacgtttaccgtaaacccgttaccccccgttaccgtaccttccgttaaccgtttccggggaaccggtaacggggaaacccgtaaagggtcgggtaaacgtaagtaaccgtaaaaccgggtaaacgtagggttacggtaccgttacggaccctaaccgttaacgttccgtttaacccg

SEQ ID NO: 285784 - DNA, 549 bp, Homo sapiens
  misc_feature: GYAE6OF01DMUTS.4.57.F02.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
  modified_base (545)..(545): a, c, t, g, unknown or other
  misc_feature (545)..(545): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctcctgtctgcatcgtgtggganacagagtcatcatctcttgccggcaagtcagagtgttagtatttaatttaaattggtatctagttacaaacaggaaacnccctaagctcctgatctatgctcgactatccgtaacgtttaacgaaaaggttcgggtaccctaagtacaaagtattcgagtggacaggtggatcgtaggactagtactttcactctacacctatctagtacgtactaacaacctagaacgttatttacgactaacttactactntacaacagtacgttactactacccctcncctacgtacgttcggacggacggacgtaagggtcgagatacgaaacgagtaggtgactgacctagtnttcg

SEQ ID NO: 285785 - DNA, 646 bp, Homo sapiens
  misc_feature: GYAE6OF01DFBAY.4.57.F02.1.454.CMB.1.raw
  modified_base (198)..(198): a, c, t, g, unknown or other
  misc_feature (198)..(198): n is a, c, g, or t
  modified_base (220)..(220): a, c, t, g, unknown or other
  misc_feature (220)..(220): n is a, c, g, or t
  modified_base (271)..(271): a, c, t, g, unknown or other
  misc_feature (271)..(271): n is a, c, g, or t
  modified_base (397)..(397): a, c, t, g, unknown or other
  misc_feature (397)..(397): n is a, c, g, or t
  modified_base (614)..(614): a, c, t, g, unknown or other
  misc_feature (614)..(614): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtctccatcctccctgtcctgcatctggtggganacagatcatcatctctgccggnaagtcagagtgttagttatttattaaattgtatcagttacaaacaggaaancccctaagctcctgatctatgctgctatactaagtttaacgaaaggtcgggtacctagtactaaagatttacaggtggactaggtgtaagtcgttgggacaagttacttacactctacacctatanaagttacgtctaacgtaaacctgtaaacttacgtttagtacctaaacctttacgtaacttacgtaactaacgtaacgttaacgttaaccgtacccttacccccgtacccgttaccttaaccgttacggttttaccgggaccggtaaacggggtaacccgtaaggggtacgggtaaacgtaacgtaaccggtaaaaccggttaacgtggtacccggtntaaccggtaccctaaccgtaatcccgtttacg

SEQ ID NO: 285786 - DNA, 520 bp, Homo sapiens
  misc_feature: GYAE6OF01A9ZOM.4.57.F02.1.454.CMB.1.raw
  modified_base (218)..(218): a, c, t, g, unknown or other
  misc_feature (218)..(218): n is a, c, g, or t
  modified_base (512)..(512): a, c, t, g, unknown or other
  misc_feature (512)..(512): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctcttgccgggnaagtcagagtgttagtatttatttaaattggtatcagttcaaaccaggaaagcccctaagctcctgatctatgctgcatccagtttacaaagtgggtcccatcaagattcagtgcagtgatcgtggacagatttcactctcaccatcagtagtctacaactgaatattttagactaacttactactgtacaacagtacgttacgtactacccctcgctctacgtttcggacggtacgggaaccaagggtggaacgtatacgaaaccgtaacgtggtacggtctacgacaccgtntcgttacg

SEQ ID NO: 285787 - DNA, 622 bp, Homo sapiens
  misc_feature: GYAE6OF01BVEE7.4.57.F02.1.454.CMB.1.raw
  modified_base (195)..(195): a, c, t, g, unknown or other
  misc_feature (195)..(195): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattgtatcagttcaaacaggaagcccctaagctcctgatctatgctgcatcctagtttacaaaggttcgggtacccatacaagtattcgaggtggcaggtggatcgtgggacagtactttcacttctacacctatcaagttacgtacctaacaaccttgaattattttacgactaaactttactacttagtacctaacgtagtaacgttaccgaaccttacccccgtaccgtaccttacccgtaccgttttccggggaaccgggtaaacggggtacccgtaaaggggttcgggtaaacgtaacgttaaccgaaaaccggttaaccgttgggtacgggtaccgttacggaccctaacccgttagttccgtttaccgg

SEQ ID NO: 285788 - DNA, 511 bp, Homo sapiens
  misc_feature: GYAE6OF01EBPR7.4.57.F02.1.454.CMB.1.raw
  modified_base (221)..(221): a, c, t, g, unknown or other
  misc_feature (221)..(221): n is a, c, g, or t
  modified_base (422)..(422): a, c, t, g, unknown or other
  misc_feature (422)..(422): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatgacccagtctccatcctccctgtctgcatcgtgtgggagacagagtcatcatctctgccgggnaagtcagagtgttagtattttatttaaattggtatcagttcaaacaggaaacgccctaagctcctgatctatgctgcatcctaagtttaacaaagtcgggtacccatacaagtattcagtggcagtgatcgtggacagtattcactctcaccatcagtagtactacaactagaatatttgactaacttactactgtacaanagattacgactaccctccgctctacgtttcggcggtacggacgaaggtgagatacgaaacgtagtgtacgctagacctactgtcttacg

SEQ ID NO: 285789 - DNA, 584 bp, Homo sapiens
  misc_feature: GYAE6OF01BYI0I.4.57.F02.1.454.CMB.1.raw
  modified_base (225)..(225): a, c, t, g, unknown or other
  misc_feature (225)..(225): n is a, c, g, or t
  modified_base (368)..(368): a, c, t, g, unknown or other
  misc_feature (368)..(368): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatccctcctgtctgcatcgtggtgggagacagatcatcatctcgtggccggganaagtcagagttgttagttatttaatttaaagttggtatctagttacaaacgaggaacgccctaagctctgatctatcgctgactactaccgtaagtttaacgaaacggttcgggtaccagtacgaagtacttacgagtcgganaggtggacttcgtagggaactagttactttaccgactctacaacctatacgtaacgtacttactaaccaacgttagaatttatttacgactaacctttactactacgtaacaacgtagtaacgttacgtacctaccccgttcgctctacgttcgggacggacggacgaaggtgaagtactacgaaacgtactggtacgactagaccacgtcgttcg

SEQ ID NO: 285790 - DNA, 712 bp, Homo sapiens
  misc_feature: GYAE6OF01DBCAE.4.57.F02.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
tcagagcactgtagcacgaccggtgctcgatttagctcgatatagttgggtttgggggccagtctcagtcaggacacagcatggacatgacgggtccccgctcagctcctggggctcctgctactctggctccgagatgccagatgtgacacccagatcgacccagtcctccatccctccctgtctgcatcgtggtgganacagagtcatcatcctcgtcggccgganaagtcagtagttagttagttatttattaagttgtatcagttacaaaccgaggaacaccctaagctacctagactactatcgtctagctaactaccgttaacggtttaacgaaacgggttccgggtaccctaagtaaccgtaaagtacttacggtaggtcgtacgtaggtgtacgtacggtaggtaactacgttacttacctaactcgtacacttactagtaacgtacgttaactaacctaacgttagtaactttacggttactaaacgttacctttacttactacgtaactaacgtaagtaaccgttaccctacccgttaccccgtacgttcgttaacccgtttacgggtaccgggtaacgggtaaaccggtaccggtaaaggggtaaccgttaacgaaacccggttaacggtaaaaccggtacggttaccgggttacgtacccggtaacgtaaccccgtaactttcggtaccgttttaccccg

SEQ ID NO: 285791 - DNA, 625 bp, Homo sapiens
  misc_feature: GYAE6OF01CV8Y4.4.57.F02.1.454.CMB.1.raw
  modified_base (314)..(314): a, c, t, g, unknown or other
  misc_feature (314)..(314): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgaccacccagatcgacccagtcctccactccctccctgtctgcatctggtgggagacagagtcatcatctcgtcggccggcaaggtcagtagttgtttagttaattttattaaagttgtatactagttacaaacgacggaacgaccctaagcctctgatctatgctnctatcctaagtttacgaaggtcggtaccatagtaagtattacgagtcggacgtaggtcggtattcgtagggtactaaggttactttccgactaccgtacaaccgtatacgtagtacgttactaacaacgtagtaagttactttacgaacttaacttacttaactacgtaacaacgtaacgtaacgttacccgtaaccttacccccgtacgtaccttaccgtacggttaccgggacggtaaccggtacggtaaaggtcggaacgtacgtaaaccgaaagtacgttgtacgcgttacgactactgtcgttacg

SEQ ID NO: 285792 - DNA, 563 bp, Homo sapiens
  misc_feature: GYAE6OF01EGWXA.4.57.F02.1.454.CMB.1.raw
  modified_base (197)..(197): a, c, t, g, unknown or other
  misc_feature (197)..(197): n is a, c, g, or t
  modified_base (281)..(281): a, c, t, g, unknown or other
  misc_feature (281)..(281): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (560)..(560): a, c, t, g, unknown or other
  misc_feature (560)..(560): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctctgccggacaagtcagtagttgttagttattttaatttaaattggtatctagttacaaaccgaggaacnccctaagctcctagatctatnctncatactagtttaacgaaggttcgggccatacaagtatcgaggtggacaggtgtactcgtagggactagtactttcactctacactatactacgttagtactaactaaccgtagtaagttacttttagaccttaactttactaactacgtacaaacgtacgtacttaaccgtacttaccccgtcgtcctactcgttcggacgggtacggacctaagggcgagactacgaaacgacgttcgtaggcacggcaccgtntcg

SEQ ID NO: 285793 - DNA, 670 bp, Homo sapiens
  misc_feature: GYAE6OF01ANHTS.4.57.F02.1.454.CMB.1.raw
  modified_base (222)..(222): a, c, t, g, unknown or other
  misc_feature (222)..(222): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctctcggccggnagtcagtagtgttagttattttaatttaattggtatactagttacaaacgaggaaacgcccctaagctcctgactctagtcgctgcatacctagtttaacgtaaggttcgggtaccctagtacaagtagttacgtaggtggtacgtaggtggtacgttcgtagggaacgtagtacgttttacctacctctacctacctagtactacggttaacgtaccttaacctaaccgttagtaacgtttagtttacgacttaacctttacgtacttacgtaacctaacgtaacgtaacgttaccgaccttacccccgtccgtaccttaccgttaccgttccgggaccgggtacggtaaaccggtacgggtacggtaacggtacctaaacccggtaaacggttaaccgtacgggttacggtacgtaccgaaccctaccgtgttacccggtttaccg

SEQ ID NO: 285794 - DNA, 555 bp, Homo sapiens
  misc_feature: GYAE6OF01DLT95.4.57.F02.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (370)..(370): a, c, t, g, unknown or other
  misc_feature (370)..(370): n is a, c, g, or t
  modified_base (431)..(431): a, c, t, g, unknown or other
  misc_feature (431)..(431): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcttggccgggcaagtcagagtgttagttaatttatttaaattggtatctagttacaaaccagggaaacncccctaaagctcctgatctatgctgctatctaagttaacaaaggtcgggtacccatcaagattcagtggcagtggatcgtagggacagtntttcactctcacctatcgatacgtctaacaactagtaatattttcgactaacttactactntacaacgaagtagttaacacctaccctccgtctactacgtttcgggacgggtaacggaccgtaagggtcggaagtacgtacgaaaacgtacgtggtcggtactacgacctaccagttcgttacg

SEQ ID NO: 285795 - DNA, 691 bp, Homo sapiens
  misc_feature: GYAE6OF01C5JEQ.4.57.F02.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
tcagagcactgtagcacgaccggtgctcgatttagctcgatatagttgggtttggggagccagtctcagtcaggacacagcatggacatgagggtccccgctcagctccgtgggctcctgctactctggctccgagatgccagatgtgaccacccagatcgacccagtcctccatccctcctgtctgcatcgtggtggganacaggatcatcatctcgtgccggnaagtcagtgtgttagttatttaattaaatggtatactagtacaacgaggaactaccctaagctacctgactactatgctgctactaccgtaagttacgaacggtcgggtacctaagtacgtaaagtacgtcgaaggtcggtacgtaggtagtacgtcggtacggaactacgtactttaccgaccttccaaccgtaccgtacttacgtaacgtttacgtaacctaaacctaacgttagtaacgtttaactttacgaaccttaacgtttacctaacgttactaaccgtaaacgacggtttaaccgttaacccgtaacccctaccccgttaccgttaccgtaccgtttaacccgggtttaccggggaccggggtaaacccgggtaacgtaacggggtacgtaaacgtaacgtaaccggtaaaacggtacgtttacgggcgtaacctagtacccgtacttaacggtaccg

SEQ ID NO: 285796 - DNA, 871 bp, Homo sapiens
  misc_feature: GYAE6OF01CKV6O.4.57.F02.1.454.CMB.1.raw
tcagagcactgtagcacgaccggtgctcgatttagctcgatatagttgggttggggagccagtctcagtcaggacacagcatggacatgagggtccccgctcagctccgtggggctcctgctactctggcctccgagatgccagatgtgaccacccagatcgacccagtctccactccctccctgtctgcatcgtggtgggagacgagtacgtcaactctattccttcgtttcgggcccgggacgaagtcgaggtaggttgtttaagttaattttaaattttaaacgttggttaattaccgtagtttaaccgaaaacccggtaaggggtaaaaccgtacccccgttaaaggtcccttcccgttaggtaaccttacgttaagtcggtccgttcggtacctaaccgttccccgttaaaggttttaaaccggtaaaacggggtttcccggggttaaccccaacgttaaccgtaaaggttacgttaccggtaaggtcgggtaccgtaggtacggtacgttacgggtaggggtaacctagttacctttaccgtaccgttctaaccctacgtaactaccgtaaggtttaccctaacctaaccgtaaacccgttagggtaaacgtttacgtttaaccggaaccctttaaccgttttaaccgacgtttacccgtaaacgtaaaccgtaacggtttaacccggttaacccgtaccccttaacccccggttcccgttaccctttacccggttacccgggtttaccgggggtaccgggaaaccggggtaaccggtaaacggggttgggaacgtaaaccgttaccgggtaaaacgtacggtttacgggtcgtacgtcggtaaccccaccgttacgtttcccgg

SEQ ID NO: 285797 - DNA, 701 bp, Homo sapiens
  misc_feature: GYAE6OF01CEVVK.4.57.F02.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (689)..(689): a, c, t, g, unknown or other
  misc_feature (689)..(689): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacacccagatcgacccagtcctccatcctccctgtctgcatcgtggtggganacagagtcatcatctcttgccgganaagtnaaggtgtagttagttaattttaatttaattgtatctacgttacaaacgacggaacacccctaagtcctccgtagtactctatgtctgactactaccgtaagtttaacgaacggttcgggtaccctaagtacgaaagtacgttacgaggtcggactaggtacggtactcggtagggactacgttactttacgacgttcctacctaccgttagtaccgtaagttaacgtaccttaactaaaccgttaggtaaacgtttacgtttttaccgaacccttaaacgtttaccttaacttaacgtaaccctaagttacggttaaccttaaccgtaccccttaccccgttccgtaaccttacggtacccgtttacggggacccggtaacgggtacccgtaagggtacggtaaacgttaactaaccggaaacggttacgttgggacgtccgttaccgaacctaacccttnttcggtttaacg

SEQ ID NO: 285798 - DNA, 606 bp, Homo sapiens
  misc_feature: GYAE6OF01CYNS4.4.57.F02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (299)..(299): a, c, t, g, unknown or other
  misc_feature (299)..(299): n is a, c, g, or t
  modified_base (461)..(461): a, c, t, g, unknown or other
  misc_feature (461)..(461): n is a, c, g, or t
tcagagcactgtagcacgaccggtgctcgatttagctcgatatagttgtgtttgggggccagtctcagtcaggacacagcatggacatgagggtccccgctcagctcctggggctcctgctactctggctccgagatgccagatgtgacacccagatgacccagtctccatccgtccctgtctgcatcgtgtggganacagngtcaatcatctcgttgccgggtacaagtcaaggtagttagttaagttaattttaatttaaaagttggtatacagttaccaaaaccgagggtaaaccnccctaagcctacgtagacttaccaattcggactgactaacgtacctaagtttaacgaaaggtcgggtacccaagtaccgaagtattcgaggtggacaggtgatcggtaggactagatttcgactcgtacaactatacagtactactaacactagattattanactaacttaatctatacaaagtagtaacgttacgaccgtacccctctaccttcgtaccgtttacgggacgggtaacgggtacgtaaagggtaggaagtagaaaccgtaaaacgtacgtggtacggactaggaaccctacgtgtac

SEQ ID NO: 285799 - DNA, 727 bp, Homo sapiens
  misc_feature: GYAE6OF01BUKTG.4.57.F02.1.454.CMB.1.raw
  modified_base (152)..(152): a, c, t, g, unknown or other
  misc_feature (152)..(152): n is a, c, g, or t
  modified_base (194)..(194): a, c, t, g, unknown or other
  misc_feature (194)..(194): n is a, c, g, or t
tcagagcactgtagcacgaccggtgctcgatttagctcgatatagttgggtttgggggccagtctcagtcaggacacagcatggacatgacggtcccgctcagctcctgggctcctgctactctggctcgagatgccagatgtgacaccagntcgaccagtctccatccctcctgtctgctatcgtggtggganacagatcatcatctcgtggccggacagtcagtgtagttagttatttattaattggtatactagttacaaacgtaggaactaccctaagctcctagtactctatctctgtctagtacctaagtttaacgaagttcgggtacctaatacgtaaagtacgttacgaaggtcgtacggtaaggtggtacttacggtacgggtactaaggttactttacgtaccttactaccgtaactactacgtaacgttacgtacctaacgtaaaccgttaggttaaacgttacgttttaacgaaacctttaacccgttaacgttaccgttaattaaccaacggttaaagttaaccgtttaacccgtacccttaaccccggttacccgtaaccgtttacccggttaccggtttaacccggggaacgggtaaaccgggtaaaccgggttaaacgggtacgggtaaacgttaaccgtaaccggtaaaacggtacccgttagggtacgtaccgttacgaacccttacccgtagttcccggtttaacccg

SEQ ID NO: 285800 - DNA, 553 bp, Homo sapiens
  misc_feature: GYAE6OF01EOYT9.4.57.F02.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnaagtcagagtgttagtatttaattaattggtatcagttacaaacagggaaacgccctaagctcctgactctatgctgctatccagtttacaaggtcgggtaccatcaagattcgagtggacaggtggtagtcgtaggactagtatttcactctccacatcagtactactacaacctgaagtatttgactaacttactactagtacaacgtagtacgttacgtacctaccccttacgaccttacgtacgtttacgggcggtaacgggaccgtaagggtcggtaagacgtaccaaaacggtacgttcggtacggtactaggacctaccgtattccg

SEQ ID NO: 285801 - DNA, 634 bp, Homo sapiens
  misc_feature: GYAE6OF01BKGW8.4.57.F02.1.454.CMB.1.raw
  modified_base (220)..(220): a, c, t, g, unknown or other
  misc_feature (220)..(220): n is a, c, g, or t
  modified_base (277)..(277): a, c, t, g, unknown or other
  misc_feature (277)..(277): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacaccagatgacccagtctccatccctcctgtctgcatcgtggtggagacagagtcatcatctctggccggnaagtcagtagttagttagttatttaattaagttgtatgtacgtacaaacgaggaacnccctaagcctactgactctatgctgctactcgtagttaacgaaggtcggtaccagtacgaagtacttacgaggttacggactaggtacggtactacggtaggggaacctaggttacctttaccgacctttccgtacctaaccgtagttaccgtaagttacgtacctaaaccgtacgtagttaacgttactttcgaaccttaacgttactacgtacgtaactaacgtaacggttacgtaaccgtacccgttaccccgtacgtaccgttaccgtaccggtttaccgggacgggtaaccggtacggtaagggtacgaagtacgtaaccggaactcgtggtacgcgtacgcctagtcttcg

SEQ ID NO: 285802 - DNA, 602 bp, Homo sapiens
  misc_feature: GYAE6OF01BVA5G.4.57.F02.1.454.CMB.1.raw
  modified_base (200)..(200): a, c, t, g, unknown or other
  misc_feature (200)..(200): n is a, c, g, or t
  modified_base (278)..(278): a, c, t, g, unknown or other
  misc_feature (278)..(278): n is a, c, g, or t
tcagagcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtcctccatccctccctgtctgcatctggtggganacagagtcatcatctctgccgggcagtcagagtgttagttatttatttaaattggtatcagttacaaacgaggaaacnccctaagcctctgatctatgctgcatacctagtttacgaaaggtcgggtaccatacaaagtattcgagtcggctagtggatcggtaggactagtactttcacgttcctaccacctatcgtaagtacgtactaactaaccgtgtaagttatttgaccttaacgtttactacgttatacctaagtaacggtacgttaacgtaacccttacccccgtccgtcctaccttcggtttaccgggaccggtaacgggaaccgtaagggtacggaagtaacgtaccgtaaaacgtacgttggtacggtactacggaccctacgtcgttaccg

SEQ ID NO: 285803 - DNA, 694 bp, Homo sapiens
  misc_feature: GYAE6OF01C9QHX.4.57.F02.1.454.CMB.1.raw
  modified_base (225)..(225): a, c, t, g, unknown or other
  misc_feature (225)..(225): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttcggccgggnaagtcgagtagttgttaagttattttaatttaaattggtatactagttaccaaacgagggaacctaccccgtaagcctaccgtgtatacctatcgtctgcctaacttaccgtaagtttaaccggaaggttccgggtaccctatacgtaaagtacttcgaggtagggacgtaggtacgggacgttacggtacggggtaactaggttaacttttcctaaccttccctaccgtaaccctagttaaccggtaacgttacggttaaccctaaacggtaacccgtttaggtaaagtttaccgttttacggaaacctttaacctttaacgtacttacgtacctaaacgtacgttaacgttaccctacctacccccgtcgtccttacgtccggttacggaccgggtacggaacgtaggggtacgaaggttactaaccgaaaccgtagtacggtcggactcgaccgacgtcgttaccg

SEQ ID NO: 285804 - DNA, 800 bp, Homo sapiens
  misc_feature: GYAE6OF01CM7M7.4.57.F02.1.454.CMB.1.raw
  modified_base (231)..(231): a, c, t, g, unknown or other
  misc_feature (231)..(231): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccactccctccctgtctgcatcgtggtggagacagtagtcatcactctcgtcggccgganagtcagtgttagttagttatttaatttaagtgtatcagttacaaacgaggaactccctaagcctcgtagattctatgctgactactacgtagttaacgtaacggtcggtaccagtacgaaagtcgttacgagtcggactaggtacgtacgttcggagggtaactacggtactttaccacgtttaccgaccttaaccgtaagttaacgtaacggtttaaccgttaaccgtaaacccgttaaacggtttacggtaaaaccgttttagttttaaccggaaacccctttaaaacgttttaccgtttaaacgtaccgggttaaacctaaaacggttaaccgggttaacccggtttaacccccttaaccccgtttaacccccccggtacgttcccccgtttaaacggtttaccccgggtttaaacccggggggtacccggggtaaaacggggttaccccgggttaaaacggggttaggtaaaacccggttaacggttaaaaccccggtaaaagggttaaccggtcgggttaaccgggacccgtttacgaacccccgttcgtaaccttttcccggg

SEQ ID NO: 285805 - DNA, 575 bp, Homo sapiens
  misc_feature: GYAE6OF01A3HJ8.4.57.F02.1.454.CMB.1.raw
  modified_base (222)..(222): a, c, t, g, unknown or other
  misc_feature (222)..(222): n is a, c, g, or t
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtgacacccagatgacccagtcctccatcctccctgtctgcatctgtggagacagagtcatcatctcttggccggnaagtcagagtgttagttatttatttaaattggtatctagttacaaaccgtagggaaacgcccctaagcctcctgactctatgctgcatacctagtttaacgaaacggttcgggtcccaatacaagtattacgagtggactacggtagatcgtagggactacgtagtttccacgttcctaccaccagttcgaagttacgtacctaactaacctagtaagttatttcgactaacttactactgtacaacagtacgttacaccttccctaccgtctacgtaccgtttcggcggtaaccggaccgtaagggtcgaagactacaaacgtaacgtggtacgctacgacctctacgttcg

SEQ ID NO: 285806 - DNA, 510 bp, Homo sapiens
  misc_feature: GYAE6OF01CGT3E.4.57.F02.1.454.CMB.1.raw
  modified_base (480)..(480): a, c, t, g, unknown or other
  misc_feature (480)..(480): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaaccagggaaagcccctaagctcctgatctatgctgcatccagtttacaaagtgggtccatcaagatcagtgacagtgatcgtagggacagtatttcactctcaccatcgtaagtacgtctaacaacctagaagtattttgactaacttatactgtacaacagagttacgacttcccctacgtctctactttcgggcggaggaccgaagggtgaganacgaaagactgtcgtcngacacctncttcg

SEQ ID NO: 285807 - DNA, 682 bp, Homo sapiens
  misc_feature: GYAE6OF01AJ6DI.4.57.F02.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (668)..(668): a, c, t, g, unknown or other
  misc_feature (668)..(668): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctcctgtctgcatctgtggganacagagtcatcatctcttggccggcaagtcagtagttagttagttatttatttaattggtatctagttacaaaccgagggaaaccnccccgtaagtcctcctagacttctagtcgtacgtcgactacttaccgttaagtttaacgaaacgggttccgggttaccaagttaccgaaagttacttacgagggtcgtacgtagggttagacgtttaccggtaggggtaccttaaggttaccttttaccaccgttaccgtacctacctaacgttaccgtaacggtttactaacccgttaacctaaacccggttagtaaacgttttagtttacccgaacctttaacgtttaccttacgttacgtacctaaacgtacggtaacgttaaccgtaacccttacccgttccgtacccttacgtaccgttcggaccggtaggaccgtaggtggactacgtacgaaacgcgttaggtcgtacntacctacgtgttcg

SEQ ID NO: 285808 - DNA, 738 bp, Homo sapiens
  misc_feature: GYAE6OF01C4O80.4.57.F02.1.454.CMB.1.raw
  modified_base (101)..(101): a, c, t, g, unknown or other
  misc_feature (101)..(101): n is a, c, g, or t
  modified_base (230)..(230): a, c, t, g, unknown or other
  misc_feature (230)..(230): n is a, c, g, or t
  modified_base (456)..(456): a, c, t, g, unknown or other
  misc_feature (456)..(456): n is a, c, g, or t
tcagagcactgtagcacgaccggtgctcgatttagctcgatatagttgggtttggggagccagtctcagtcaggacacagcatggacatgagggtccccgntcagctcctggggctcctgctactctggctccgagatgccagatgtcgaccacccagatcgacccagtctccactccctccctgtctgacatcgtgtgggagacagagtcatcatctcgtcggccgganagtcagtagttagttaagttatttaatttaaagttgttactactagttaccaaaacgaacgggaaccaccctaagccttacgtagtattcctatcgtctagactacttacccgtaacgtttaacggaacgggttccggtaccctaagtacgtaaagtcttacgagggtcggagtaggtacggagttcggagggtaactagtacctttacaccttccacctaacctntacgaacgttacgtactaaacaaccgttagttaacgttactttaccgaactttaacctttacgtaacttacgtaaccgtaaacgtacggttaaccgtttaaccccgtaccccttacccccgttaccgtttaccccgtttaccgtttaacccccggggttaacgggggtaacccggtaaccggggtaaaccctaaggggggtactaaaaccgggttaacccgtaaccgtaaaacggttacgttcgggtaccgtacgacgtaaccctaccgtttggttaacccg

SEQ ID NO: 285809 - DNA, 596 bp, Homo sapiens
  misc_feature: GYAE6OF01BXUXR.4.57.F02.1.454.CMB.1.raw
  modified_base (200)..(200): a, c, t, g, unknown or other
  misc_feature (200)..(200): n is a, c, g, or t
  modified_base (227)..(227): a, c, t, g, unknown or other
  misc_feature (227)..(227): n is a, c, g, or t
  modified_base (290)..(290): a, c, t, g, unknown or other
  misc_feature (290)..(290): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatccctccctgtctgcatcgtggtggganacagagtcatcatctcgtggccggganaagtcagagttagttagttaattttaatttaaattggtatcgtagttacaaacgagggaaacnccctaagccttcctagtactctagtcgctgctactctaagttaacaaggtcgggtaccagtacgaagtagttacgagtggacgtaggtaggtacttcggtagggactagtactttcactctacactatctaagttactactaacgacctagtaacgttactttacgactaacctttactacttacgtaacaacgtaagtacgttaaccgtaaccttaccccgtacgtccttacgtacggttcgggacggtacggaacgtagggtacgagtactacgaacgtacgtggtgacancctacngttaccg

SEQ ID NO: 285810 - DNA, 583 bp, Homo sapiens
  misc_feature: GYAE6OF01D95AF.4.57.F02.1.454.CMB.1.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (576)..(576): a, c, t, g, unknown or other
  misc_feature (576)..(576): n is a, c, g, or t
tcagagcactgtagcacgaccggtgctcgatttagctcgatatagttggggtttggggagccagtctcagtcaggacacagcatggacatgagggtccccgctcagctcctggggctcctgctactctggctccgagatgccagatgtgacacccagatgacccagtctccatcctcctgtctgcatctggtgggagacagagtcatcatctctgccggnagtcagagtnttagttatttattaattggtatctagttacaacgaggaacgccctaagctctgatctatgtgctatctagttacgaaggtcgggtaccatacaagtacttacgagtggacgtaggtggatcgtaggactagttactttacgacttactacctacctatacgtagttacgttacctaacctaaacgttaggtaagttacgttttacgaccttaactttaacttacttacgtactaacgtaagtacgttaaccgtaccttacccctccgtcttacgtacgttcgggacggaacggtaccgtaagggtacggaatacgacgaaacgtagtcggagtccacgacctactntcttacg

SEQ ID NO: 285811 - DNA, 599 bp, Homo sapiens
  misc_feature: GYAE6OF01BMUVY.4.57.F02.1.454.CMB.1.raw
  modified_base (195)..(195): a, c, t, g, unknown or other
  misc_feature (195)..(195): n is a, c, g, or t
  modified_base (221)..(221): a, c, t, g, unknown or other
  misc_feature (221)..(221): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacaccagatgacccagtctccatcctccctgtctgcatcgtggtggganacagagtcatcatcctcgttgccggnaagtcagtagtgttagtatttatttaattggtatcagttacaaacgaggaactaccctaagctacctagactctatgctagctatacctaagtttaacgaaagtcgggtacccatacaagtattgagtgacaggtgacgtgaggactagtacgttcacttctacgactatctaagttacgtactaacaactaggtaattacgtttagaaccttaacgttacttaactagtaaacgtaaagaacgtttaacctacctaaccccttccgtacttccgttaccgttacggggaaccggaacgggtaacccgaggttaacggacgtataacgaaacggtaatcggtagtacgtaccgaccaacgttctccgttgttaacccg

SEQ ID NO: 285812 - DNA, 550 bp, Homo sapiens
  misc_feature: GYAE6OF01EYM5Z.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagngtgttagtatttatttaaattggtatcagttacaaaccgagggaaacgcccctaagctcccgtgactctatgctgcatcctagtttacaaaggttcggggtccaatcaagtattcagtggcaggtggtatcgtagggacagtactttacactctccaccatcgagttacgtctaacaacccttgaagttattttagctaacttactactgtacaacagtagttaccgactaccccttcgacctctaccgttcgggcggtacgggaacgtaagggtcggaacgtagtacgaaacgacgtgtacggactagcctaccgattcg

SEQ ID NO: 285813 - DNA, 658 bp, Homo sapiens
  misc_feature: GYAE6OF01AY5PM.4.57.F02.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (291)..(291): a, c, t, g, unknown or other
  misc_feature (291)..(291): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtctccatccctccctgtctgcatcgtggtggganacagagtcatcatctctcggccgganaagtcagtagttgttaagttaattttaatttaagttggtatactaagttacaaaacgaggaaaccncccctaagtcctacctagtactctagtcgtctcgactacttaccttaaggtttaacgaaaggttcgggtaccctataacgaagtacgttcgaggtcgacgtaaggtggtactcggtagggaactagttactttccgaactccgtaccacctatacgtaacgttactacctaacgtaacttagtaacttatttacgaaccttaacgttaccttacgtataaccgaacgtacggttaaccgttaccgaacccttaccccgtccgtactacccgttaccggttccgggaacggtaacggtaccggtaagggtacgacgtaataaccggtaaacgtacgtggtacgtactacgacctacctgttccgtacg

SEQ ID NO: 285814 - DNA, 841 bp, Homo sapiens
  misc_feature: GYAE6OF01DCHV4.4.57.F02.1.454.CMB.1.raw
  modified_base (200)..(200): a, c, t, g, unknown or other
  misc_feature (200)..(200): n is a, c, g, or t
tcagagcactgtagcacgaccggtgctcgatttagctcgatatagttggggtttgggggccagtctcagtcaggacacagcatggacatgagggtcccgctcagctcctggggcctcctgctactcgtggctccgagatgccagatgtgacacccagactgacccagtctccatccctcctgtctgcatcgtggtggganacagagtcaatcatctcgttgccgggacaaagtcagtagttagttagttaattttaatttaaatttaggtatacgtaacgttaacgaaaccgtaacgggaaacgtacccctaaggtacctacctaggtacttacgttaacgtcgtactcggtactaacgttaccctaacggtttaaacgtaaaacgggttacggggtaccctaacgttacgaaagttaacgtttacgtaacggtacgggtaaccgtagggtacggtaacgtacgggtacgggtaacgtaacgttaacgttttacgtaaccttacctacctaaccgttaactacgtaacgttaaacgttacctaaacttaaacgttaacggtaaagtttaacgttttacggtaacctttaaaccgtttaacctttaacgtttacgtaacgttaaacgtaacggttaacggtttaacccggtaaaccctttaacccccgttacccggttaccttaccggttaaccggttttaccggggaacccggggtaaacgggaaacccgggttaaaggggtaacgggtaaagtaaaccggtaaacgtaaacggttaaaaccccggttagggtaccgggttaccgttacaacccggttaacctaaacgttcgttaacccgg

SEQ ID NO: 285815 - DNA, 670 bp, Homo sapiens
  misc_feature: GYAE6OF01C99BV.4.57.F02.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacacccagatgacccagtctccatccctccctgtcctgcatctggtggganacagagtcatcatctctgccggnaagtcagtgtagttagtattttaatttaaattggtattcagttacaaaccgaggaaacgtcccctaagctacctgactctagtgctgctactctaagttaacaaacggtcgggtacccaatacgtaagtattacgaggtggtacgtaggtcggagtacggtgggaactagtactttaccgacctctacctacctaacttacgtaagttacgtacctaactaacctaggtaattacgttttagtacctaactttaacctacttacgtaacctaacgtaacgttaacgttaaccgtaacccgtaccccctccgtaccttaccgtaccggttttaccgggaccggggtaaacgggaccggtaaagggttacgggaaacgtacgtaaccggtaaaacgtaaccgttacgggttacggtaccgttacggtaccgtaaccgtacgttccgttaccg

SEQ ID NO: 285816 - DNA, 174 bp, Homo sapiens
  misc_feature: GYAE6OF01A68JX.4.57.F02.1.454.CMB.1.raw
  modified_base (174)..(174): a, c, t, g, unknown or other
  misc_feature (174)..(174): n is a, c, g, or t
tcagagcactgtagcacgaccggtgctcgatttagctcgatatagttgggtttggggggaagaggaagactgacggtcccccaggagttcaggtgctgggcacagcggccctgggctgcctggtcaaggactacttccctacagtgctctgagcgggctggcaaggcgcatagn

SEQ ID NO: 285817 - DNA, 701 bp, Homo sapiens
  misc_feature: GYAE6OF01CTETV.4.57.F02.1.454.CMB.1.raw
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtgacacccagatgacccagtctccatccctcctgtctgcatctggtgggagacagagtcatcatctcttcggccggacaagtcagagttgttagttatttatttaattggtatctagtacaaacgaggaactccctaagcctctgactctagtgctcgactactaccgtagtttaacgaaacgggttcgggtaccctagtacgaaagtattacgaggtcggacgtaggttaggtacgtacggtacgggactaaggttactttaccaccgttacctaccgacctagtacgtaacgttacgttacctaaacgtaccgttagtaacgtttacttttacgaaccttaaccgtttaactacgttacgtaaccaaactaaggttaaccgttaacccgtaccttacccccgtaccgttccttaccggtacccgtttacccggggacgggtaaacccgggtaaccgtaaggggtaccgggtaagtaaaccgttaaccggtaaaaaccggtacgggttcggtaccgggtacctaaccggacccgtaacccgttgtttacccgg

SEQ ID NO: 285818 - DNA, 686 bp, Homo sapiens
  misc_feature: GYAE6OF01AMAE9.4.57.F02.1.454.CMB.1.raw
  modified_base (192)..(192): a, c, t, g, unknown or other
  misc_feature (192)..(192): n is a, c, g, or t
tcagagcactgtagcacgaccggtgctcgatttagctcgatataggttgggtttggggccagtctcagtcaggacacagcatggacatgaggtcccgctcagctcctgggctcctgctactctggctccgagatgccagatgtgacacccagactgacccagtctccatcctcctgtctgcatctgtggganacagagtcatcgatctcttgccggcaagtcagtagtgttagtatttaattaaacttggtatctagttacaaaaccgtaggaaactcccctaaagcctcctagatcctagtcgactgcacgtcctagtttacgaaacggttcgggtacccagtacctaaggtactttacggaaggttacgggtacgtaacggttgggtaaccttccggtacgggggtaaactacgggttaaaccgtttttaccaacccgttaccggttaaccctaacccggttaagttacccgttaaggtttaaccgttaccgttaaccgtaaaacccgtttaggtaaacgtttacttttacggaaccttaaactttacgtacgttacgtacctaacgtagtaacgttaccgacttaccccgtcgaccttcgtacgttcgggacgtacggaccgtaagggtacgaacgtaacgtacgaaacgtacgtcggagtacctagaccactgttcgtaccg

SEQ ID NO: 285819 - DNA, 722 bp, Homo sapiens
  misc_feature: GYAE6OF01A210X.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctctggccggcaagtcagtagtgttagtatttatttaattggtatctagttacaaacgaggaaacgtcccctaagctcctgtatacgtatcgctgactactacctaagtttaacgaaaggttcggggtaccctactacgtaaagtacttacgaggttcggactaggtggtatccggtagggactaaggttactttacctacgttcctaccaacctagtaccgtacgttaaccgtaccgttaacaaaacccgttagtaaacggtttaacgttttacggaacctttaaacgtttaccttacgttacgtaaccgtaaacgtacgtaacgttaacccgtaccttacccccgttaccgttacccttacccgttaccggtttacccggggacggtaaccggggtaaccgtaaacgggggttacggaaccgtaaacgttaaccggtaaaaacccggttaaccgtgggttaaaccggttccgtaacgtaacccgtacccttaacgggttcctttaacccgg

SEQ ID NO: 285820 - DNA, 592 bp, Homo sapiens
  misc_feature: GYAE6OF01EZ1OB.4.57.F02.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
  modified_base (547)..(547): a, c, t, g, unknown or other
  misc_feature (547)..(547): n is a, c, g, or t
  modified_base (586)..(586): a, c, t, g, unknown or other
  misc_feature (586)..(586): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtcctccatcctcctgtctgcatctggtggganacagagtcatcatctctggccgganaagtcagagtgttaagttatttaattaaagttggtatctagttacaaaccgagggaaacnccctaagctcctgatctangctgcatcctaagtttaacgaaacggttcgggtaccagtacgtaaagagttacgagtcggagtaaggtaggtatcggtagggaactaggtaatttccgacttcgtacctaacctagtacgtagtactactaactaacctagtaagtatttacgactaacttactaactagtacaacgtaagtacgtaccgtaccttacccctcgtacctctacgttccgggacggacggaaccgtaggacggtanaactacgaaaacgtacgttagtacggactacgactacgngttacg

SEQ ID NO: 285821 - DNA, 573 bp, Homo sapiens
  misc_feature: GYAE6OF01BIPK3.4.57.F02.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (272)..(272): a, c, t, g, unknown or other
  misc_feature (272)..(272): n is a, c, g, or t
  modified_base (563)..(563): a, c, t, g, unknown or other
  misc_feature (563)..(563): n is a, c, g, or t
tcagagcactgtagcacgaccggtgctcgatttagctcgatatagttgggtttgggggccagtctcagtcaggacacagcatggacatgacgggtccccgctcagctcctggggctcctgctactctggctccgagatgccagatgtgaccacccagatcgacccagtctccatcctccctgtctgcatctgtaggganacagagtcatcatctctggccggnaagtcagtagtgttatatttattaatggtatcagttacaacgaggaacnccctaagctcctagatctatgctgcatcagttacaaggtcggaccatacaagtattcagtgcaggtggactgtacgggactagttacttcgactctacgaactatacgtagtactactaactaacgtagaagttactttcgaactaacctttatactgacctaaacgtgtaaccgttaacgaccttaccccctcggtaccttacgttacccggttacggggaaccgaacgggtacccgaagggttacggaacgtactaacggaaacgtacggtggacgtcacgaccacgtnttcgttaacg

SEQ ID NO: 285822 - DNA, 646 bp, Homo sapiens
  misc_feature: GYAE6OF01DH2MT.4.57.F02.1.454.CMB.1.raw
  modified_base (622)..(622): a, c, t, g, unknown or other
  misc_feature (622)..(622): n is a, c, g, or t
tcagagcactgtagcacgaccggtgctcgatttagctcgatatagttgggttggggagccagtctcagtcaggacacagcatggacatgagggtccccgctcagctcctggggctcctgctactctggctccgagatgccagatgtgacacccagatgacccagtctccatccctcctgtctgctatcgtggtgggagacagacgtcatcatcctcgtaggccgggacaagtcgaggtagttgtttaagttattttaatttaagttggtatactagttaccaaacgagggaaccaccctaaggtcctacgtagtattactatcgtactcgactacttaccgtaagttaaccgaaggtccggtacctagtaaccgtaagtacttacgagggtcgtacgtaggtcgtacgtacggtaggtactagttactttcacgttacctaccgtaacctagtaccgtaagttacgtaacctaaaccgtaacgttagtaagtttactttacgaccttaactttacgtacttacgtactaaacgtagttaacgttacctaccttaccccgtctactaccgttacggtacggtacggacggtaacggaggtcggaatacgtaaacgaacgtagnggtacgtctacgacctcgtgtacg

SEQ ID NO: 285823 - DNA, 763 bp, Homo sapiens
  misc_feature: GYAE6OF01BELBF.4.57.F02.1.454.CMB.1.raw
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (754)..(754): a, c, t, g, unknown or other
  misc_feature (754)..(754): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgaccacccagatcgacccagtcctcctactcccgttccctgtcctgcctatcgtggtgganacagagtcatcacttctcgttcggccggtanaacgtcgaggtagtttagttaagtttaattttaagtttaaagttaggttactaccgtaacgttaaccgaaaccggtaagggtaaccgtaccccgttaagtcccgttaccttagtactaccgttagtacgtcgtacgtaccttacgttaccgttaacggtttaaaccgaaacggggttccgggtaaccctaagttaaccgtaaaggttacttacggacggttacggaccgtaaggtcggtacgtacgggtacggtacgtacgttacgttacctaccgttactaccgtaactcgtaacttacggttacctaacttaacgtaacgtagttacttacgttacgaactttaacgtactagtacgtactaagttaacgggtacctacccgtaaccctccccgttacgtcctaccggttaaccggtccgggaacggtacccggaacggttacggaacggttacgaacccggttaaacgaacccggtaggttccggtaccgttacaccgtacctaccggttnttaccccgg

SEQ ID NO: 285824 - DNA, 577 bp, Homo sapiens
  misc_feature: GYAE6OF01EG3OC.4.57.F02.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (393)..(393): a, c, t, g, unknown or other
  misc_feature (393)..(393): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctcctgtctgcatctggtgganacagagtcatcatctcttggccggnaagtcagagttgttagtatttattaatgtatcagttacaacaggaacgacccctagctcctgatctatcgctgcactctagtttaacgaacggtcgggtacccatacaagtattcgagtggacaggtggtatcgaggtacagtacttcactctacacacgtcacgtacgtcacncgtacctagtattatttgacttaacgttattacttcgtaactaactaagttaactttaaattaacgttacgccgtaccttactaccggtttaccgggacggttaaccgggaccgtaaggggtacggtaagaacgtaccaaaacgtacgtcgggtacgtacgtaccgacctaccgtacgttaccg

SEQ ID NO: 285825 - DNA, 806 bp, Homo sapiens
  misc_feature: GYAE6OF01BVC24.4.57.F02.1.454.CMB.1.raw
tcagagcactgtagcacgaccggtgctcgatttagctcgatatagttgggtttggggccagtctcagtcaggacacagcatggacatgaggtccccgctcagctcctggggctcctgctactcgtggctccgagatgccagatgtgaccacccagatcgacccagtcctccactccctccctgtctgctatcgtggtggagacagtagtcatctactctcgtcggccggactaacgtgaggtagttagttttaagttaattttaagttttaaagttggtaacttacgtaacgttaaccgaaaaccggtaacgggtaaaaccgtaccccgtaaacgtccttaccgtacgtaacttccgttaacgtcggtaccttacggtacctaaccttaacccgttaaaggtttaaaccggtaaacgggttaccgggttacctaacgttaacgtaaagtacgttacggtaacggtgggaccgtaggtggtaacgtcgtaagggtaacttaggttactttaccaccttcctaacctaactacgttacgttaacgttaaccgtaaccgtaaccgtaaaccgttagtaacgtttactttaaccgaaccttttaaacgtttacctaacgttaacgaacccgtaaacgttaacggtaaccgtttaacccgtaaccccgttaaccccgttccgtaaccttacccggttaccgggttaccgggaaaccgggtaaccgggttaaccgaagggttaacggaaacgttacgaaaccggtaaaccggtacgttcggacgtaccacgtaacctactccgttcttaccg

SEQ ID NO: 285826 - DNA, 631 bp, Homo sapiens
  misc_feature: GYAE6OF01B8KE5.4.57.F02.1.454.CMB.1.raw
  modified_base (202)..(202): a, c, t, g, unknown or other
  misc_feature (202)..(202): n is a, c, g, or t
  modified_base (625)..(625): a, c, t, g, unknown or other
  misc_feature (625)..(625): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtcctccatccctccctgtcctgctatcgtggtggganacagagtcatcattctcgtcggccggcaagtcagtagttagttaagttattttaagtttaaattcggtaattctaagttaccgaaaaccgaggggtaaaccgtacccctaaagccttaccgttagtactcttagtcggtacactacttcctacgtttcgaacgtaaagggttccgggtaccctaagtacgtaacgggttcacgggcggactaggtcggtaatcggtagggactagttactttccactcctacgcctagtccacgcacgcctaacacgctagaagtttgtttacacttagtttactactagtacaacgtattaacctaatacgttactcacttcgtacgttccgggacgggtaacgtacggtaaggtcgaacaacgttaaccgaaggtactcggtacggactacggacctcgtnttcccg

SEQ ID NO: 285827 - DNA, 514 bp, Homo sapiens
  misc_feature: GYAE6OF01BZY2M.4.57.F02.1.454.CMB.1.raw
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggnaagtcagagtgttagtatttatttaaattggtatcagttcaaacaggaagcccctaagctcctgatctatgctgcatccagtttacaaagtgggtcccatcaagattcagtggcagtggatcgtagggacagtatttcactctcaccatcagtacgtctacaacctgaagtatttgctaacttactacttgtacaacgtagtaacgttacacttacccctcgtcctcgtaccttcggacgggaggaccaagggtgagtatacaaacgactggtacgctcgaccacgtatcgtacg

SEQ ID NO: 285828 - DNA, 578 bp, Homo sapiens
  misc_feature: GYAE6OF01E05VY.4.57.F02.1.454.CMB.1.raw
  modified_base (197)..(197): a, c, t, g, unknown or other
  misc_feature (197)..(197): n is a, c, g, or t
  modified_base (277)..(277): a, c, t, g, unknown or other
  misc_feature (277)..(277): n is a, c, g, or t
  modified_base (403)..(403): a, c, t, g, unknown or other
  misc_feature (403)..(403): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcttgccgggcaagtcagtagtgttagtattttaatttaaattggtatcagttcaaacagggaaancccctaagctcctgatctatgctgcatcctagtttacaaaggtcgggtcccatacaagtattcaggtggcaggtggatcgtgggacagtatttcacttctctaccatcagtagtacctacaacctnaagtattttagactaacttacttactgtactaacgagtaacttaaccgtactaccccttccgccttctacgtttcggacggtaacggtaccgaaagggttcggaacgtaagtaaccggaaaaccggtaacgttacggcggtaccgttacggaacctaacccgtattccgttacgg

SEQ ID NO: 285829 - DNA, 760 bp, Homo sapiens
  misc_feature: GYAE6OF01D7LR4.4.57.F02.1.454.CMB.1.raw
  modified_base (197)..(197): a, c, t, g, unknown or other
  misc_feature (197)..(197): n is a, c, g, or t
  modified_base (220)..(220): a, c, t, g, unknown or other
  misc_feature (220)..(220): n is a, c, g, or t
  modified_base (270)..(270): a, c, t, g, unknown or other
  misc_feature (270)..(270): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctctgccggnaagtcagagtgttagtatttattaattgtatcagttacaaacgaggaacnccctaagctcctgatctatgctgctattcccgtaagttttaacgaaaggttcgggtaccctatacaaagtacttacgaggttcggacgtaggtacggtacttcggtaggggtaaacctaaggttaacctttttacccaaccgtttaccttaaccccgtaaaccctaagtttacccgtaaagggtttaaccgtaaccgttaaaacccgtaaacccgtttaagggtaaaacgttttaacgtttttaccgaacccgttaaaccgttttaacttaacgttacgttaaccgtaaaccgtaacgggttaaacgtttaacccgtaacccgtttaaccccccgttcccgttacccttaccgttaaccggttttcccggggaacccgggtaaaccggggtaaccgtaaacggggtacgggtaacgtaaccgttaaaccggaaaaacccggttacgttacgggtacggtaccttacggaacccctacgttaccgttaccg

SEQ ID NO: 285830 - DNA, 553 bp, Homo sapiens
  misc_feature: GYAE6OF01A2ZON.4.57.F02.1.454.CMB.1.raw
  modified_base (275)..(275): a, c, t, g, unknown or other
  misc_feature (275)..(275): n is a, c, g, or t
  modified_base (418)..(418): a, c, t, g, unknown or other
  misc_feature (418)..(418): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagtagtgttagtatttaatttaattggtatcagttcaaaccagggaacncccctaagctcctgatctatgctgcatccagtttacaaaggtcgggtccatcaagattcgagtggcagtggatcgtgggacagtatttcactctcaccatctagtactctacaactgtaagtatttcgactaacttactactntacaacagtaacgttacgactaccccgtctactctaccgtttcggacgggtacggaccgtaagggtacggaacgtagttaccgaaaacggtacgttacggtacggtaccgtacgaccaacctacgttcgttacgg

SEQ ID NO: 285831 - DNA, 703 bp, Homo sapiens
  misc_feature: GYAE6OF01DFD5V.4.57.F02.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (534)..(534): a, c, t, g, unknown or other
  misc_feature (534)..(534): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtcgacaccagatcgacccagtctccatccctcctgtcctgacngtcgtggtggganacgagtactcatctactctcgttgccggacaagtcagtagttgttaagtttattttaagttttaaatcggttaactacgtaacgttaacaaaaccgtagggaaactcccccgtaagtcccttcgtaagtacttccgttagtcgccgttacgactaaccgttaccttaacggttttaaacggaaccgggttcgggtaccctaaagttaccgaaacgttcgtacggtaaggtacggtacgtaaggttacggacttacgggtaggaacttaggttacctttacaccgttaccacacctagtaacctagtacttacaactaacgtgtaaacgttntttacgacctttaaacgttctaacgtacgttacgaacgtaagttaccgtaccgttaacctccccgtacgtcttaccgtcggttaccggaacggtacccggtaagaagggtagtaaactcgtaaaccggaaagtaccggtggtaaccacgtacacccaacgttgttaccg

SEQ ID NO: 285832 - DNA, 687 bp, Homo sapiens
  misc_feature: GYAE6OF01DU7VY.4.57.F02.1.454.CMB.1.raw
  modified_base (225)..(225): a, c, t, g, unknown or other
  misc_feature (225)..(225): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcattctcgttggccggganaagtcagtagttagtttagttaattttaatttaagttggttattactagttacgaaaccgaagggtaaaccgcccctaagcctaccgtagacttctatcgctgctatcctaagtttacgaaaggttcgggtaccagtacgaagtattacgaggtgacgtaggtggtatcggtagggactaagttagtttacctacttccgtaccaaccctaattacgtaacgttaacttaccgtaaaccgtaaccgttagtaacgtttacgttttaaccgacctttaaactttaccttaacttacgtaacctaaacgtaacggttaacgtttaacccgaacccttaccccgttaccgtccttaccgttaccggtttaccgggaccgggtacggtaaccgtaagggtcggaaacgtacgtaacgtaaacggacgttggtacgtccgtacgtaccgtaacctcgttcgttaccg

SEQ ID NO: 285833 - DNA, 563 bp, Homo sapiens
  misc_feature: GYAE6OF01A986T.4.57.F02.1.454.CMB.1.raw
  modified_base (194)..(194): a, c, t, g, unknown or other
  misc_feature (194)..(194): n is a, c, g, or t
  modified_base (272)..(272): a, c, t, g, unknown or other
  misc_feature (272)..(272): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacacccagatgacccagtctccatcctccctgtctgcatctgtggganacagagtcatcatctcttcgccgggcaagtcagagtgttagtatttatttaaattggtatcagttacaaacaggaacncccctaagctcctgatctatgctgcatcagtttaacaaagtgggtacccatcaagtatcagtgacgagtggatcgtgggactagtatttaccacttctaccacctatactagtagtactaactaactagtaatatttagactaacttactacttactactaacagtaacgttacgaacctaccccttactcgttactacgttccggacggtacggaccgtaagggtacggaacgtaagtaccgtaaagaaccgtggtacggtaccgtacgtaaccaccgtagtccgttacg

SEQ ID NO: 285834 - DNA, 597 bp, Homo sapiens
  misc_feature: GYAE6OF01DZTF6.4.57.F02.1.454.CMB.1.raw
  modified_base (200)..(200): a, c, t, g, unknown or other
  misc_feature (200)..(200): n is a, c, g, or t
  modified_base (281)..(281): a, c, t, g, unknown or other
  misc_feature (281)..(281): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (589)..(589): a, c, t, g, unknown or other
  misc_feature (589)..(589): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtcctccatcctccctgtctgctatcgtggtggganacagagtcatcattctcgtggccgggacaagtcagtagtgttagttatttattaaatggtatcagtacaaacgaggaaacnccctaagctctgtatctatgtctcgactactcctaagtttaacaagggtcggtaccatacaagtntcgaggtgngagtgatcgtaggactagtactttacaccgttctacaaccgtatacgtacggttacgtacctaacgtaaccgtagtaacgtttacttttacggacctaaacgtttacctagtacgtaacaacgttaaggtaacttaccgaccgttaacccctcgtacctaccgtacggttccgggacggtacgggaccaaggggtacgaacgacgttacgaaacgtagtgacgtcacgacactntcgttacg

SEQ ID NO: 285835 - DNA, 552 bp, Homo sapiens
  misc_feature: GYAE6OF01BNRWQ.4.57.F02.1.454.CMB.1.raw
  modified_base (199)..(199): a, c, t, g, unknown or other
  misc_feature (199)..(199): n is a, c, g, or t
  modified_base (399)..(399): a, c, t, g, unknown or other
  misc_feature (399)..(399): n is a, c, g, or t
  modified_base (411)..(411): a, c, t, g, unknown or other
  misc_feature (411)..(411): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtctccactccctccctgtctgcatctggtggganacagatcatcatctcttggccggcaagtcagagtgttagtattttatttaaattggtatcagttacaaacagggaaacgcccctaagctcctgatctatgctgctatcctagttacaaagtcgggtacccatacaagtattcagtgacgagtggatcgtgggactagtatttcactcaccacctatcagttactactaanaacctagaagtntttagacctaacttactactacgtacaacgtagtacgttaacaccttaccccctcgtcctccgtacgttcggacggaacgggtacgaagggtcggagactacaaaccggtactggtcgacttacgaccacctagtccttcg

SEQ ID NO: 285836 - DNA, 731 bp, Homo sapiens
  misc_feature: GYAE6OF01ES985.4.57.F02.1.454.CMB.1.raw
  modified_base (218)..(218): a, c, t, g, unknown or other
  misc_feature (218)..(218): n is a, c, g, or t
tcagagcactgtagcacgaccggtgctcgatttagctcgatatagttgggtttggggagccgagtctcaggtcaggacacagcatggacatgagggtcccccgctcacgcctcctggggctccctgctactctggctccgagatgccaggatgtgaccacccagatacgacccagtcctcctagttccctcctgttcctcgctattcgtggtaggganacgagtacgtcaacgtctattccgttcgttcggccgggactaaaggttcaaggtacgttagttaagttatttaactttaaagttggtactcgtaacgttacaaaccggtagggaacctaccctagcctctacggaacttctagtcgtactgcctagttaccgtaagttaacgagggttcccggacaagtacgagtacgttcgaaggtcggacgtaggtcgtacgtacggtagggtaactacggttactttcccgacttacccgtaccgtaaccgttaatacgttaacggttaactttaaccggttaaaccctaccggtaagtaacggtttctttacggaactttaacgttttacttaccgtacttaacgaaccgttacgttaaccgtttaaataccggttacgtaccgtacttacgttacggttcgggaaccggtaacggtaaccggtagggtaccgaaagtactaccgggtaaacgtcggtacgttcgacttaccgactaccgtgttaccgg

SEQ ID NO: 285837 - DNA, 801 bp, Homo sapiens
  misc_feature: GYAE6OF01B17PC.4.57.F02.1.454.CMB.1.raw
tcagagcactgtagcacgaccggtgctcgatttagctcgatataggttgggtttggggagccagtctcagtcaggacacagcatggacatgagggtccccgctcagctccgtggggctcctgctactctggctccgagatgccagatgtgaccaccagactcgacccagtcctccatccctcctgtctgctatcgtggtaggagacagtagtcatcattctcgttcggccgggataacgtcaaggtaggttagtttaagttaattttaaatttaaagttggttaatacgtaacgttaaccgaaaaccggtaacgggtaaacctacccccgttaaagccttaccctaggtacttaccttagtcggtactcgactaacgtccgttaagtttaaccgaaagggttccgggtaaccctacgtaacgtaaagttacgttacgaggttcggaacgtaggtacggtacgttacggtaacggggtactaaggttacctttaccgtaacgttaccgtaacctaaccgtaatttaaccggtaacggtttaaccgttaaccgttaaaccgtaaacggtttaacggttaaacgtttaacgttttaccggaaacctttaaccgttaaccgttaacgtttaacgtaaccgtaacgtaacggttaacgttaacccgtaaccgtacccccgttcgtaaccttccgtaccgggtttacgggaccgggtaacggtaaaccgagggtaacgtaaggtaaaccgttaacgaaaccgttaacggttcggtacgtactacgtaccctaaccgttgttaaccgg

SEQ ID NO: 285838 - DNA, 656 bp, Homo sapiens
  misc_feature: GYAE6OF01AH5X1.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtagggagacgagagtcatcatctcgttcggccgggacaagtcgaagtagttgttaagttattttaatttaattggtatctagttacgaaacgaggaaacgccccgtaagcctacctgactctagtcgactgctactacctaagtttaacgaaaggtcgggtaccctaagtacaaagtactttacaaggttggacgtaggttggtactcggtaggactagtactttcgactctaccacctagtactaagttactacctaactaaccgttagaacgttacttttacgaaccttaacttactaacgttataaccaaacgtagttaacgttaaccgtacccttaccccgtcgtacgttacccgttacggtacccgggtacggtaaccgtaaccgggtaaggtacggtacgtaactaaccggtaaaccgtacgttgggacgtactacgtaaccacttacgtcgtttaccg

SEQ ID NO: 285839 - DNA, 626 bp, Homo sapiens
  misc_feature: GYAE6OF01C0K16.4.57.F02.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (608)..(608): a, c, t, g, unknown or other
  misc_feature (608)..(608): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgctatcgtggtgggaanacagatcatcatctcgtcgccgggnaagtcaaggtagttgttaagttaattttaatttaaagttgtatactaagtacaaaacgtaggaaacctccctaagctcctagtatcctatgactcgactacttaccgtaagtttaaaccgaagggtccggtaccatacaaagtcttacgaggtgacgtagtaggattcgtaggacctaagtacttcactacctaccaactatacgtaagtactaacgtaactaacgtagtaatacgtttacgaccttaactttactacttacgtaacaacgtaagtaaccgttaacgtacctaccctacgccttacgtacggttacgggacggaacgggtaccgtaagggtcggataacgtaaacgaaaccggttacgtagtacggtactanaacccgtacgtattaccg

SEQ ID NO: 285840 - DNA, 619 bp, Homo sapiens
  misc_feature: GYAE6OF01ELGK9.4.57.F02.1.454.CMB.1.raw
  modified_base (202)..(202): a, c, t, g, unknown or other
  misc_feature (202)..(202): n is a, c, g, or t
tcagagcactgtagcacgaccggtgctcgatttagctcgatatagttgggtttggggagccagtctcagtcaggacacagcatggacatgagggtccccgctcagcctcctggggctcctgctactctggctccgagatcgccagatgtgacacccagactcgacccagtctccatccctccctgtctgccatctgtggganacagacgtcatcatctcgttgccggataagtcagtagtgttagttattttaattaaagttggtatctacgttacaaaccgaggaacgcccgttaagtctcctagtatctatgtctgactactccgtagtttaacgaaaggttccgggtaccagtacaagtcttagagtcggcgagtcggtatacgtaggactagttacgtttacacttctactactacgtacgtaagtacgtactaacaaccgtagtaagtatttcgactaacttactactctacaacgtagtagtaccgtacttacccgtcgtacctactaccggttaccggacgggtaaccgggtaaccgtaagggtacgggagtaacgtaaccggtaaacgtaccgttaggaccgtacgtaccgaactacccgtcgttacccgg

SEQ ID NO: 285841 - DNA, 587 bp, Homo sapiens
  misc_feature: GYAE6OF01AT3J1.4.57.F02.1.454.CMB.1.raw
  modified_base (212)..(212): a, c, t, g, unknown or other
  misc_feature (212)..(212): n is a, c, g, or t
  modified_base (296)..(296): a, c, t, g, unknown or other
  misc_feature (296)..(296): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctnttcgccgggcaagtcagagtgttagtatttattaatgtatctagttacaaacaggaactccctaagctcctgatctatgactcnctatcctaagtttaacaaggtcgggtacccagtacaagtattcgagtagctaggtaggactgtaggacacgtatttccactctacactagtacagtacgtactaaccaactagaacttatttcgaacctaactttacctctagtactaaacgtacggtaacgttaccgaccttacccccgtcgtaccttaccgtacggtttacgggaccgggtaacggtacccggaaagggtaggaaacgtactaaccggaaactaacgtgtacgtctacgacccgaactcgttcgttacg

SEQ ID NO: 285842 - DNA, 729 bp, Homo sapiens
  misc_feature: GYAE6OF01AYKYS.4.57.F02.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtgacacccagatgacccagtcctccatcctccctgtctgcatcgtggtggganacagngtcatcagtcctcttggccgggacaagtcgaagagttgttagttaattttaatttaaattggtatctagttacaaaccgagggaaacncccctaagcctccgtagactactatnctcgacacttacctaagtttaaccgaaagggtccgggtaccctaatacgaaagtacttcgtaggtcggacgtaaggtggtactacggtacgggaactaacggttactttacccgtacttcctacctaacctactaaccgtaacggttaaccgttaccttaaaccgtaaacccgttagtaaacgttacgttttaccgaaccgttaaacctttacttaaccgtacgtaactaaacctaacggttaacgtttaaccctacccgttaccccgttcctaacccgttacccgtaaccggtttaccgggaccgggtaaaccgggtaaaccggtaacgggtacggaaggtaaccgtaaaccggaaacccggtaacggttccgggtacggtaccgtacgaaccctacgtacgtttaccg

SEQ ID NO: 285843 - DNA, 851 bp, Homo sapiens
  misc_feature: GYAE6OF01AX4QN.4.57.F02.1.454.CMB.1.raw
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
tcagagcactgtagcacgaccggtgctcgatttagctcgatatagttgggtttggggagccgagtctcagtcaggacacagcagtggacatgagggtcccgctcagctcctgggctcctgctactctggctccgagatgccagatgtgaccaccagatcgacccagtcctccactccctcctgtcctcgcatcgngtggganacagagtcatcatctcttcggccggacaacgtcagtagttagttacgttaattttaattaaacgtggttacttactacggtttaaccaaaccggtaggtaaaccgtaccccgtaaagtcccgttaccgtacggtaacttaccgtagttaccgtcggtaactaccgtaaccttaccgtttaaacgtttaacggtaaacgggttccgggtaccctaaagtaccgtaaaggtaacgtttacgaggttcggtaccgtagtcgggtaaactcggtaacgggacgttaagttacgtttacccgaacgttaccgtaacctaaccgttaacgtaccgttaagtaaccgtttaacctaaccgttaaacctaagggttaaagtttaccgttttaggaaaccctttaaaacgtttacgttttaaccgtaacgtttaaaccgtaaccggtttaaagtttaaccgtttaaaacggttaaccgtttaacccggtaccgtttacccttaacggtttaacccggttaccggggaaacccggggtaacgggtaaaccccggttaaggggtaccggaaccggttaaaccggtaaccgtaaaacccggttaccgtttacggtacgggtacccgtaacccggtcccctaaacgttcccgttaaccccgg

SEQ ID NO: 285844 - DNA, 615 bp, Homo sapiens
  misc_feature: GYAE6OF01CVBIO.4.57.F02.1.454.CMB.1.raw
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (376)..(376): a, c, t, g, unknown or other
  misc_feature (376)..(376): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (426)..(426): a, c, t, g, unknown or other
  misc_feature (426)..(426): n is a, c, g, or t
  modified_base (526)..(526): a, c, t, g, unknown or other
  misc_feature (526)..(526): n is a, c, g, or t
  modified_base (600)..(600): a, c, t, g, unknown or other
  misc_feature (600)..(600): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgacacccagatcgacccagtctccatcctccctgtctgcagtcgtggtagggagacaggagtcattctatcctcgttcggccgggataagtcaagtagttgttaagttattttaatttaaagttggttatcgtagttacaaaaccgngggaaccnccctaagcttctagacttacagttcgctcgctactccgttaagttaacgaacggttcggtaccagtacaagtntcgagtggacnggtgntaggnggactagtactttcaacgtctacctaacnctacgtagtaacttacctaactaccgttagtaagttatttacgaattaaccttagtacgtctaacgtaacgtagtaaccgttactaccgttccctccgtntccgttacggttacgggacgggacggttaagacggtaggattaaggtaacccaaagggtccgtaggtacgcganacctccgtattcccg

SEQ ID NO: 285845 - DNA, 590 bp, Homo sapiens
  misc_feature: GYAE6OF01CQOSV.4.57.F02.1.454.CMB.1.raw
  modified_base (275)..(275): a, c, t, g, unknown or other
  misc_feature (275)..(275): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggacaagtcagagtgttagtatttatttaattggtatctagttacaaacgaggaacnccctaagcctcctgatactatgctgctactaccgtagtttaacgaaggtcgggtaccagtacaagtattcgagtggacgaggtaggatacgtaggactaggtactttaccacttcctacacctacgtacacgttacgtacctaaccgtaacctagtaacgttatttacgactaacttactaacgtatacaactagtacgttaaccgccttacccctccgtactcgtacggttcggacgggaacggtacgaacgggtacgaaagtaacggaaaccgtacgtggtacggtactacggaccaccgtagttcgttaccg

SEQ ID NO: 285846 - DNA, 759 bp, Homo sapiens
  misc_feature: GYAE6OF01BUTUI.4.57.F02.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (237)..(237): a, c, t, g, unknown or other
  misc_feature (237)..(237): n is a, c, g, or t
  modified_base (345)..(345): a, c, t, g, unknown or other
  misc_feature (345)..(345): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgaccacccgagactcgaacccagtcctccactccctcctgtctgcntcgtgtggganacagtacgtcatctatcttcgttcggccgggnaagtcgagtagttagtttaagttaatttaatttaagttcgtatacgtaacgtacaaacgtaacggaacgtacccctaagtcctactacgtattcgtaactgtaccgtntaccgtaactaccgttaagtttaaacgaacgggttccggtaccctaagtaacgtaaagtacgttacgaacggtggtaacgtaggttacgtaagttccgggtaaacggtacgttaggttaacctttaccgttaaccttacccttaaccgtaaccgttacgtacgttaaacgttaaccgttacctaaaaccgttaacgttaagtaactttaacgtttacgttaaaccttaacgtttaaacctacgtaacgttaacaacggttaacgttaccgttaacccgtacccttaacccgttacccgtaccgttacgtaacccgggttcgggaaccgggtaacgggtaacccgtaagggtacggtaacgaacgtaaacggtaaccgtacgtacggtacgtacgtacgaccttacgtctttccg

SEQ ID NO: 285847 - DNA, 546 bp, Homo sapiens
  misc_feature: GYAE6OF01BKRVU.4.57.F02.1.454.CMB.1.raw
  modified_base (273)..(273): a, c, t, g, unknown or other
  misc_feature (273)..(273): n is a, c, g, or t
  modified_base (539)..(539): a, c, t, g, unknown or other
  misc_feature (539)..(539): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagtagtgttagtatttatttaaattggtatcagttcaaaccaggaancccctaagctcctgatctatgctgcatccagttacaagtgggtccatacaagattcagtggctagtggatcgagggacagactttcacttctacacctatacagtactactacaaccgtagaacgtattttcgactaacttactactgtacaactacgtacttaacgccttacccctcgtcctacgtacgtttacgggacggtacgggaccgtaagggtacggaacgtagtacaaacgtacgtgtacggtctacgacctaccagtnttaccgg

SEQ ID NO: 285848 - DNA, 738 bp, Homo sapiens
  misc_feature: GYAE6OF01EIPNY.4.57.F02.1.454.CMB.1.raw
  modified_base (203)..(203): a, c, t, g, unknown or other
  misc_feature (203)..(203): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccactccctccctgtctgctatcgtggtgganacagagtcatcatctcgtggccggataagtcgagtagttgttaagttattttaatttaagttgtatacgtaagttaccgaaaacgacgggtaaacctcccctaagcctacgtagtacttctagtcgtctcgtactacttaccgttaagttaacgaacgggtccggtacctaagtacgtaaacgtcgttacgaggtcggacgtaggtaggtactacgggtaggaactaggttacttcgtaccttactaccaacgtacttacgtaacgttacaacctaacgtaacgttagtaaacgtttacgtttaccgaaccttaaccgtttaacgttaccgttacgtaaacctaacggttaacgttaaccggttaaccctacccccgttaaccccgtacgtaccgttacccggttaaccggttacccgggggaacggttaaacccgggtacggttaaacggggtcgtaaacggttacgtaaaaccgggaaccggttacggttcggtacgtacgtaacccgtaccgttaaccgtcggtttacccgg

SEQ ID NO: 285849 - DNA, 811 bp, Homo sapiens
  misc_feature: GYAE6OF01BUAIT.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacaccagatgacccagtctccatcctcctgtctgcatcgtggtgggagacagagtcaatcattccttcgttcggccgggactaagtcgaaggtagttagtttaagttaatttttaatttaaagtttggttactacgtacgtttaaccgaaaaccggaacgggaaaccgtaccccgtaaagccttacctgtacttacgtagtcgcgtacgactacgttaccgtaagtttaacgtaacgggtccgggtaccctaagttacgtaaagtacttaccgaggtacggacgtaggtacggtaacgttcggttacgggaacctaaggtttactttaccgtaaccgttcctaaccgtaaccttagttaaccgtaagttaaccgttacccgtaaactaacccgttaagttaaacgttttacgttttaccgtaaacctttaaaccgtttaaccttaaccgttacgtaaacctaaacgttaacggttaaccgtttaacccgtacccgttaaccccccgttccgttaccgttaacccgttacccgggtttaccgggaaccggggtacgggtaaaccggtaaacgggtacgggtaaacgtaaccgttaaaccggaaaaccggttaacggttacggtaccggttaacgaccggtaacctaaccgttacgtttacccgg

SEQ ID NO: 285850 - DNA, 659 bp, Homo sapiens
  misc_feature: GYAE6OF01DGZQH.4.57.F02.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (256)..(256): a, c, t, g, unknown or other
  misc_feature (256)..(256): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatccctccctgtctgcatctgtggganacagagtcatcatctctggccggnagtcagagtgttagttatttatttaattggtatntagttacaacgaggaacnccctaagcctctgatctatgctcgactactacctagttaacaaggttcgggtacccagtacgaaagtactacgagtagggactaggtaggattcgaggggtaactaaggttacttttaccacctttccaccgtaacctaactacgtaaacggtttacgttaacccttaaacctaaccgttaggtaaacgtttacttttacgaacctttaaaccctttaacgttaactagttaaccaaacgtaaggttaaccgtttaccgtaccctaaccccgttcccgtaccttaccgtacggtttcccgggacgggtaccgggaccgtaagggtacggtagtaacgtaaccgtaaacgtacgttcggtcgtacgtacgacctcgtacgttaccg

SEQ ID NO: 285851 - DNA, 502 bp, Homo sapiens
  misc_feature: GYAE6OF01BFS3I.4.57.F02.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (220)..(220): a, c, t, g, unknown or other
  misc_feature (220)..(220): n is a, c, g, or t
  modified_base (273)..(273): a, c, t, g, unknown or other
  misc_feature (273)..(273): n is a, c, g, or t
  modified_base (498)..(498): a, c, t, g, unknown or other
  misc_feature (498)..(498): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagngtcatcatctcttgccgggnaagtcagagtgttagtatttaatttaaattggtatcagttacaaacagggaanccctaagctcctgatctatgctgcatccagttacaaagtgggtaccatacaagattcagtggcagtggatcgtggacagtatttcactctacacatcagtacgtactactaacctgtaagtattttcgactaacttactactagtacaacagtacgtacgtactacccctctctctacgttcggcgaggaccagggtgagatcgaaacgatggtcgactagcacnttcg

SEQ ID NO: 285852 - DNA, 786 bp, Homo sapiens
  misc_feature: GYAE6OF01AU33P.4.57.F02.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccacttccctccctgtctgcatcgtggtggganacagagtcatcatcttcgtcggaccgganagtcgagtagttagttattatttaagttaagttggttactactagttaaccaaacgtaacgggaaacctacccctaaggtccttaccgtagtactccgttaactcgtctcgtactacttacccgttaagtttaaccgtaaacgggttcccgggtacctaacgtactaaacgtttacgttacgtacgggtcggacgttagggtaggtacgttcggtaagggaactagttactttccgaacctttcacccgtaactagttacgtacgttaaccgttaacgttacccaaacgtttaggaacgttttaacgtttacggtaacctttaaaccctttaacgtaacgtttaacggtaacaaacggtttaaggttacccggttaaccgtaaccccttaacccccggtttcgtacctttaccggttacccggtacccggggtaacggggaaacccggttaacggtaaccgggggttaagtaacgtaaaccccgtaaaccggggttaaacgtacgggttccggttaacggacccgttaacgtacccgtacgttcgtttacccg

SEQ ID NO: 285853 - DNA, 812 bp, Homo sapiens
  misc_feature: GYAE6OF01B18ZP.4.57.F02.1.454.CMB.1.raw
tcagagcactgtagcacgaccggtgctcgatttagctcgatatagttgggtttgggggccagtctcagtcaggacacagcatggacatgaggtccccgctcagctcctgggctcctgctactctggctccgagatgccagatgtgacacccagatgacccagtctccatcctccctgtctgcatcgtggtggagtacgagtagtcatcactctcgtgccggctaagtcagagttgttagttacttttaatttaaattggtacttctacgttaccgaaaacgtagggtaaaccgtaccccgtaacggtcctaccgtagtacgttcctagtcggtacgtcgtacctaacgttacccgtaaggttttaaccgaacggttccggggtaaccctaacgttaacgtaaacgttacgtttacggtaacggtacgggtaccgtagggttcggaacgttcggtaacgggtaccgtaaggttaacgtttccctaaccgttcctaacccgtaaccgtaacgttaccgtaacgtttaacccgtaaccgtaaccgttaacccgtaaggtaaaccgtttacgtttacgaaaccgtttaaaccgttttaaccgttaaccgttacgttaaacccgtaaacgtaacggttaacggttaaaccccgtacccgttacccccgttaccgttacgtttacccgttacggttacccggggtacgggtaaaccggggtaaccgtaaggggtaccggaacggttaacgaaaccggtaaaccggtaacggttacgtacggtacgtaccgtaaccgtaccttagtccgtttaacccgg

SEQ ID NO: 285854 - DNA, 670 bp, Homo sapiens
  misc_feature: GYAE6OF01D34IY.4.57.F02.1.454.CMB.1.raw
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (243)..(243): a, c, t, g, unknown or other
  misc_feature (243)..(243): n is a, c, g, or t
  modified_base (580)..(580): a, c, t, g, unknown or other
  misc_feature (580)..(580): n is a, c, g, or t
tcagagcactgtagcacgaccggtgctcgatttagctcgatataggttggggtttggggagccagtctcagtcaggacacagcagtggacatgacgggtccccgctcagctccgtggggcctcctgctactctggctccgagatgccagatgtgaccaccagatcgacccagtcctccactccctcctatcgtgacagtcgtggngggaanacagtatcatcattccgtcgtacggccggganaacgtgaaggttagttagtttaaagtttaattttaagttaacgttggtaactacgtaacgtaaccgaaacgggtaacggacctacccgtaatcctccgtataatcgttaagcgctacgtactaacgttacgttaaaggttaaacggaagggtcccgtacctaagtaactaaggtattcggaagtcggataaggtgtacgtacggtaggataacgttcttaacgcctaaccacaaccgtagtactaacgttacctaactaccgaaagttgtaaacttttctaccgaacttaactagttaacgtcaaaccgtagtaacgtctaaccgtcccctaccggnttaccgtacgtcggggtacggacgggtaacgaacggtagtagaaccacggttaaaccgaagtggtcgaccataaccgcctaagtttcgtc

SEQ ID NO: 285855 - DNA, 630 bp, Homo sapiens
  misc_feature: GYAE6OF01B52ZT.4.57.F02.1.454.CMB.1.raw
  modified_base (271)..(271): a, c, t, g, unknown or other
  misc_feature (271)..(271): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttgccggcaagtcagagtgttagtatttatttaaatgtatcagttacaaacaggaacnccctaagctcctgtactctatgctgcattcctaagtttaacgaaaggttcgggtacccagtacaagtattacgaggtcggctaggtcggatcgtagggactagtactttacacttctaccacctatacagttactacctaactaaccgtagtaagttacttttacgaccttaaacctttacttaaccgttacgtaaccaaacgtaacgtaacgtttaaaccgaccctttacccccgtccgttaccttaccgttaccgtttccggggaccgggtaacgggtaacccggtaagggtacgtaacgtaacgtaacgtaaaccgtagtcggtacgtacgtacgaccctaacctgttccgttacg

SEQ ID NO: 285856 - DNA, 645 bp, Homo sapiens
  misc_feature: GYAE6OF01D4K7T.4.57.F02.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (624)..(624): a, c, t, g, unknown or other
  misc_feature (624)..(624): n is a, c, g, or t
tcagagcactgtagcacgaccggtgctcgatttagctcgatatagttgggtttggggagccagtctcagtcaggacacagcatggacatgagggtcccccgctcagctcctgggctcctgctactctggcctccgagatgccagatgtgaccacccagatcgacccagtcctccactccctccctgtctgctatcgtggtggganacagagtcatcatctcgtggccgganaagtcagtagttagttagttattttaatttaagttggttatcgtaagttaccaaaccgtaagggaaaccgtcccctaagcctaccgtagtacttctatcgctcgactactacctaagtttaaacgaacgggttcgggtaccctagtacgtaagtacgttacgaggttcggacgtaggtcggtagtcgtaggactagtactttaccactcctacacctatacgtaagtactactaaccgtaactagtaatttactttcgaacttaacctttacttagtacgtaacaaacgtaagttacgttaacctacccttaccccctcgtactaccgttacggttccgggacggtaaccgggaacgtaagggtcgaatacgaacgaaaccgtagtcggtacncgtagaccctacgtgttaccg

SEQ ID NO: 285857 - DNA, 726 bp, Homo sapiens
  misc_feature: GYAE6OF01A4347.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacacccagatgacccagtctccatccctccctgtctgcatctggtggganacagagtcatcatctcttggcggcagtcagtagtgttagttatttattaaattgtatcagttacaacaggaactccctaagctctgactctatcgactgctatacctaagttacaaaggttcgggtaccctaagtaccaaagtactttacgaggtaggacgtaggtggtacttaccggtaggggtaactaacggttacgttttacccaaccgtttctaccctaacctaagttaccccgtaaaggtttaacgttacccttaaacgtaacccgtttaaggttaaacggtttaccttttacggaaccctttaaaccgtttaaccgttaacgttacgtaaccctaaacggttaacgttaacgttaacccgtaacccgttaacccccgtttacccgtaacttacccgtttaacccggttaccgggtaccgggtaaacgggttacccggaaagggttaacgggtaacgtaacccgtaacggtaaaaccgtacgttcggaacggtactacggtacccaccgttacgtccggttaccg

SEQ ID NO: 285858 - DNA, 655 bp, Homo sapiens
  misc_feature: GYAE6OF01D8M89.4.57.F02.1.454.CMB.1.raw
  modified_base (646)..(646): a, c, t, g, unknown or other
  misc_feature (646)..(646): n is a, c, g, or t
tcagagcactgtagcacgaccggtgctcgatttagctcgatatagttggggtttggggagccagtctcagtcaggacacagcatggacatgagggtcccccgctcagctcctggggctcctgctactctggctccgagatgccagatgtgaccacccagatcgacccagtcctccattccctccctgtctgcatctggtggagacaggatcatcattctcgtgccgggacaagtcagtagtgttaagttatttaattaagttggtatctagttacaaacgacggaacaccctaagtcctcgtacgtattactatcgtctgactactaccgtaagtttaacgaaaggttccgggtaaccatacgtaagtacttcgagtcgacgtaggtcgagtcgtaggactagttacttcgtactcctacaacctatactaacgttacgtaactaacctaaaccgttagtaaatttacgttaccgtaaccttaacctttacgtactttacggtacaaaccgtaaggttaaccgttaccgtaaccctaacccccgttcgtaccttacgtaccggttacggacgggtaaccggtacgtaagggtcggtaaataaccgtacgaaaccgaagtttcggacgttacgaaccgcttaaccgntttacccgg

SEQ ID NO: 285859 - DNA, 573 bp, Homo sapiens
  misc_feature: GYAE6OF01AX3KC.4.57.F02.1.454.CMB.1.raw
  modified_base (198)..(198): a, c, t, g, unknown or other
  misc_feature (198)..(198): n is a, c, g, or t
tcagagcactgtagcacgaccggtgctcgatttagctcgatatagttgggtttgggggccagtctcagtcaggacacagcatggacatgaggtcccgctcagctcctggggctcctgctactctggctccgagatgccagatgtgacacccagatcgacccagtcctccatccctccctgtctgctatctggtggganacagagtcatctatctctcggccggcaagtcagtagtgttaagttatttaatttaattggtatctagttacaaacgaggtaacacccctagctctagactactatgtctgactacttctaagttacgaaggttcggacatacgatatcaggtgacgtagtgtagtcggtagacgtgtacttccactctacacctatactagtactacacatagacttattcacctacttactacgtcgtaacaagtcgtaacgttaccgaaccttccccgaaccttccttaccgttaccggtagggaccggtacgggtaaccgaagggtcgaactaagtaacccgtaaaggtactcggtacgacctactacgtctattccgtacg

SEQ ID NO: 285860 - DNA, 687 bp, Homo sapiens
  misc_feature: GYAE6OF01E58OD.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatcctccctgtctgcatcgtggtggagacagagtcatcatctcgttggccggacaagtcagtagtagtttaagttaattttaattaaagttggtatactaacgttaacgaaaccgagggaaacctccccgtaagtccttacctagtacttactagtcgctacgactacgttaccgtaaggtttaacgaacgggtccgggtaccaagtaccgtaaagtacttacgaggtcggactaaggtaggtacgtcggtaggtactaagttactttaccaccgtacctacacctactacgtaacgttacgtactaacgaaccgttagtaatttactttacgaaccttaacttactaacttacgtaacaacgtaacgtaaccgttaaccgtaacccttaccccgtaccgtaccttaccgttaccggttaccgggaccggggtaacgggtaaacccgtaagggtacggtaagaacctaacggaaaaccgtagtcggtacggacttaccgacctacctagttacccg

SEQ ID NO: 285861 - DNA, 770 bp, Homo sapiens
  misc_feature: GYAE6OF01A7S4Q.4.57.F02.1.454.CMB.1.raw
  modified_base (198)..(198): a, c, t, g, unknown or other
  misc_feature (198)..(198): n is a, c, g, or t
  modified_base (226)..(226): a, c, t, g, unknown or other
  misc_feature (226)..(226): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatcgtggtggganacagatcatcatcctcgttcggccgganaagtcaggtagttagtttagtaattttaatttaaagttggtatcgtaagttaccaaaaccgaagggtaaaccgacccctaaggtcctaccgttgtacttcgtatcgtctagcctattacccgttaagtttaaacggtaaacgggttcgggtaccccaagtaacgtaaggttactcgtaaggttcgacgtaaggtggtacgtcgtagggaactagttacttcctacgtacctaccaccgtatacgtagtaacgttaccaacctaacgttagtaacgtttacttttacgaaccttaaaccgttttaccaacgttaccggtaactaacgacgttaaccggtttaaccccaaccgtttacccccctaccgttaccgttaccgtttaacccgggtttacccggggaaccggggttaaccgggaaacccgggtaaaggggttcgggtaaacccgtaacccgttaaaccgggttaaaaaacccggacgttaggggttaccggtaacccttacggtaacccctaaccctttagggtttaccctttacccggg

SEQ ID NO: 285862 - DNA, 182 bp, Homo sapiens
  misc_feature: GYAE6OF01ADYI2.4.57.F02.1.454.CMB.1.raw
  modified_base (174)..(182): a, c, t, g, unknown or other
  misc_feature (174)..(182): n is a, c, g, or t
tcagagcactgtagcacgaccggtgctcgatttagctcgatatagttgggtttgggggaagaggaagactgacggtcccccaggagttcaggtgcgtgggcacagcggccctgggctgcctggtcaaggactacttccctacagtgctctgagcgggcgtggcaaggcgcatgnnnnnnnnn

SEQ ID NO: 285863 - DNA, 598 bp, Homo sapiens
  misc_feature: GYAE6OF01CJWDJ.4.57.F02.1.454.CMB.1.raw
  modified_base (222)..(222): a, c, t, g, unknown or other
  misc_feature (222)..(222): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccacccagatcgacccagtctccatccctccctgtctgcatctggtgggagacagagtcatcatctctgccggnaagtcagagtgttagtatttatttaattggtatcagttacaaacgagggaacgcccctaagcctcctagattctatgctgcatctaagttacgaagtcgggtccatacaagtatcagtgcagtggtactcgtaggactagtacttcactcctacacctactacaagtactactaaccaacgttagtaagttacttttacgaaccttaactttaacttactacgtacaaacgtacgtaacgttaccgaaccttacccccgttaccgtaccttacgttacccgttcgggaccgggtaacgggaaccgtaaggtcgggaacgtaacgtaaccgtaaacggaagtcggtacggaccttacgaccaaccctgttccgtacg

SEQ ID NO: 285864 - DNA, 625 bp, Homo sapiens
  misc_feature: GYAE6OF01EC0BE.4.57.F02.1.454.CMB.1.raw
  modified_base (329)..(329): a, c, t, g, unknown or other
  misc_feature (329)..(329): n is a, c, g, or t
  modified_base (422)..(422): a, c, t, g, unknown or other
  misc_feature (422)..(422): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgcagatgtgacacccagatgacccagtctccactcctccctgtctgctacttcgtggtgggagacaggactcaatcattctcgttcggccgggactaagtcagtagttgttagttaattttaatttaagttggtatctaagttaccaaacgaggaaacctaccctaagcctctagtacttctagtcgcgtnactactctaagtttaacgaggtcgggtacccagtacaagtacttgagtggacgtagtggtactagtaggatatacttccactcgtaccaactntacgtactaacactaactacgtagtaacttatttaccgacttaacctttacgacgttacgtaacaactaggtaaccgttactacccgttaccctccgtacttaccgtacggttcggaacgggtacggaccgggtaaggtacggaacttacgaaacccgtaacggtagttacggtacgacgtacgtaccctacgtaagttcccg

SEQ ID NO: 285865 - DNA, 617 bp, Homo sapiens
  misc_feature: GYAE6OF01E2MXQ.4.57.F02.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccacccagatcgacccagtcctcctactccctccctgtctgctatctggtggganacagagtcatcatctcgtcggccggacaagtcagtagttagttagttatttaatttaatgtatctagtacaaacgaggaacaccctagctacnatcatcgctgctactcgtaagttacgaacggtcggtaccatactaagtctacgagtgacgtagtgatcgagtactagttacttcacttcacctactagtacctagttactaccttaaccaacgtagtaacgttattccgtaaccttaacgtttactacctacgtaacaaccgtgttaaccgttaaccctaccctacccccgtcgtacttcccgttacggttccgggaacggtaccgggtaaccgaaagggttacggaacgtaaaccctacggaaaacggttactcgggtaccgtctaccggaaccctacgtcttcgtaccg

SEQ ID NO: 285866 - DNA, 626 bp, Homo sapiens
  misc_feature: GYAE6OF01C60V4.4.57.F02.1.454.CMB.1.raw
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
  modified_base (475)..(475): a, c, t, g, unknown or other
  misc_feature (475)..(475): n is a, c, g, or t
tcagagcactgtagcacgaccggtgctcgatttagctcgatataggttggggtttgggggagccagtctcagtcaggacacagcatggacatgagggtcccccgctcagctcctggggctcctgctactctggctccgagatgccagatgtgaccacccagatcgacccagtcctccatccctccctgtctgctatcgtggaggganacagngtcatcatctcgttgcgggacagtcagtagtagttaagttattttaattaaattggttactcgtacgttaacaaaccggaagggtaaaccacccctaagcctccgtagattccgtaatcgtctacgactacgtacctaacggtttaacgaacggttccgggtaccaagtacaaagtntacgaggngacgagtgtactggtaggactagtacttcactactcctaacncgtacgtagtactactaacctaacgtagtaacgttnttacgactaacttactactctaactaacgtaacgtacgtaacctaccttacccctacgaccgttaccgacggttcggaccggaacgggtaacaaggggtagaagtaacgtaaccgtaaacgacgttacggtcggactagaccactacgtcg

SEQ ID NO: 285867 - DNA, 783 bp, Homo sapiens
  misc_feature: GYAE6OF01DV2AG.4.57.F02.1.454.CMB.1.raw
  modified_base (359)..(359): a, c, t, g, unknown or other
  misc_feature (359)..(359): n is a, c, g, or t
  modified_base (390)..(390): a, c, t, g, unknown or other
  misc_feature (390)..(390): n is a, c, g, or t
tcagagcactgtagcacgaccggtgctcgatttagctcgatatagttgggtttgggggccagtctcagtcaggacacagcatggacatggacgggtccccgctcagctccgtgggcctcctgctactcgtggctaccgagatgccagatgtacgaccacccagactcgacccagtcctaccacttccctccctgtctgcctagttcggtgggtagggaacacgtagagtcactactatttcctcgttcgggacccgatacgtcgagttaggttacgttttaagttttaagttttaaagtttaaagttgttaacgttacgtaacgttaaccgaaaccggtacggaaccctaccggttaancccttacgtagtacttcgtagtcggtacctntaccgttaactttaccgttaaggttaccggtaacggtccggtacaacgttaacgtaagttcgttacgggtagttcggtacgtagggttcggtagttacgggacggtaaacgtttcgtttaccgtttaccgtacccgttaaccctaccgtaacttaccgttacgtaaaccggtttacctaaaccgttaaccgaactttaaggttacgtttactttaccgtaacttaaccgtttactacgtttaacgaacctaacggtacttaaaccggttacctaaccctccccgtactttccgtacgtaccgggtacggaccggacggtaccgtaaggtacggaactaccggaaacgtacgtacgttggaccgtaacgtcaacccgttcttgtcccgttaccg

SEQ ID NO: 285868 - DNA, 680 bp, Homo sapiens
  misc_feature: GYAE6OF01C40N1.4.57.F02.1.454.CMB.1.raw
  modified_base (231)..(231): a, c, t, g, unknown or other
  misc_feature (231)..(231): n is a, c, g, or t
tcagagcactgtagcacgaccggtgctcgatttagctcgatatagttggggtttggggagccagtctcagtcaggacacagcatggacatgagggtccccgctcagctcctggggctcctgctactctggctccgagatgccagatgtgaccacccagactcgacccagtcctccactccctcctgtcctgcatcgtggtggagacagagtcatcatcgtctcggccgganaagtcagtagttagtttagttattaatttaagtgtatactacgttaacaaacggtaggaaccgtaccctaagcctacgtgacttctatcgctgtacacttacgtagttaacgaacggtcggtacctaagtacaaagttactagacgtcggactaggtagactacggtaggtaactaggttcttacacttaccctacgaaccttagtaccgtaaggttaacctaccgtaaaccgtacgttagtaaactttcgtttaactaaccttaacgtttaccgtaacgtacgtaacctaaagttaccgttaacgttaacccgtacccgttaaccccctcgttacccttacggttacccgttaggggtacccggtaccgggaaacggtaagggtacgtaagtaacctaacggaacgtaccgtttggaccggtacttacccgaacctagtcgtttaccg

SEQ ID NO: 285869 - DNA, 807 bp, Homo sapiens
  misc_feature: GYAE6OF01CE5N2.4.57.F02.1.454.CMB.1.raw
  modified_base (199)..(199): a, c, t, g, unknown or other
  misc_feature (199)..(199): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtcctccatccctccctgtctgcatctggtgganacagagtcatcatcctcttggccggacagtcgagtagttagtttaagttaattttaatttaagttggtacttacgtaacgtttaaccgaaaacgtaacggggtaaaccgccccgtaaagtccttaccgtagtaaccttcgttaacgtcgtctcgacctaacgttacccgtaagtttaacgaaacgggttccgggtaacccctaagttaccgaaagttacgttacgtagggtacgacgtaggttacgggtacgttcgggtaacgggtactaacggtttaccttttaccaacctttccgtaccaacctacgttacgtacgttaacgtaccctaaacgtaaccgttagtaacgttacgttttaccaacctttaacctttacgtaaccgttacgtaacgtaaaccgttaagttaaccggtttaaccctacccgtttaaccccgtcccgttaccgttaccgttaaccggtttaccccgggaacggggtaaaccggaaacccgggttaaaggggttacgggtaaccctaacggttaaacccggtaaaacccggttacggtttaccgggtacggttacctaacccggttacccgtaaaccgttctttaaccccgg

SEQ ID NO: 285870 - DNA, 663 bp, Homo sapiens
  misc_feature: GYAE6OF01BZ8F1.4.57.F02.1.454.CMB.1.raw
  modified_base (200)..(200): a, c, t, g, unknown or other
  misc_feature (200)..(200): n is a, c, g, or t
tcagagcactgtagcacgaccggtgctcgatttagctcgatatagttgggtttggggagccagtctcagtcaggacacagcatggacatgagggtccccgctcagctcctgggctcctgctactctggctccgagatgccagatgtgaccacccagatcgacccagtctccactccctcctgtctgcatcgtggtggganacgagagtcatcagtctcgttcggccgggacaagtcgagtaggttagtttaagtttattttaaagtttaagttggtactacgtaagttacaaaccgaacgggaaacctacccctaagtcctacgtagtaacttctatcgtctacgtctacttccgtaagtttaaacgaacgggttccgggtacctaatacgtaagtacgttacgtaggtaggtacgtaggtaggtacgtacggtaggactagttactttcgactcctaccaccgtagtactagttactacctaacgaacgttagtaacgtttattacgtaacctaacgtttactacttacgaacaacgtacgtacttaccgtaccctaccctccgtcttaccgtcggttacggacggtaccgggtaacgtaagggtacgtaatacgaaccgtaaacgtacgtacggtcgtacacgaccctaaccgttgttacg

SEQ ID NO: 285871 - DNA, 796 bp, Homo sapiens
  misc_feature: GYAE6OF01DVNUE.4.57.F02.1.454.CMB.1.raw
  modified_base (217)..(217): a, c, t, g, unknown or other
  misc_feature (217)..(217): n is a, c, g, or t
tcagagcactgtagcacgaccggtgctcgatttagctcgatatagttgggttggggagccagtctcagtcaggacacagcatggacatggacgggtcccccgctcagcctccgtggggctcctgctactcgtggcctccgaagatcgccagatgtacgaccacccagatacgaacccagtcctccacttccctcctgtcctgctatcgtggtggaanacagtagtcatcatctcgtcggccgatagtcagtagttagttaagttattttaagtttaagtgttatacgtaagtaaccgaaacggaaggtaaccccgtaccctaagtcccttacgtacgtacttctaacggtcgtcgtcacgttaacttaaccggttaagtttaaaaccggacgggttaccggtaaccctagtaaacgtaaacgtttacgtaccggtaggtcgggtaaacgtaggttacggtacgttaccgggtaacggtaaacgtttaacgttaaccctttaccaacccgtttacccgtaacctaaccgttaacgttaccgggttaacgttaacccgtaaccttaaaccgtaacgttaagtaacgttttaacttaccgtaactttaaaccctttacgtaacgtaccgtaaagtaaccgttaacgttaaacccgttaccctaaccccgtcccccgttacgtaccgttacggttaacccgggttaccggggaaccggtaacgggtaaccgtaaggggtcgaaacgtaaccgtaaacgtaaacggttgtacgggacgtactaccgactacgttcttaccg

SEQ ID NO: 285872 - DNA, 723 bp, Homo sapiens
  misc_feature: GYAE6OF01EDLOX.4.57.F02.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
tcagagcactgtagcacgaccggtgctcgatttagctcgatatagttggggtttgggggccagtctcagtcaggacacagcatggacatgacgggtccccgctcagctccgtggggctcctgctactcgtggctccgagatcgccagatgtgaaccacccgagactcgacccagtcctccactcccgtcctgtcngctagtcgtgggtagggacacgaaggntcaactcattcctcgttcggacccgggataacggtacgaggttagttaggtttaagttaagttttaatttaaagttaggttatagtacgttaacgaaaaccggtaacggggtaaaccaccccgttaataccgttacgtacgtattactagttcgacgtacgactaacgttaccgtaagtttaacgaaacgggttcgggtaccaattacgaattacgtaccgtaggtgtacgtaggtcgtagtacgtacggtataagtacttaccacttcgaaccctactacgtacgtactacgtaactaaccgtacgtagttaagttcttacgtaacctaaactttacacgttacgtacgaaagtcgttaaacctaccgtttacccgtacccctaccggttactaccgttacggtaccggggtaaggaccggtaaggaacggtacggaacgtaacaacggtaaacccggttgaacggtcgtaccgtacgaacgtaccgttgtaccgtttcg

SEQ ID NO: 285873 - DNA, 685 bp, Homo sapiens
  misc_feature: GYAE6OF01B8SFF.4.57.F02.1.454.CMB.1.raw
  modified_base (346)..(346): a, c, t, g, unknown or other
  misc_feature (346)..(346): n is a, c, g, or t
tcagagcactgtagcacgaccggtgctcgatttagctcgatataggttgggtttgggggccagtctcagtcaggacacagcatggacatgacgggtccccgctcagctccgtggggctcctgctactctggctccgagatgccagatgtcgaccacccagactcgacccagtcctccactccctccctgtctgcatcgtggtgggacacgagagtcatcattctcgttacggccgggactaaggtctaggtagttaggttaagttaattttaagttaaagttggtaatctaacgttaccaaaaccggacgggtaaacctcccctaagtcctacctagtactcctancgctgactactccgtaaagtttacgaaacggttcgggtacctatacgtaaagtgttcgaaggtcgacgtaggtggtaacgtcgtagggtaactacgtactttaccgacctctaacctacgtatacgtaagtacgttaactaaccgaacgttagtaaacttctttacgaaccttaacttacctaagttctaacgaacgtacgtaacgtaccgtaccctaacccctcgtacttaccgtaccggttacggaccgggtaacgtacggtaacggtaggtaacgtaacctaacggaaacgtacggttacggacggtacctacggaccctactaacgtcgttaccg

SEQ ID NO: 285874 - DNA, 576 bp, Homo sapiens
  misc_feature: GYAE6OF01E2RJG.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatcgtgtgggagacagagtcatcatctcttgccggcaagtcagagtgttagtatttattaattgtatcagttcaaacaggaacgcccctaagctcctgatctatgctgcatccagtttaacaaaggtcgggtacccatacaagtattcgagtggcaggtggatcgtagggacagtactttacaccttctaccaacctagtcgtaacgttagttacctaacgtaacctgaacgtattttcgacctaaactttacctaacttgtacaacagtaacgttacgtaccttacccctccgtccttactaccgtttcgggacggtacgggtaccgaagggtacggactaagtaccgaaacgacgtacggtcggtactacgacctacctcgtcgttaccg

SEQ ID NO: 285875 - DNA, 663 bp, Homo sapiens
  misc_feature: GYAE6OF01DJ51R.4.57.F02.1.454.CMB.1.raw
  modified_base (162)..(162): a, c, t, g, unknown or other
  misc_feature (162)..(162): n is a, c, g, or t
  modified_base (248)..(248): a, c, t, g, unknown or other
  misc_feature (248)..(248): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (650)..(650): a, c, t, g, unknown or other
  misc_feature (650)..(650): n is a, c, g, or t
tcagagcactgtagcacgaccggtgctcgatttagctcgatatagttgggtttggggagccagtctcagtcaggacacagcatggacatgacgggtccccgctcagcctccgtggggctcctgctactctggcctccgagatgccagatgagaccacccagntcgacccagtcctccactcctccctgtctgctatcggtggtaggggaacacgaaggtactacactctactcttcgtcggccggtanagtcaggtagttgttaagtttatttaatttaagttgtatacgtaacgtaacaaacggaacgggaacctaccgtaacgtcctactagtactctagcgtctacgtactactacgtagttaaggacggtcgtacctagtaagagtacgtacgagtcgagtgtaggtctacggngtaatnttacgttacaccttacacctaactagtaacgtagttacctacgtaactaaccggttataacgtttacttaacggtacttaactttaccgtaagtctaaaccgtaagttaaccggttaacgtaaccccgtaccttaaccccgtccgttaccgtccggttaacggtccgggtaaacggaccggtaactacgggtaagagtaacgtaaacgaacgtcgtagtcgacgtnactaccgtgtacc

SEQ ID NO: 285876 - DNA, 178 bp, Homo sapiens; identical to SEQ ID NO: 285644
  misc_feature: GYAE6OF01DYOUY.4.57.F02.1.454.CMB.1.raw
  modified_base (173)..(178): a, c, t, g, unknown or other
  misc_feature (173)..(178): n is a, c, g, or t

SEQ ID NO: 285877 - DNA, 792 bp, Homo sapiens
  misc_feature: GYAE6OF01E3FTO.4.57.F02.1.454.CMB.1.raw
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtcgaccacccagatcgacccagtcctccactccctccctgtctgctatcgtggtgggacacgagagtacatctacttcctcgttcggccggacaagtcgagtaggttagttaagttaatttttaagtttaaaagtttggttaacttacgtaacggtttaacccaaaaaccgggtaacggggaaaaccctcccccgttaaaaggtcccttaccgttaacggttaacttccgtttaagtcggtccttacgtacctaacgtttaacccgtttaaacggttttaaaccggtaaacggggtttccgggtaacccctaagtaaacgtaaaggtcgtttacgtaaggtcggaacgttaagggtggttaacgtcggttaacggacttaaacggttactttaccgtaccttaccgtacctaaccttaacgttacgtaacgttaacgtaccttaaacctaccgtaagtaatttaccgtttactaacgttaacttacgtactacgtaactaagtacgtactaaccgtaccttacccctctacttaccgtaccggttacgggaccggtaaccggtaacgaaggggtacgtaacgtaacgtaaaccggtaaacgtcggttaacgggtccgtaactacccggacctccgtacttaccgg

SEQ ID NO: 285878 - DNA, 724 bp, Homo sapiens
  misc_feature: GYAE6OF01CGU2J.4.57.F02.1.454.CMB.1.raw
  modified_base (193)..(193): a, c, t, g, unknown or other
  misc_feature (193)..(193): n is a, c, g, or t
  modified_base (715)..(715): a, c, t, g, unknown or other
  misc_feature (715)..(715): n is a, c, g, or t
tcagagcactgtagcacgaccggtgctcgatttagctcgatatagttgggtttggggagccagtctcagtcaggacacagcatggacatggagggtccccgctcagctccgtggggctcctgctactctggctccgagatcgccagatgtgaccacccagacgtcgacccagtcctaccactccctcctgtcngcatcgtggagggagacgagtacgtcatctactctcgttcggccgggataaggtcgaaggttaggtttaagttaagtttaattttaaagtttaaagttaggttactacgtaacgttaaaccgaaaccggtaacggggaaaccctacccgtaacgtccttccgtagacttacctagtcgctagtactacgtacgttaacgttaaacggtaacgggtaccgggtacccaagttaacgtaaaggtacgttaggacgtcgggtacgtaggttaggtaccgtaggtacggtactaaggttaccttacgtacctacctacaacctacttaccgaaagttacttaactaaccgtacgtaacgttaagttacttaccgtaaccttaacgttcttaacgtaacgtacgtaacgaacggttacttacccgtaccctaccgtaccgttacctccgttaacgggtcggaaccggggtaaccgagtaacgggttagaactaacggaacctaggtacgtgacggtacactacccgntccgttacg

SEQ ID NO: 285879 - DNA, 655 bp, Homo sapiens
  misc_feature: GYAE6OF01AOWLS.4.57.F02.1.454.CMB.1.raw
tcagagcactgtagcacgaccggtgctcgatttagctcgatatagttgggtttgggggccagtctcagtcaggacacagcatggacatgacgggtccccgctcagctcctggggctcctgctactctggctccgagatgccagatgtgaccacccagatcgacccagtctccactccctccctgtctgcatcgtggtagggagacagacgtcaatcatctcgttcggccgggcaaggtcaggtagttgtttagttattttaatttaaagttggttaatctagttaccaaacgaagggaaccgtacccctaagtcctacctgactactatcgtctgctactaccgttaagtttaacgaaggttcgggtaccagtactaagtatcgaggtgacgtaggtggtagtcggtaggactacgttacttccacttcctccaactacgtacgtacgttactacctaacgtaacctagtaacgttactttacgacttaacttaccgttacgtactactaactacgtaacgtaccgtaaccttacccctccgtcttaccgtacgttacgggaccgggacggtaaccgagggttacgaacggtaacgtaaccgtaaacggtaccgttggtacggtaccgtacgtaccctaccttagttccgttacg

SEQ ID NO: 285880 - DNA, 847 bp, Homo sapiens
  misc_feature: GYAE6OF01E0TTC.4.57.F02.1.454.CMB.1.raw
tcagagcactgtagcacgaccggtgctcgatttagctcgatatagttgggtttggggagccagtctcagtcaggacacagcatggacatgagggtcccccgctcagctccgtggggcctcctgctactcgtggctccgagatcgccagatgtacgaccacccagatcgacccagtcctccactccctccctgtctcgctatcgtggtggacgacagatcatcattccgtcgtcggaccggataacgtcgagtagttagtttaagtttaattttaagtttaaagttggtatactaagttaaccaaacggaacggaaccgtacccgtaagccttaccgtagtacttactagtcgtctacgtactacgttaaccgttaacgtttaaacggaacgggttcccgggtaacccctaagtaaccgtaaacgttacgttacggtacgggtacggtaaccggttagggtagggttaaccgtcgggtaacggggtaactaacgtttaaccgtttaccgtacccttaccgttaaccccaaccgttaagtttaaccgtaaacgggtttaaacccgttaaccgtaaaaccgtttaaacccgttaacggttaaacggttttaagttttaaacccgtaaacctttaaacccttttaacgttaaccttacgttaaaccgtaaaccgttaacgggtaacccgtttaacccgtaacccctttaacccccgttacgttacccgttacccgttaaccggtaccgggaacccgggtacgggtaaaaccccggtagggtaaccgtaacggtaacccgtaaacgaaaccggttagtcggtacgtcctaccggaccctacgttccgttacg

SEQ ID NO: 285881 - DNA, 578 bp, Homo sapiens
  misc_feature: GYAE6OF01AKLZW.4.57.F02.1.454.CMB.1.raw
  modified_base (197)..(197): a, c, t, g, unknown or other
  misc_feature (197)..(197): n is a, c, g, or t
  modified_base (276)..(276): a, c, t, g, unknown or other
  misc_feature (276)..(276): n is a, c, g, or t
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtgacacccagatgacccagtctccatcctccctgtctgcatctgtggganacagagtcatcatctcttgccgggcaagtcagagtgttagtatttattaaattgtatctagttacaaaccgaggaaacnccctaagcctacctgatctatgctgcatcctaagtttacaaacggtcggggtacccaatacgaaagtattcgagtcggacgtaggtggatcgtagggactagtatttcacttcacactatctagtatacctaactaactagtaagttatttcgactaacttactactagtaacaactaagtacgttacgtaccttaccccgtaccgtactaccgtacggtttccggacgggtaaccggaaccgtaagggtacggaagtacgtaaccgaaacgtacgtacggtcgactagactacctgttccg

SEQ ID NO: 285882 - DNA, 762 bp, Homo sapiens
  misc_feature: GYAE6OF01A8WCR.4.57.F02.1.454.CMB.1.raw
  modified_base (101)..(101): a, c, t, g, unknown or other
  misc_feature (101)..(101): n is a, c, g, or t
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (315)..(315): a, c, t, g, unknown or other
  misc_feature (315)..(315): n is a, c, g, or t
  modified_base (339)..(339): a, c, t, g, unknown or other
  misc_feature (339)..(339): n is a, c, g, or t
  modified_base (474)..(474): a, c, t, g, unknown or other
  misc_feature (474)..(474): n is a, c, g, or t
tcagagcactgtagcacgaccggtgctcgatttagctcgatatagttgggtttggggagccagtctcagtcaggacacagcatggacatgagggtccccgntcagctcctgggctcctgctactctggctccgagatgccagatgtgacaccagatgacccagtctcatcctcctgtcngcatcgtggtaggagacngacgtcatcattccttcgttcggaccgggtataacgtcgaagtggttttagttaagtttaattttaagtttaaaagttcggttatactaacgttaccgaaaaccggtaggtaaacccncccgtaagtccgtacctagacttntacgtcgctacgctacttaccgttaacgttaacgtaacgggttccgggtacctaagtaacgtaacggtacttcgtagtacggtcgtaaggtgtacgtacggaggtacgtagtttattccgacttcgcctaacctntacgaatttacctacaacgtactaggttaacttcggtttacaaccctacgtttaactacgttaacgtaaccaacgggttaacgtacccgtttaaaccgtaccccgttacccgttaccgtacgtttacccggtaaccggttccggggggtaacggaaacccggtttaacgggtaaaccgggttacggtaacccgggttaaaacgttacccgttaaaaccgggggttccgttacggggttaaccccgttagaaccccgtaaccttaaaccccggggttcttaaacccggg

SEQ ID NO: 285883 - DNA, 822 bp, Homo sapiens
  misc_feature: GYAE6OF01DYJCL.4.57.F02.1.454.CMB.1.raw
  modified_base (182)..(182): a, c, t, g, unknown or other
  misc_feature (182)..(182): n is a, c, g, or t
  modified_base (200)..(200): a, c, t, g, unknown or other
  misc_feature (200)..(200): n is a, c, g, or t
  modified_base (216)..(216): a, c, t, g, unknown or other
  misc_feature (216)..(216): n is a, c, g, or t
tcagagcactgtagcacgaccggtgctcgatttagctcgatatagttgggtttggggagccagtctcagtcaggacacagcatggacatgacgggtccccgctcagctccgtggggctcctgctactcgtggctccgagatcgaccagatgtacgacacccagactcgacccagtcctaccncttccctcctgtctgacnttcgtggtaggggaanaacgagtacgtactactactcttccgttcgttccggaccggggtactaagtcgtaaggttagtttaggttttaagttttaaatttttaaagttttaagtttagggttaacttacgtaaacgtttaaccgaaaaacgggtaacgggtaaaacccgtaaccccgttaacggtacccgttacgttacgtacgttactagtcgtctactacgtacttaacgttaacggttaaacggtaacggtcgggtaacctacggtaaactaacgtacgtagtacgggtgtaccggtagtaggtaccgtacgggtaccggaatacggtttcttaccgtacgttaccacgtaaccttagtacttacggtaacttaacgtacctaacggtttacgaacggtttaacttacgtaacgtttaacgttaactttacgtaaccgtaactaaaacgggtttaccgtaacgttaaccgttaaccccttaccggtacccttaccgttaccgttccggtaaccggggacggtaacggtaaccgggtaacggtaaccggttaaggaaccgtaaacggtaaaccggttcggtaccggttacgcgttaacgtacccagttaacccggttcg

SEQ ID NO: 285884 - DNA, 1075 bp, Homo sapiens
  misc_feature: GYAE6OF01BJVIY.4.57.F02.1.454.CMB.1.raw
tcagagcactgtagcacgaccggtgctcgatttagctcgatatagttgggtttgggggccagtctcagtcaggacacagcatggacatgacgggtccccgctcagctccgtggggctcctgctactcgtggactccgagatcgcagatgtcgaccaccagatcgaccagtcctccacttcccgtcctgtcgtcgactacgttcgtgggtacggggaacacgtaggacgttaccaacttccgtaacgttccgtttaccggttaccgggaccccggggtaactaacgggtaccgtaaggtttaggttttaacggtttttaaagttttaacgtttttttaaaaggtttttaaaacgggtttcggttaaaccttaacggttaaaccggttaaaacccggtaaaaaccccgggtaacgggggttaaaaacccccgtacccccgttaaacccggtttaccctaccggggtttaattaaccggttacctttaaggttcccgtacggtttaccgtaaccgtttacccggttttaaaccggtttaaagggttttaaaaacccggggaaaccggggttttccgggtaaaccccttaaagttacccgtaaaggtttaacgtacgggtaacgggtaccggtcgggtaaagggtcccgggttaaaggtttaccgggtaaaccggggtaaacctttaggtttaaaccgtttcccgtaaccctttacccgttaacccgtaacccgtttaacggtttaaccgttaacgggtttaaaccccgtttaaccgttaacccgttaaaaccgttaggtttaaaccgtttacgttttaaacccgtaactttaaaccgttacgtaacgttacgtaacgttaaaccggtacgttaaccgttaccccgaacccctttacccgttacccgttaccggttacccgtttaccggggttacgggtaaccgggggtaaccggttaaccggttaaaacgggggtcgaaaaccgttaaccgggaaacccggttaaaccggttaccgttccgggaccgtttacgaacccggttacccgtacccgttaggttttaccccgtttacccggg

SEQ ID NO: 285885 - DNA, 614 bp, Homo sapiens
  misc_feature: GYAE6OF01EFQ9J.4.57.F02.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (291)..(291): a, c, t, g, unknown or other
  misc_feature (291)..(291): n is a, c, g, or t
tcagagcactgtagcacgaccggtgctcgatttagctcgatataggttgggtttggggagccagtctcagtcaggacacagcatggacatgagggtccccgctcagctcctggggctcctgctactctggctccgagatgccagatgtgacacccagatgacccagtctccatcctcctgtctgcatctgtgganacagagtcaatcatctcttcgccgganaagtcagagtgttattatttattaatgtatcaattcaaacaggaaacgccctaagctctagtactctangctagctatacctagttacaaaggtcgggtaccagtactaagtacttcgaggtacgcgtaaggtgacgtcgtacggactagtactttacactctacgacctatccgaagttacgtactaacgtaacctagtaagttatttcgactaaactttacctacgtagtaccaacgttacgtaacgttaccgtaccgttaaccccgttaccgacttacccgtaccgtttaccggggaccggtaacgggtaacccgtaggggttaacggtaaggaactaccggtaaaacgtaccttgggtaaccgtacacgtactaacccgtgtttaccg

SEQ ID NO: 285886 - DNA, 764 bp, Homo sapiens
  misc_feature: GYAE6OF01AZ8S4.4.57.F02.1.454.CMB.1.raw
  modified_base (201)..(201): a, c, t, g, unknown or other
  misc_feature (201)..(201): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgacacccagatcgacccagtcctccactccctccctgtctgcatctgtggganacagagtcatcatctcgtgccggacagtcagagtgttagtatttatttaattggttatctagttacaaacgagggaaacacccctaagtcctcctgactactatgcgtagctactacctaagtttacgaaggtcgggtacctactacgaagtacttacgaggtcggacgtaggtacggtacgttacggtagggtacgtaacgttactttaccgtaccttcccgtaccacccgtaattaccgtaaacggtttaccgttacctaaaccgtaacccgttaaggtaaacggttttacgttttacgaacccttaaaccgtttaacgtttaacccttaacgttacctaaaacgtacgggttaaacgtttaaaccgtacccttaaccccccggtacccgttaccgtaccccgtttaaccggtttcccggggaccgggtaaaccgggaaacccggtaacgggggttaacggtaaccgggtaaaccttaaacccggtaaaaacccgggttaaccgttacgggggtaccggtacccggttaccgggtacccttaaaccgtcggtttaccccgg

SEQ ID NO: 285887 - DNA, 761 bp, Homo sapiens
  misc_feature: GYAE6OF01CNOHG.4.57.F02.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
tcagagcactgtagcacgaccggtgctcgatttagctcgatatagttggggtttgggggccagtctcagtcaggacacagcatggacatgagggtccccgctcagctccgtggggcctcctgctactctggctccgagatgccagatgtcgaccacccagatcgacccagtctccactccctcctgtctgcatcgtggtggganacgagagtcatcatctcgtcggcgganagtcagtagtagttaagttattttaagtttaagttggtatacgtaagttaaccgaaaccggtaacgggaaaccgtaccccgtaacgtccctaccgttacgtacttcgtaacgtcgtacgtacgtaccttaaccgttaccgttaaacgtttaaacggtaaaccggggttccgggtaccctacgtacgtaagttacgttacgaggtcgacgtaggtaggtacgtacggtacggacgttaagttacttacctaccgtcctaccaacgtcgtaacgtacggttaccgtacgtaaccgtaacgtagttaacgttacgtttacgtacttaacctttaccgtaacgttacgtaactaacggttaaccgttaacccgttaaccgtacccccgttaccccgtacccgttaccttcccggttacggtacccgggggtaccggtaacgggtaaacgggtaacgggttacggtaaacggttaacgtaaccggtaccgtaacgttcggtacgtccggtaaccaccgtactcgttcgttacccg

SEQ ID NO: 285888 - DNA, 601 bp, Homo sapiens
  misc_feature: GYAE6OF01BYTQA.4.57.F02.1.454.CMB.1.raw
  modified_base (219)..(219): a, c, t, g, unknown or other
  misc_feature (219)..(219): n is a, c, g, or t
  modified_base (595)..(595): a, c, t, g, unknown or other
  misc_feature (595)..(595): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatgacccagtctccatcctccctgtctgcatctgtggagacagagtcatcatctctgccggnagtcagagtgttagttatttatttaaatgtatctagttacaacgaggaacgccctaagctcctgatctatgctgctactacctaagttaacaacggttcgggtacccagtacgaagtattcgaggtggctaggtcggatcggtagggtacaaggttactttaccaccgttcctacctacctacgtactaagttacgtaccttaaaccgaacgttagtaaacggttatttacgacttaactttacctacttacgtactaaacgtagtaacgttaccaccttacccctaccgtacttcctaccggttcgggacggtacggaacccgtagggtacggtagtaacgtacgaaacgtaacgtcggtacgctagacctaccngttccg

SEQ ID NO: 285889 - DNA, 640 bp, Homo sapiens
  misc_feature: GYAE6OF01DAKXQ.4.57.F02.1.454.CMB.1.raw
  modified_base (185)..(185): a, c, t, g, unknown or other
  misc_feature (185)..(185): n is a, c, g, or t
  modified_base (193)..(193): a, c, t, g, unknown or other
  misc_feature (193)..(193): n is a, c, g, or t
  modified_base (297)..(297): a, c, t, g, unknown or other
  misc_feature (297)..(297): n is a, c, g, or t
  modified_base (632)..(632): a, c, t, g, unknown or other
  misc_feature (632)..(632): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacaccagatgacccagtctcatcctcctgtctgcatcnggtggganacagagtcatctactctcgtcggccgggataagtcgagtagttagtttagttaattttaattaaagttgtatacgtaacgttacaaaaccgtaagggtaaaccncccctaagtcctacctagacttactacgtcgtctacgctaacttccgtaaagtttaacgaacgggttccgggtaccctaagtacgtaaacgttacgttacgaggtcggtacgtaggtaggtactcggtagggactagttacttccgacttactacctactatacgtagtacttaccgtaactaacgtagtattacttactactactttactactgtaactaacgtagttaacgttacctacctcccgtcgtaccttaccgttacggttacggacggtaacggacggtaggtacgacgtaacgtaacgaaacgtacgtgtcgtacgacacgtaacngttcgtac

SEQ ID NO: 285890 - DNA, 897 bp, Homo sapiens
  misc_feature: GYAE6OF01BKWDE.4.57.F02.1.454.CMB.1.raw
tcagagcactgtagcacgaccggtgctcgatttagctcgatatagttgggtttggggagccagtctcagtcaggacacagcatggacatgagggtcccccgctcagctcctggggcctcctgctactctggctccgagatgccagatgtcgaccacccagatcgaccctagtcctccatccctccctgtcctcgctatcgtggtaggagacagagtcatctacttcgttccgttccgggccggtacgtaacgtacgtaagtaggtttagtttaacgttttaatttttaaacgttttaaaggtttaggttactacgtaacgttaaccgaaaacccggtaacggaaacccgtaccccgttaaccgtccgtacctacgttacgtacttagtacgtccgtcgaccttaccgtaaccgtttaacggtttaaaccggtaacgggttaccgggttaaccctaaacgttaacgtaaacgttacgttacgtaggttacgggtaacgtcggttaggtacgttaccggtaacggtaacgttacgtttacccggtttaccttaccgtccttaacccgaccttaacgtagttaaccgtttaacccgtaccgttaaaaccgtaaccgttaagtttaacccggtttaatttaccgtaaacctttacccgttaaaccttacggttaaacgtaacccgtaaacgttaccggtttaaaccggtaacccccgtttaacccgttaccccccgttacgtttacccccgttaacccgggtttaaccggttcccgggggtaaccggggttaaaccgggacggtttaaaccggggacgttaaaccggtacccggtaaaacccggtaaacggttcgtaccggttacctacgtacccggaaccctaacggttcccgtttaacg

SEQ ID NO: 285891 - DNA, 804 bp, Homo sapiens
  misc_feature: GYAE6OF01B156U.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccactccctccctgtctgctatcgtggtgggagacagacgtcatcatcttcgtcggccgggacaagtcgaggtagttagttaagtttaattttaatttaaagttggttaactacgtaacgttaaccgaaaacccggtaaggggaaaacccgtaccccctaaaggtcccttacccggttagtaacttaccgttaagtcggtccgttacgaccttaacgttacccgttaaaaggttttaaccgtaaaaacggggttccgggtaacccctaagtaaccgtaaagttacgttaccgtaagggttcggaacgtagggtaggtaacgtggttacggggaactagttacttttaccgaccttacctaccctacgtaacgtacgtaacgttaaccgtaaccgttaactaaaccgtttaggtaaacgtttaacgttttaccgaacccgtttaaactttaaccgttacgttacgtaacctaaacggtaacgtttaacgtaacccgtaacccttaccccgtacccggtacttaccgttacccgggtttccgggaccggtaaccgggtaaccggtaacgggtaggaacgtaacgtaacccgaaacggttactcgggtaccgacgtaccgaccgtaccgtgttccg

SEQ ID NO: 285892 - DNA, 736 bp, Homo sapiens
  misc_feature: GYAE6OF01DH2CK.4.57.F02.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (313)..(313): a, c, t, g, unknown or other
  misc_feature (313)..(313): n is a, c, g, or t
tcagagcactgtagcacgaccggtgctcgatttagctcgatatagttgggtttggggagccagtctcagtcaggacacagcatggacatgagggtcccccgctcagctcctggggctcctgctactctggctccgagatgccagatgtgacacccagatcgacccagtcctccacttccctccctgtcctgcatccgnggtgggganacagtntcatcatctctcggccggacaagtcagtagttgttattaatttaatttaagttggttactctagttaaccaaacgaacgggaacctccctaagcctaccngtactactagtctctcgactactacgtacgtttaacggaacggttcgggtaccaagtacaaagtaacgttcgtaaggtggacgtagtgggtacgtacgtaggaacgtagtacttacaacttctacctaacctatcgtaacgttacgtacgtaaacctaaccgtagtaacgttatttacgacttaacgtttaccttacgtacgtaacaacgtaacggttaacgttacccggtaaccttaccccccgtcccgttaacgttacccgtttaaccgggttttcccgggaacggggttaaacccgggtaaccgggtaaacgggttaacgggtaaaccgttaaaccggtttaaacccgaaaaacccgggttaaccggttacggtacccgggttaacggacgtaaaccccgtaacgtcccgggtttaaccc

SEQ ID NO: 285893 - DNA, 762 bp, Homo sapiens
  misc_feature: GYAE6OF01AXCBN.4.57.F02.1.454.CMB.1.raw
  modified_base (201)..(201): a, c, t, g, unknown or other
  misc_feature (201)..(201): n is a, c, g, or t
  modified_base (753)..(753): a, c, t, g, unknown or other
  misc_feature (753)..(753): n is a, c, g, or t
tcagagcactgtagcacgaccggtgctcgatttagctcgatatagttgggtttggggccagtctcagtcaggacacagcatggacatgacgggtccccgctcagctccgtggggctcctgctactctggctccgagatgccagatgtgaccacccagatcgacccagtcctccactcctccctgtctgcatcgtggtgganacgagagtcatctatctcgttcggccgggacaagtcaggtaggttagtttaagttaatttttaagtttaaagtttggtacttcgtaacgttaaccgaaaaccgacgggaaacctccccgtaagccgtacctaggtacttctagtcgtaccgtcgtacctacgttaccgttaaacgttttaaacgaacgggttaccgggtacccctaagttaccgtaaagtacgtttacgaacggtggtaacgtagggttacggtacgtacggtacggggtaactaacgtttacgtttaccgtaaccctaccgttacctaacccgttaacgtaccgttaaaggttaccgttaacctaacccggtaaaccttaaggtaacgtttaactttacgtaaccttaacctttaacgtactacgtaacgtaacgttaacgtaacgttaccgtaacccgttacccgttccgttacttaccgtaccggttaccgggacgggaaccggtaacgtagggtacgtaacgtactaaccggtaacgtacgtagtccgtacgttacaccgttaccgtnttccgtacg

SEQ ID NO: 285894 - DNA, 659 bp, Homo sapiens
  misc_feature: GYAE6OF01BL44Q.4.57.F02.1.454.CMB.1.raw
  modified_base (545)..(545): a, c, t, g, unknown or other
  misc_feature (545)..(545): n is a, c, g, or t
tcagagcactgtagcacgaccggtgctcgatttagctcgatatagttgggtttgggggccagtctcagtcaggacacagcatggacatggacgggtccccgctcagctccgtggggctcctgctactcgtggctccgagatgccagatgtcgacaccagatcgacccagtcctccactcctccctgtctgcatcgtggtggagacagactcatcacgtctcgtcggccggactagtcgagtagttagtttaagttaattttaatttaagtagttatactaacgtaacaaacggtaacggtaaccgtaccgtaacgtcctacgtacgtactactacgtcgtctacgtacctagttaccgttaacgttaacggtaaggtcgggtacctatacgtatacgtagacgtcgagtaggtgagtcggtacgactacgtactccgacctactccgactacgtactacgttactaactaacctaacgtagtaactagttacacttaaccttactcgtacgtaaccaagtacaccgttacacccgttacccgtcnccgttacgtacggttacccgggagggtaaccggtaacggtaagggtacggtaacgagtaaacggtaacgttacggtagttaccgcgttacacccttaacgttctccgttaaccg

SEQ ID NO: 285895 - DNA, 683 bp, Homo sapiens
  misc_feature: GYAE6OF01C6M4G.4.57.F02.1.454.CMB.1.raw
  modified_base (173)..(173): a, c, t, g, unknown or other
  misc_feature (173)..(173): n is a, c, g, or t
  modified_base (217)..(217): a, c, t, g, unknown or other
  misc_feature (217)..(217): n is a, c, g, or t
  modified_base (501)..(501): a, c, t, g, unknown or other
  misc_feature (501)..(501): n is a, c, g, or t
  modified_base (671)..(671): a, c, t, g, unknown or other
  misc_feature (671)..(671): n is a, c, g, or t
tcagagcactgtagcacgaccggtgctcgatttagctcgatatagttggggtttggggagccagtctcagtcaggacacagcatggacatgagggtcccccgctcagctccgtgggggctcctgctactcgtggcctccgagatgccagatgtcgaccacccagatcgacccngtcctccactccctccctgtctgctatcgtggtgggagacgagngtacatcctatcttcgttcgggccggatagtcgaggtaacgttggttaagtttaatttaagttttaaagttggttaactacgtaacgttaaccgaaaaacggtacggggtaaaccctaccccgtaagccttaccgtagtactactagtcgtctcgactacgttacctaacggttaacgaacgggttccgggtaacctagtaccaaagtacgttcgaggtcgacgtacggttaggacttacggacggtaactacgttactttaccaccttcctaccgtaactacncgtaagttacctactaaactacgtagtaatttacgttacaaccttattactactactaacgaacgtacgtacgttaaccgtacctacccgtctaccgttacgttaccgggttacgggacgggtacgaggtaggtacgataaccgtaagtacggtacgtcggtacacctanacctgtcgttcg

SEQ ID NO: 285896 - DNA, 696 bp, Homo sapiens
  misc_feature: GYAE6OF01CRNTF.4.57.F02.1.454.CMB.1.raw
  modified_base (397)..(397): a, c, t, g, unknown or other
  misc_feature (397)..(397): n is a, c, g, or t
  modified_base (607)..(607): a, c, t, g, unknown or other
  misc_feature (607)..(607): n is a, c, g, or t
tcagagcactgtagcacgaccggtgctcgatttagctcgatataggttggggtttggggagccagtctcagtcaggacacagcatggacatggacgggtcccccgctcagcctccgtggggcctcctgctactcgtggcctccgagatcgccagatgtacgaaccacccagactcgaacccacgtcctacctacttccctcccgtgtacctgcctatcgtgggaggagacgtagtactctatactcgttccgtcgtcggacccgggataaggtacaaggttagtttaggttaaacttttaattttaagtttaaacgttcggtaactacgtaacgttaaaccgaaaccggtaacgggaaaacctccccgttaagcgttacctaatacttaaccgttgngtacctgtaacctaacgttaccgttaaaggttaaaccgagggttaccggacctaaagaacgtaacgtcgtaccgaggtcaggtacgtcgatacgggtacgaattacgttactacctcctacctacaacctatacgtaatacgtaactaaccgtaataacgtattagtactactactactactacgactaagactcgtaacctcctacccngtccgtactccggtacggacggaacggtaacggtacggtagtaacgacgtaacgtacgtacggacgtcacgtaccacgtacgtcttacg

SEQ ID NO: 285897 - DNA, 1124 bp, Homo sapiens
  misc_feature: GYAE6OF01ERX15.4.57.F02.1.454.CMB.1.raw
  modified_base (207)..(207): a, c, t, g, unknown or other
  misc_feature (207)..(207): n is a, c, g, or t
tcagagcactgtagcacgaccggtgctcgatttagctcgatatagttgggtttggggagccagtctcagtcaggacacagcatggacatgagggtcccccgctcagctccgtggggctcctgctactctggcctccgagatgccagatgtgacacccagatcgacccagtcctccactccctccgtgtctgctatcgtggtgggaanacgagtagtcactctacttccgttcgttcgggacccgggactaaacggtccgaaggtacggtttaggttttaaagtttaagttttttaaaagttttaaaaggtttacgggtttaacgttaaccgttaaacggttttaaaacccggaaaaaaccccggtaaagggggtaaaaaccccggttaccccccgtttaaaacggtccccgtttaacccgttaacggttaaccttaccggttaacgttccggtaccgttacggtaacctaccgtttaaacccgttaaacggttttaaaaccggtaaaaccggggttccccggggtttaaccccttaaaaggtaaacccgtaaaacggggttaaccgtttacccggttaaacggggttcgggttaacccgggtaagggttacggggttaaccggttaccggggttaaacggggtaaccgttaaaccgggttttacctttaaccccgggaaacccttttaccgtaaacccccgtaaccttacgggttaacccgttaaaacgggtttaacccgtttaaacccccgttaaaacccggttaaacccgttaagggttttaaaaccgggtttttaccttttaacccgggtaaaccctttaaaacccgtttttcgtttaaacccggtaacgttaaaccgaaaccggtttaaacggttaaccccgggtttaaacccttacccccggtttaacccccgttccggtttaaccccgttaacccgtttaaccggggggttacccgggtaaacccggggtaaaaccggggtaaaccgggttaaacggggtaccggttaaacccggttaaacccggttaaaacccgggaaaaccggggtttcttacccggggggttaaccgtaaccccgtttacccgaaacccgggttccctaaaaccgggttttccgg

SEQ ID NO: 285898 - DNA, 741 bp, Homo sapiens
  misc_feature: GYAE6OF01B76UJ.4.57.F02.1.454.CMB.1.raw
  modified_base (102)..(102): a, c, t, g, unknown or other
  misc_feature (102)..(102): n is a, c, g, or t
  modified_base (207)..(207): a, c, t, g, unknown or other
  misc_feature (207)..(207): n is a, c, g, or t
  modified_base (212)..(212): a, c, t, g, unknown or other
  misc_feature (212)..(212): n is a, c, g, or t
tcagagcactgtagcacgaccggtgctcgatttagctcgatatagttggggtttggggagccagtctcagtcaggacacagcatggacatgagggtccccgntcagcctccgtggggctcctgctactctggctccgagatgaccagatgtagaccacccagtactcgacccagtcctccatccctccctgtcctgacagtcgtggnggganacgagtacgtacagtctactctcgttacggccgggacaaggtcgagtagttagttaagttaattttaagtttaaagttgttatacgttaacgtaccgaaaaccggaacggtaaaccgtacccgtaacgtccttaccgtacgtactctaagtcgtcgtactacgtaacttaccgttaagttaaacggtaacggttaccgggtaccctaagttaacgaaacgtacttacgtaaggtcggagtacggtggtacgtcggaaggtactacgttacgtttaccaccttaccgtacctaacgatacgtaacgtacgttaaccgtaaactaacgtaacggttaacgttatttacgaaccttaaccgttcgtaacgttaacctaacgacgtaacgttacgttaacccgttaacccgtcccgttacctacttacccgtcggttaccggacgggtaaaccggtacgtaaacgggttcgaacgtaaccggtaacgtaaaccggtagtcgggtaacgacgtaccgaccgtagtacgttaccg

SEQ ID NO: 285899 - DNA, 1040 bp, Homo sapiens
  misc_feature: GYAE6OF01DPFF4.4.57.F02.1.454.CMB.1.raw
  modified_base (1024)..(1024): a, c, t, g, unknown or other
  misc_feature (1024)..(1024): n is a, c, g, or t
tcagagcactgtagcacgaccggtgctcgatttagctcgatatagttggggtttgggggccagtctcagtcagggcacagcatggacatgacgggtccccgctcagcctccgtggggcctcctgctactctggctccgagatgccagatgtgaccacccagatcgacccagtctccactccctccctgtctgctagtcgtggtacgggaagaacgaggtacgtacacttactattccgttccgttaccgggacccggggtaataaacggtgtaaggtaggttttagtttaaggtttaaattttttaaagttttaaaagtttggttaaacttacgtaaacggtttaaaccgaaaaaccggtaacgggggaaaaaccccgttaaccccccggtaaaaggtccctttacccgtaggtaaccttttaccgtaacggttcgtaccgttacggtccttaacttaacccggttaaacggttttaaacggaaaccggggtttaccccggggtacccttaaacgtaaccggtaaatttacggtttaaaccgagggtacgggtaacgtaacgggtttcggtaacgttacgggggtaacggggtaactttaagggtttaaacctttacccgttacttaaccccgttaaccgtaaacccgtttaaccgtacggtttaaaacgggtttacccgtttaaccgttaaaaccccgtttaaaccggttaacggtttaaacgttttaacgtttttaaaccccgtaaaccctttaaaccgtttttaaacccctttaacggttaaacccgtttaaacccaaacggtttaaaccgtttaacccgggtttaaaacccctaaccccgtttacccccggttacccgtttcccgttaacccgtttacccggggtttacccgggggaacccgggttaacccggggaaagggtttaaccggggaacggtaaaccggttaaaccgttaaacccggtaaaacgttccgggggttaacggtaaccggttccggtaaccgaccccgttttaaacngttttcgttaaccccg

SEQ ID NO: 285900 - DNA, 911 bp, Homo sapiens
  misc_feature: GYAE6OF01BK6WN.4.57.F02.1.454.CMB.1.raw
  modified_base (101)..(101): a, c, t, g, unknown or other
  misc_feature (101)..(101): n is a, c, g, or t
tcagagcactgtagcacgaccggtgctcgatttagctcgatatagttgggtttggggagccagtctcagtcaggacacagcatggacatgagggtccccgntcagctcctggggctcctgctactctggcctccgagatgccagatgtacgaccacccagactcgacccagtcctccacttccctccgtgtctcgctagttcgtaggtgggaacgacgaggtacgtactacttccacgttcccgttcggtaccgggaccggtaacgtaacgtacggaaggttaggtttaagttttaagtttttaaatttttaaagtttaaggtttacgttaacttaacgttaaccggttaaaccgaaaaccgggtaaaccgggtaacccctaacccgttaacgtcccttacgtaagttactacgtacgtacgtcgtaccgtacttaaccgttaaccgtttaaacggttaaaccggtaacggggttacccgtaacctaacgtaacgtaaacgttcggttacggagggtacgtacggtaacggtacggtacggttacgggtaacggtaacttagttaccttcctaaccgtccttaaccaacgttagtaacggttaccttaacgtaccctaaacggttaacgttaagttcgtttaactacccgtaaactttacttaccgtttacgacgtaaacctaagttaaccgttaccccggttaaacctaccccccgttacccgttacgtaaccccgtttacggggttaaccccggggtaaggggtaacccggggtaaacggttaaacccgggtaagggtaaccggtaaacccggttaaaccgttaaaacccggggtaaccggttagggttcccgggtaacggaaaccccggtttaaccgaacccttttacgggttccgttttaaccccgg

SEQ ID NO: 285901 - DNA, 657 bp, Homo sapiens
  misc_feature: GYAE6OF01EKSED.4.57.F02.1.454.CMB.1.raw
  modified_base (139)..(139): a, c, t, g, unknown or other
  misc_feature (139)..(139): n is a, c, g, or t
tcagagcactgtagcacgaccggtgctcgatttagctcgatataggttgggtttggggagtcagtcccagtcaggacacagcatggacatgaggtccccgctcagctcctggggctcctgctgctctggctcccaggtnccagatgtagccatccagttcgacccagtctccatccgtcctgtcagcatctagtagagacagatcacgatcacgttcgccgggaccagtcgaggctatttactagttacttacgccgtggtatcgaagaacaaaacgacgggaacgaccctaacgctaccgtagatcgttaagtcggtagtactactaccttactttacgacgtaaacggtcgggtacccagtacctaaggtcaggcgacgtagtggactcgtacgggactaagacttacgactacacctacgatacgacgtacgaagtccaaacgctaaccgtagtaaacgttatttacggaacttaaacctttatttaaccgacgttaactaaaccgtacttaaaccgtttaaacgttaacgttaccgactacgttacccgttacgggttacgaaccggggttaccggaacggttaaacgggtggaaacgaacttaaacggaaacgacggtttacggcggtactacggacctacgtacttaccgg

SEQ ID NO: 285902 - DNA, 681 bp, Homo sapiens
  misc_feature: GYAE6OF01DAA20.4.57.F02.1.454.CMB.1.raw
  modified_base (267)..(267): a, c, t, g, unknown or other
  misc_feature (267)..(267): n is a, c, g, or t
  modified_base (665)..(665): a, c, t, g, unknown or other
  misc_feature (665)..(665): n is a, c, g, or t
tcagagcactgtagcacgaccggtgctcgatttagctcgatatagttgggtttggggagccagtctcagtcaggacacagcatggacatgacgggtcccccgctcagcctccgtgggggcctcctgctactctggcctccgagatcgccagatgtacgaccacccgagatacgacccagtcctccactccctcctgtctcgctagtcgtggtagggaacacgagtacgtcatctactcgtcgtcggaccggacagtcgagtaggttnttaattatttaatttaagtggtatacgtacgttaaccgaaacgaacggaacctacccgtaacgccttacctagtactccgtagtcgcgtacgaccttaacgtacgttaacggttaaacggtaacgggttaccgggtaccctaataaccgtaacgttacgttacgtaggtacgacgtggtacggcgttacggaaggtacttaggttaccttaccgtcctacctcgtaacctagttaccgagtttaaccaacgttaaacctaacgtacggttaattacttacgtaaccttacgttactacgtacgtaacacgttaacggtacctaaccgttcccaccctcgtactccggttacgtccgggacggtacgcgaggtagatacgaacgtacgtagtcggtacncacgacctgtcttacg

SEQ ID NO: 285903 - DNA, 751 bp, Homo sapiens
  misc_feature: GYAE6OF01CPKVT.4.57.F02.1.454.CMB.1.raw
  modified_base (169)..(169): a, c, t, g, unknown or other
  misc_feature (169)..(169): n is a, c, g, or t
  modified_base (227)..(227): a, c, t, g, unknown or other
  misc_feature (227)..(227): n is a, c, g, or t
  modified_base (316)..(316): a, c, t, g, unknown or other
  misc_feature (316)..(316): n is a, c, g, or t
tcagagcactgtagcacgaccggtgctcgatttagctcgatatagttggggtttgggggccagtctcagtcaggacacagcatggacatgagggtccccgctcagctcctgggggctcctgctactctggctccgagatgccagatgtgacacccagatgacccagtcnccatccctccctgtctgcatctggtgggagacagatcatcatctcgttcggccggganaagtcagtagttagttagttaatttagttaaattggtatctagttacaaacgaacggaacaccctaagtcctcctagactctatgcgtnctacttaccgtaagtttaaccgaaacggtcgggtaccctaagttacaaagtacttacgtaggtggacgtaggtaggagttcggtagggtaactacgttaactttccaccttctaccctaaccttacgtaacgtacgttaaccgtacctaacgttaaaccgtgttaaacggtttattttacgaaaccttaaacctttacgttaacttacgtaaaccgtaacgtaacgttaaccggttaacccgtaaccccgtttaccccccgtaccggtttacccgttacccgtttaacccggtttacgggggaacccggggttaaaccgggaaccgggtaaacggggttacgggtaaaacggtaccgttaaaacgtaaaaccgggtaacgttagggttaacggtcttaaaccggaccctaaccgtttcgttaccgttttaacccg

SEQ ID NO: 285904 - DNA, 715 bp, Homo sapiens
  misc_feature: GYAE6OF01B4V1Y.4.57.F02.1.454.CMB.1.raw
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (372)..(372): a, c, t, g, unknown or other
  misc_feature (372)..(372): n is a, c, g, or t
tcagagcactgtagcacgaccggtgctcgatttagctcgatatagttggggtttgggggccagtctcagtcaggacacagcatggacatgaggtccccgctcagctcctggggctcctgctactctggctccgagatgccagtatgtgaccacccagatcgaccctagtcctccatccctcctgtctgctatcgtggtgganacgagtactntactctatcctcgtcggccgggactaacggtcgaaggtagttagtttaagttaattttaacgtttaaagttggtaacttacgtaacgttaaccgaaaaccggaacggggtaaacctacccccgtaagtccttacctagtacttaccgtagtcgtacgtanacctacttaccgttaaggtttaaccgtaaggtccgggtacctaagtacctaagtactcgtaggtacgtacgtaggtagcgtacgaggtacgtacgttaccgttactacctactaccgaccttactacgtaagttacctaaccgtaactaacgtagttaagttattaccgtacttaacttacgtaactacgtaactaacgtacgtaacgttacccgtacccgttacccaccggttactaccggttacgtacgggtcgggtaacccgtaacggtacggtaggtaacctaacgaaccggtaaacgttcggtacgtccggaccctacgactaccgtgtccgttaccg

SEQ ID NO: 285905 - DNA, 629 bp, Homo sapiens
  misc_feature: GYAE6OF01DQZL3.4.57.F02.1.454.CMB.1.raw
  modified_base (197)..(197): a, c, t, g, unknown or other
  misc_feature (197)..(197): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtggganacagagtcatcattctcgttcgccgggcaagtcagtagttagttagttaattttaatttaaattggtatctagttacaaaccgaggaactccccgtaagtcctaccgtagacttacgtatcggctgctactaccgtaagtttaacgaacggttcgggtacctagtacaagtattacgaggtcgtacgaggtggtagtcgtaagggtaccgagttactttacaccgttacctaccgaactacgttactacggttaacttacctaaacaaccgtagttaacgttatttacaaccgttaactttacgttacttactaactaagtacggtaacttacccgaccttacccctcgtccttacgtacgttacgggacggtacgacggtaggtagtaacgagtaacgaacgtagtgtacgtctacgactctagttcttcg

SEQ ID NO: 285906 - DNA, 609 bp, Homo sapiens
  misc_feature: GYAE6OF01A4P1Y.4.57.F02.1.454.CMB.1.raw
  modified_base (195)..(195): a, c, t, g, unknown or other
  misc_feature (195)..(195): n is a, c, g, or t
  modified_base (275)..(275): a, c, t, g, unknown or other
  misc_feature (275)..(275): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgccatctgtggganacagagtcatcatctcttgccgggcaagtcagtagtgttagtatttatttaaattggtatctagttcaaacgagggaaancccctaagctacctgattctatgtctgcatccaagtttaacaaacggtcgggtacccataccaagtattaccgagtcggcgagttggagttcgtcgggaactacgtatttccaacttactcaccgtattacagtttactacctaactaaacctggtaacgtagttttcgaacttacttaacgtacttagttaccaacgttacgtacgttaacgaccgttaccctcccggtactaccgtacgttaccggcgggaacgggtacctaacgggtaggaacggtactaacggtaaaccgtaacgtcggtacgtacgtcgtaccaccgttatccgttacg

SEQ ID NO: 285907 - DNA, 1097 bp, Homo sapiens
  misc_feature: GYAE6OF01CCGHV.4.57.F02.1.454.CMB.1.raw
tcagagcactgtagcacgaccggtgctcgatttagctcgatatagttgggtttgggggccagtctcagtcaggacacagcatggacatgacgggtccccgctcagctcctggggcctcctgctactctggctccgagatgccagatgtagaccacccagtactcgacccagtcctccactcccttcctgtctgcatcgtggtgggagacgaggtagtactactctacttccgttcgttcgggccgggtactaacggtcgtaaggtagtttaggttttaagtttaattttttaaacgttttaaagtttcggttaattaccgtaacgtttaacccgtaaaaccgggaaacgggtaaaaccccgtacccccgttaagtccccgtttaccgtacgttaacgttaccgttacgtcgtaccggttcgtaccttaaccttttacccggttaaacggttttaaaaccggaaacgggggttttacccgggtacccgtaaacgttaaacgtaaacgttaacgtttacgggaacgggttggggtaacccgttaagggtaacgggtacgttaccggggtaacggggtaaacttaaggtttaccgtttaccccttaacctacccgttaaccctaaaccccgtaacgttcccgggtttaaaacggtttaaacccggttaccccttaaaacccggttaaacccggttaggttttaaacgggttttaaaccgtttttaccccgggaaaaccccttttttaaaacccgttttacccggttttaaaacccttccccgggtttaaaaacgttaaacccgttaacgggggtttaaaacccggtttaaccccccgggtttaaaaccccccttttaccccccccgggtttaaccgttaccccccgtttaaacccggtttttaaccccccggggggttcggggtaaaaccccgggggttaacccgggtaaaaacccggggtaaccgggggggtttaaaccggtaaacgttaaaaccccgggttaaaacccggtaaaaaccggggttaaacgggtttccggttaaccggggtaacccgttacgtacccccggtaaacttttacgttccccggtttaaacgg

SEQ ID NO: 285908 - DNA, 723 bp, Homo sapiens
  misc_feature: GYAE6OF01A1JKU.4.57.F02.1.454.CMB.1.raw
  modified_base (206)..(206): a, c, t, g, unknown or other
  misc_feature (206)..(206): n is a, c, g, or t
tcagagcactgtagcacgaccggtgctcgatttagctcgatatagttgggtttgggggccagtctcagtcaggacacagcatggacatgacgggtcccgctcagctcctggggctcctgctactctggctccgagatgccagatgtacgaccacccagatcgaccctagtcctcactccctccctagtctgctatcgtggtggganacagactcatcatctcttcggccggataagtcagtagttgttaagttattttaatttaaagttggtactactacggttaacaaaaccggagggtaacctacccctaagtcccgtaccgtagtaacttctactcgtcgttcgactacgtacctaacggtttaacgaacgggtcggtaccctaagtactaaggtacttcgtacgtggtacgaggtacggtactacggtaggaactacgtactttaccgaccgttaacgtccaaccttcgtaaaccgtacgttaaacgtaccgttaacctaaacgttacgttaacgttagtttaccgtactaaccttacgttacgtacttaacgtaacgtaagtaccggttaccaaccctttaccccgcgttacgtcccgttaacggttacggacccgggtacgtaaacccggtagggtaaacgtccgtaaagttaacggaaaccccggtaggttaccgtacgggtactcccgggtaaacctccgtacgtttacgttccg

SEQ ID NO: 285909 - DNA, 817 bp, Homo sapiens
  misc_feature: GYAE6OF01BJNEX.4.57.F02.1.454.CMB.1.raw
  modified_base (212)..(212): a, c, t, g, unknown or other
  misc_feature (212)..(212): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccggagatgccgagatgtgacacccgagatcgacccagtctccactcctccctgtctgcatcgtggtggagacgagacgtnatacattctcgttcggccggacaagtcgaggtaggttagtttaagtttaatttttaagtttaaagttcggttaataccgtaagtttaacccgaaaaccggtaacgggtaaaccgtacccccgtaaagtacccgttaccgtggtaacttaccgttattccggtccgttacgtacctaaccgtttaacccgttaaacggttttaaaccggtaacggggtttaccccggggttaacctaacgttaacgtaaacggttacgtttaaccgaggtcggtaaccgtagggttaacggtacgttaccggttaaggggaaccttaaggttaaccgtttaccctaacttcccgttaacccaacttacgtaacgttaacgggttaactttaaccgtaaacgttaaaccgtaaggttaacgtttacgtttaacgtaacccttaaccttttacgtaaccgttagtaaactaacgttaacgtaaccggttactacccgttacccttcccgtacttacccgtaccggttacgggaccggttaggacccgggtagtacgggtaaccacggttaaccaaacggttagtcgggtacgtaccgactaccgtcgtacttacccgg

SEQ ID NO: 285910 - DNA, 712 bp, Homo sapiens
  misc_feature: GYAE6OF01BSHZO.4.57.F02.1.454.CMB.1.raw
  modified_base (147)..(147): a, c, t, g, unknown or other
  misc_feature (147)..(147): n is a, c, g, or t
  modified_base (693)..(693): a, c, t, g, unknown or other
  misc_feature (693)..(693): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtnacacccagatcgacccagtcctccactccctccctgtctgcctagtcgtggtaggatacagatcaatcattctctggccggacaagtcaggtagttagttagttaattttaatttaacgttaggttactactaacgttaccaaaaccgtaagggtaacctaccccgtaacgtcttacctgtacttactagtcgtctcgtactactaccgttaagtttaacgtaacggtcgggtaccctaagtacgaaacgtattcgagtcggtacgtaggtaggtacgttcgtacggaactacgttagttacctaccttacctacacctacgtacgtaaggttacgttaacctacgtaaccgttagtaagtttactttacgtaaccttaacctttacttacgtacgtaacctacgaagttaaccgttacgtaaccctacccccgttccgttcccgttaccgttaccggttacgggaccggtaaccgggtaccgaagggttacggtacgtaacgtaaccggtaaacggaccgttaggtacgtaccgtacggtacccnccgttaacgttcgttaccg

SEQ ID NO: 285911 - DNA, 796 bp, Homo sapiens
  misc_feature: GYAE6OF01CERF0.4.57.F02.1.454.CMB.1.raw
  modified_base (194)..(194): a, c, t, g, unknown or other
  misc_feature (194)..(194): n is a, c, g, or t
  modified_base (223)..(223): a, c, t, g, unknown or other
  misc_feature (223)..(223): n is a, c, g, or t
  modified_base (533)..(533): a, c, t, g, unknown or other
  misc_feature (533)..(533): n is a, c, g, or t
  modified_base (777)..(777): a, c, t, g, unknown or other
  misc_feature (777)..(777): n is a, c, g, or t
tcagagcactgtagcacgaccggtgctcgatttagctcgatataggttggggtttggggccagtctcagtcaggacacagcagtggacagtggaccgggtccccgctcacgccgtccggtggggccttccgtgcttcctcgtcggcgtccgagactcgacgagagttcgacgaccaccgagtactaccgacccntcctcctaccttccctccttgctagtctntcggttaggaggaacgtacgagtactacgtactactcgttccgtcgtacgggaccggtacgtaacgtagtaaggtttacgtttagttttaagttttaacttttaagtttaacggttcggttaacttacttaaacggttaaaccgaaaacgggaccggtaacctccggaacgtccgttatacgtattcgacctagtccgtacaaccgttacgttaaccgttaacgttaaacggtaccgggtaccgtaccgttaagaacgtttaacgtcgtaaggtacggcgtaaggtcggttacgtacggttcggacggtntaccgttactacccgtactaacgtaccgtactacgtactaacgaaccctttacgaacgttaacgtagtttacgttacgtttaaccgtaactttaaccgttactacgttacgaaagtaaccggtacggttaacctacccgttaaccctaccttacccgtactttcccggtaacggtaccggggaagtaacccgggttaaggtaccgtaacggtactaacgacgttaacgacggttcgtacgtacncgtactcttcgtcgttccg

SEQ ID NO: 285912 - DNA, 693 bp, Homo sapiens
  misc_feature: GYAE6OF01BVNU3.4.57.F02.1.454.CMB.1.raw
  modified_base (147)..(147): a, c, t, g, unknown or other
  misc_feature (147)..(147): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (524)..(524): a, c, t, g, unknown or other
  misc_feature (524)..(524): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
tcagagcactgtagcacgaccggtgctcgatttagctcgatatagttgggtttggggagccagtctcagtcaggacacagcagtggacatgacgggtccccgctcagctccgtggggctcctgctactctggctccgagatgcaagntgtgacacccagatcgacccagtcctccactcctccctgtctgctatcgtggtagganacgagngtcatcatctcgttcggccggataagtcgagtagttgttaagttaattttaaattaagttgtaacttcgtaagttaaccgaaaccgaagggaacctcccgtaaagtccgtaccgtgtactacttagtcgtcgtaacgtacctacttaccgttaaacgtttaacgaaacgggttccggtaaccctagtaccgtaagtcgttacgaggtcggactaggtcgtagtcggtaggtaactagttactttaccgacttcccgtaacaaccgttatacgtaacgttaccgttaactaaacctaccgttaagtaacctttntttaacccggaacttaacccttttagcgtttaacgtaacgtaagtaccgttaaccggttacctacccgttccccctacgtcttaaccggttcgggtacgggaacggtacgaaacgttgggaagatacgtaaccgaacgttcgnggtcgtacngaccctagtcgttacgg

SEQ ID NO: 285913 - DNA, 714 bp, Homo sapiens
  misc_feature: GYAE6OF01AD1CD.4.57.F02.1.454.CMB.1.raw
  modified_base (272)..(272): a, c, t, g, unknown or other
  misc_feature (272)..(272): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
tcagagcactgtagcacgaccggtgctcgatttagctcgatataggttgggtttggggagccagtctcagtcaggacacagcatggacatgagggtccccgctcagctcctggggctcctgctactcgtggcgtccggagagtcgccagtacgtggtacgaaccacccgagtacgtccgacccgtagtcctcccacgtcccttcccgtgttcctagctagtcgtgggtacgggacgacgaggtacgtacactctatccgtcgtcggccgganacgtacaggtacgttagttattaatttattagtgtactctagtacaacgaggaactccgtanctacngtactcgtagtnacgtgactactacgttaagttacgaacgggtccgtactaactacgtaaacgttcggtaacgacggtggtacgagggttacggtactccgggtaaggacttacgttattacccgtactcctaacctacgtaattaccgtaacgtaccgtaacgtactacggtaacgttagtttacgttactaccgtaacttaaccgtatacgaactaagtacggtaacccttacgaccccgttaccttcccgtaccttaacggttcccggtacgggtaccggtaaccgggttacgtacggggtacgtacgtaacgttacccggaaacggttcggaaccgtcggttaacgaccgtaacccggttcaccgtttccg

SEQ ID NO: 285914 - DNA, 799 bp, Homo sapiens
  misc_feature: GYAE6OF01BJEQA.4.57.F02.1.454.CMB.1.raw
  modified_base (518)..(518): a, c, t, g, unknown or other
  misc_feature (518)..(518): n is a, c, g, or t
tcagagcactgtagcacgaccggtgctcgatttagctcgatatagttgggtttgggggccagtctcagtcaggacacagcatggacatgacgggtcccgctcagctccgtggggctcctgctacctctggctccgagatcgccagatcgtacgaccacccgaggtactcgaacccagtcctaccacttccctccctgtctcgcacgttccgtaggtacgggacgacgtaagtacgtctactctaccgttccgttcgttacggccgggtaacacgttacgaaggttacgtttaggtttaaacgttaacttttaacgtttaagttagtacttacgtaacgttaaccaaaccggtaacggaaacctaccctaaccgctaccgtctaactactagtccgtacgtccgacttaccgtaccgtaagttaaccgtagggtacccggactacgtaacgaagttacgtacggacggtagtaacgtacgggttacgtacggtaccgtaggacttaacggtctttaacnccgtacctacgtaactcgtaaccgtagtaaaccccgtaccttaaacgaacgttaagaccctttaagttacccgtaacttaaccgttaccgtacgttaacctaaacgtaaccgttaacgtaaccggttaaccctcccgtaaacccccgtcgttccgttaaccggtccgggttaaccggacggggtaaccgaacgggttaagaacggacttaaaccccgaaacggtaaccgtagggttccgttaccggaccttaccgaacccttacgtaccgttttcgtaacg

SEQ ID NO: 285915 - DNA, 885 bp, Homo sapiens
  misc_feature: GYAE6OF01EQXLX.4.57.F02.1.454.CMB.1.raw
  modified_base (119)..(119): a, c, t, g, unknown or other
  misc_feature (119)..(119): n is a, c, g, or t
  modified_base (859)..(859): a, c, t, g, unknown or other
  misc_feature (859)..(859): n is a, c, g, or t
tcagagcactgtagcacgaccggtgctcgatttagctcgatatagttgggtttggggagccagtctcagtcaggacacagcatggacatgagggtccccgctcagctcctggggctccngctactctggctccgagatgccagatgtcgacacccagatcgacccagtcctccactccctcccttgtcctgctactcgtggtagggacacgagtgtacattcacttccgttcgttcggaccgggtactaagtccgtaaggtagttagtttaagttttaattttaagttttaagttaggttactacgtaacgtttaaccgaaaacccgggtaaggtaaaccccgtaccccttaagtccgttaaccttaaactccgtaagttccgtaccggtactacgttacctaaccgtttaaggtttaaacccgtaacgggttcccgggtaacctacgttaacgaaacgtttacctacgggtaggttacggtacggttacggtaacggtacgtttacgggtacgggtaaaccgtaacgtttacgtttaccgacctttacccgaccttaaaccgtaccgttaacggtaacggtttaaccctaaccgttaaccgtaaccggtttaaaggttaccgttttaacgttttaccgtaaacccgtttaacccttttaaccgttaaccgtttaacgggtaacccaaaacggtttccggttaaacccgtttaaccccggtaccccctttaacccccggttacgttacccttaacccgggtttaccgggtaaccgggtaaccgggtaaccgggtaaccggaagggtaacccggtaacgtaaacgtaaccggtaaacgttcggtacgttcggaaccgttnaaccccgtagttacggttcttaccgg

SEQ ID NO: 285916 - DNA, 774 bp, Homo sapiens
  misc_feature: GYAE6OF01BYEOA.4.57.F02.1.454.CMB.1.raw
  modified_base (619)..(619): a, c, t, g, unknown or other
  misc_feature (619)..(619): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatcgccagatgtgacacccagatcgacccagtcctccactccctcccttgtctgcctatcgtggtagggacgacgagacgtcatctactccttccgttcgggccgggtactaaggtcgtaaggtagtttaggtttaacgttttaattttttaaacgttttaaaagttttaggttaacgttaccgtaacggtttaaacccgaaaaccggtaaacggggtaaaacccgtaacccccgttaacgtccttaccgttagtacttacgttacgtcggtctcgacctacttaccgtttaacgtttaaacgtaacgggttacgggtaccctaataacgtaagttacgtacgtaggtcggtacggaggttaggtacgttacgggtagggtaaccgtagttacctttcctaccttccaaccgtactacgttaacgtacgttactaaccgtaactaacgtagtaacgtttgttacgacttaaccgtatacgttnaactaacgtgtaaccgttacccgtacccttaccccgtccgtacttaccggttaccgggtcgggtacggggtaacgtaccggaggtacgggtaactaacgtaaacggacggtaccgttgggtaccgtactacggtaccctagtcccgttgtacccg

SEQ ID NO: 285917 - DNA, 818 bp, Homo sapiens
  misc_feature: GYAE6OF01BR0GI.4.57.F02.1.454.CMB.1.raw
  modified_base (102)..(102): a, c, t, g, unknown or other
  misc_feature (102)..(102): n is a, c, g, or t
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
tcagagcactgtagcacgaccggtgctcgatttagctcgatatagttgggtttggggagccagtctcagtcaggacacagcatggacatgagggtcccccgntcagcctccgtgggctcctgctactctggctccgagatgccagatgacgaccacccagactcgaccctagtcctccacttccctccctgtctgcntcgtggtagganacagacgtcatcactctcgtcggccggacagtcgagtagttagttagttaattttaatttaaagttgtactcgtaacgttacgaaaccggtaaggtaaacccgacccgtaagtcctcgtagtacttcgtagtacgtacgtcgaccttacgttaccgtaaggtttaaaccgaacggggttcgggtacccctaaagttaccggtaaaagttcgttacggtagggtaccggtacgttaagggttacggtacgtacgggtaacggtacgtacgttaacgtttacccaccgttacctaccgaacctaacggtacgtacgttaaccgttactaaccgtaaccgttagttaacgttttaccttacgtaaaccttaacctttaaccggttaccgttaacgtaaaccctaacggtaaccgggtttaacccgttaaacccgtaccccgttacccccgttacccgtacgtttaccccggttaccgggtttaacccggggaaccgggtaaaccggtaaccgggttaaagggtcccgtaaagggtaaaccccttaaacgggaaaccggttaccggtacggtaacgggcccttaaccggacccgttaaccgtgttttaaccgg

SEQ ID NO: 285918 - DNA, 528 bp, Homo sapiens
  misc_feature: GYAE6OF01D23UK.4.57.F02.1.454.CMB.1.raw
  modified_base (268)..(268): a, c, t, g, unknown or other
  misc_feature (268)..(268): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaattggtatcagttcaacaggaanccctaagctctgatctatgctgcatccagtttacaaagtgggtcccatcaagattcagtggacgagtggatcgtgggacagatttcactctccacatctagttagtcctacaacctgaagtattttgactaacttactactgtacaactagtacgttacgaactaccccgtccgtactcctacgtttccggccggacgggacccgtaagggtacggagaacgtcaaaccggattacgtcgggcttaggcctacgcttacg

SEQ ID NO: 285919 - DNA, 605 bp, Homo sapiens
  misc_feature: GYAE6OF01BYKMV.4.57.F02.1.454.CMB.1.raw
  modified_base (590)..(590): a, c, t, g, unknown or other
  misc_feature (590)..(590): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatcctccctgtctgcatcgtggtgggagacagagtcatcactctcgttcggaccgggcaagtcagtagttagttagttatttaatttaaagttggtatactagttacaaaccgaggaaactccctaagcctcgtgactctatgctgactatacctaagttacgaacggtcggtaccatacgtaagtacttacgaggtcggacgtaggtcgtactcggtaggactacgttacttccacttcctacaccgtatacgtaagttactacctaacgtaaccgtagtaacgtttacttacgaaccttaactttactacgtacgtaacaagttacgtacgtaacctaccgtaccctctactacgtacggttcggacggacggtacgtagggtgacgtaacgtacgaaaccgtgtcggacgtcgtanaaccctgtacttccg

SEQ ID NO: 285920 - DNA, 683 bp, Homo sapiens
  misc_feature: GYAE6OF01B2XAM.4.57.F02.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (306)..(306): a, c, t, g, unknown or other
  misc_feature (306)..(306): n is a, c, g, or t
  modified_base (668)..(668): a, c, t, g, unknown or other
  misc_feature (668)..(668): n is a, c, g, or t
tcagagcactgtagcacgaccggtgctcgatttagctcgatataggttgggtttgggggccagtctcagtcaggacacagcatggacatgaggtccccgctcagctcctggggctcctgctactctggctccgagatgccagatgtgacacccagatgacccagtctccatcctccctgtctgcatcgtggtgganacgagatcatcatctcgtcggccggnaagtcagtagttagttagttaattaatttaagttgttatacgtagttacaaaccgacggtaacgaccctagcctactgatctangtctcgactactacgtaagttacgaaggttccgggtacagtacgaagtcttacgagtcgacgtaggtcgtacgtcggtaggaactacgttacttacgaccttaccgtaccaacgttacgtaaccgttacgttaaccgttaacctaacctaaaaccggtttagtaaacgtttaaccgttttacgaaacctttaacccgtttattaaccccgttagtaacccgtaattaaccgggttaacttaacccgtacccgtaccccgttccgtacctaccggttaccgttacgggacgggtaaccggaaacgaggtacggtagtaaacctaacgggaaacctacgggttacgtcggtacggtactaaccncttacgtcgttaccg

SEQ ID NO: 285921 - DNA, 816 bp, Homo sapiens
  misc_feature: GYAE6OF01BNCIL.4.57.F02.1.454.CMB.1.raw
tcagagcactgtagcacgaccggtgctcgatttagctcgatatagttgggtttggggagccagtctcagtcaggacacagcatggacatgagggtccccgctcagcctccgtgggctcctgctactctggctccgagatcgccagatgtcgaccacccagatacgacccagtcctcccacttccctcctcgtctcgctacgtcgtggtgggagaacgagacgtcatccactcttcgtcggaccggacaagtcagtgttagtttaagttaattttaagtttaagttggttactacgtaacgttaccaaaccggaacgggtaaaccgtcccctaagtccgttaccgtgtaacttctacgtcgtcctacgtaaccttacgttaacccgttaaaggtttaaaaccgggttaacggggttacccgggttaccctaaaagtttaaccgaaaacggtttacgttaaccgtaggggtccgggtaacgttagggtacgggttacgtaccggttacgggtaacttaacgtttactttacccgtaccttacctacccgtaacctattaccgtaacgttacctaacgtaacctaaccgttagttaacgtttattacgtaccgtttaacttacgttacgtacctaacgtaacgttacgttaaaccgttaccgttaccccgttaccccgttacccgtacgttacccgttaccgggtacccggtaccgggtaacggtaaaccgggtaaggtacgtaacccgtaaacggtaacggtaaacgttccgggtaggtccggttaaggacccttaacggtcccttcggtttaccccg

SEQ ID NO: 285922 - DNA, 717 bp, Homo sapiens
  misc_feature: GYAE6OF01BLIGZ.4.57.F02.1.454.CMB.1.raw
  modified_base (314)..(314): a, c, t, g, unknown or other
  misc_feature (314)..(314): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatcgccagatgtgaccacccagatcgacccagtcctccatccctccctgtctgcagttcgtggtggagacagtacgtcagtcatctcgttcggccggactaacgtcgaggtagttagtttaagttaattttaacgttaagttgtactacgtacgttaaccaaaccggagggtaaaccnccccgtaaagtccttacctagtactcgttaacgtcgtccgttacgtacttaccttacccgttaaaggtttaaaccggtaaacggggttcccgggttaacccaagttaacgaagttacttaccgtaggtcggacgtaggtacggtatcggtaaggtactagttacgttcctactacctaccgtacctatctaagttctaacctaacgtactaagttaacttcttacgtaccttaacgttactacgtacgtaacgtaactacggtaaccgttaactacccgttacccctcgtaccttaccgtacggttccgggaacgggtaccggtaacggtaacggtcggtaaatacccggtaaaacggaacctaggtcggtacgttccgaacggacccttcgttaagttcccg

SEQ ID NO: 285923 - DNA, 593 bp, Homo sapiens
  misc_feature: GYAE6OF01EOTR4.4.57.F02.1.454.CMB.1.raw
  modified_base (191)..(191): a, c, t, g, unknown or other
  misc_feature (191)..(191): n is a, c, g, or t
  modified_base (195)..(195): a, c, t, g, unknown or other
  misc_feature (195)..(195): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (235)..(235): a, c, t, g, unknown or other
  misc_feature (235)..(235): n is a, c, g, or t
  modified_base (358)..(358): a, c, t, g, unknown or other
  misc_feature (358)..(358): n is a, c, g, or t
tcagagcactgtagcacgaccggtgctcgatttagctcgatatagttgggtttggggccagtctcagtcaggacacagcatggacatgaggtcccgctcagctacctggggctcctgctactctggctccgagatgccagatgtgacaccagatgacccagtctccatcctccctgtctgcatctgtgganaccngagtcaatcatctcttgccggnaagtcagntgtagtattnttaaactggtatcagttcaaacctaggaaagcccctaaagctcctcgaatctaatgactggcatcccagtttacaagtgggtccagtcaagactcagtggcagttggatctaggcaggtattnactcgctacatacagttagtactacgacctagaacgtatttacggacaactttaccgtaacgtacgttccaaacgtacgtaacgtttaacgaacgttaaaccccctcggtacctaccgtaaccgttttccggacggtaacgggtaaccccgtaaaggttcggtaacgtaacgtaccgtaaacgaaacgttacgtacggtaccttagggaaccctaacccgacgttcgttaaccgg

SEQ ID NO: 285924 - DNA, 780 bp, Homo sapiens
  misc_feature: GYAE6OF01ESZ6R.4.57.F02.1.454.CMB.1.raw
  modified_base (515)..(515): a, c, t, g, unknown or other
  misc_feature (515)..(515): n is a, c, g, or t
  modified_base (559)..(559): a, c, t, g, unknown or other
  misc_feature (559)..(559): n is a, c, g, or t
  modified_base (774)..(774): a, c, t, g, unknown or other
  misc_feature (774)..(774): n is a, c, g, or t
tcagagcactgtagcacgaccggtgctcgatttagctcgatatagttggggtttgggggccagtctcagtcaggacacagcatggacatggacgggtccccgctcagcctccgtggggcctcctgctactcgtcggctccgagatcgccagtatgtacgaaccaccgagataccgacccgtacttccctaccctaccgttcccctcccgttgtcctcgcttacgtcggtgggtagggaacgaagacggtactacattacctacgttccgttccggttcgggacccgggtaacttaacgtacggtaaggtttagtttagttttaaagtttttaaacgtttttaaagtttaaacggttcggttaacttacggttaaccggttaaaaccgaaaaccggtaacgggtaaacccctaccccggttaacgtcctttaccgattacgttacctgttcgtccgtctactacgttacgttaacgtacggtaacggtccgactagacgtagtctacgtaggtcgnggtacggtagtacggtacggtacggtaacttacgtacctttacncctacctacacgttacgtaactacgttactaacctaacgtagtacgttaacgtttacgtaacctaacttaaccgttacaccgttacaaccgtaacgtacggttaacccttaccgaccctccgttaccgtaccgtcggttaccgggtacggaccgggtaacgtacggaaggtcgtaacctaagtaaccgagtacgtcgacgtacacttacgcttcngttacc

SEQ ID NO: 285925 - DNA, 1085 bp, Homo sapiens
  misc_feature: GYAE6OF01BLGBR.4.57.F02.1.454.CMB.1.raw
tcagagcactgtagcacgaccggtgctcgatttagctcgatatagttggggtttgggggccagtctcagtcaggacacagcatggacatgaggtccccgctcagctcctggggctcctgctactctggctccgagatgcagatgtgaccaccagatgaccagtctccatccctcctgtctagcatcgtggtggatacgagacgtactactctaactccttaccgttcggaccgggtactaaggtcaaggtagtttagttaagtttaattttaagtttaaagttaggttaattacgtagtttaaccgaaaaccgaacggggtaaaccgtaccccgttaaagtcctttaccgtaagttaccggttactaagttcggtaccgttacgtacctaaacgttaacccgtttaaaaggttttaaaaccggtaaaacgggtttacccgggggttaaccctaaacgttacgtaaaaggttacgttaacgggttaacgggttacgggtaacggttaaacgggttaacggggttaaacgttaccggggttaaacggggggtaaaccgttaaacggttttaaaacccgttttaacccgttaaccccggtttacccttaacccccgttaaaacccccgttaagtttaacccgttaaaacgggtttaaacccggttaaaccccttaaaaccggtttaaaccccggtttaaagggtaaaacgtttttaaacggttttttacccgaaaccggtttttaaaccctttaaaccggtttaaccgtttaacccggtttaaacgtaaaaccgggttaaaaccgttttaaccgggttaaacccccgggtttaacccctttaaacccccccgggtttaccggttaaccccgtttaacccgggtttaaccccgggttttaacccgggggtaaaccgggggtaaaaccgggggttaaaaccccgggtaaaccggggggtttaaaacggaaccgttaaaccgggttaaaccccgggtaaaaaccgggtttaacccggtacgggtaccgggttaaccccggtaaccggttaaccccggtaacccgtttaacgttccccggggttttaaaccc

SEQ ID NO: 285926 - DNA, 915 bp, Homo sapiens
  misc_feature: GYAE6OF01DJY6R.4.57.F02.1.454.CMB.1.raw
tcagagcactgtagcacgaccggtgctcgatttagctcgatatagttggggtttgggggccagtctcagtcaggacacagcatggacatgacgggtccccgctcagcctcctggggcctcctgctactcgtggctccgagatcgccagatgacgacacccagatcgaccagtcctccatccctcctagtctgactatacgtggtacgggaataacgacggtacgtaccatactacttccgtccgttcgggacccgggtataaacggtctagtaacggttagtttaagtttaattttaaatttaaagtttagtaattaccgtaagtttaaccaaaaccggtaagggtaaacccgaccccgttaagccctaccgtaagtacgtttcctaagtccgtgtcgtctaacttacccgttaaaggtttaaccggtaaaggttccggggttaccctaagttaacgtaacttaacgttacgtaggtacgggtacgtaacggttacggtaacggtaccggttaggggaaccgttaacgttacgtttactacccgtttacgtaaccctaaccgtaacttaccggtaaagttacccgttaacgttaacccgttaaacccgttaagggtttaacgtttaaccgttttacggtaaacctttaaaacccgtttaaccgtttaaccttaacggttaacccgttaaacgtaacgggtttaaacccgtttaaccggaacccgttttaaacccccccgtcggttaacccttaccccgtttaccggggttacgggaaacccggggtaacggggggtaaacccgttaagggggtaacgggtaacgttaacccggtaaacggtaaaaccggtaacccggtagggtttaaccgcgggtaaacccgaccgttaaacccgttacgttacggtttaccccg

SEQ ID NO: 285927 - DNA, 798 bp, Homo sapiens
  misc_feature: GYAE6OF01ELVYC.4.57.F02.1.454.CMB.1.raw
  modified_base (771)..(771): a, c, t, g, unknown or other
  misc_feature (771)..(771): n is a, c, g, or t
tcagagcactgtagcacgaccggtgctcgatttagctcgatatagttgggtttggggagccagtctcagtcaggacacagcatggacatgagggtccccgctcagctcctgggctcctgctactctggctccgagatgccagatgtcgaccacccagactcgacccagtcctccacttccctccctgtcctgctagtctggtgggaagacgagagtcatactacttcgttcgttcggccgggtactaacgtacgaggttaggttagttttaagtttaaagtttttaatttaaaacggttcggttaacttaccgtaacggtttaacccaaaaaccggtaacggggtaaaacccctccccgtaaagtcccgttaccgttacgtaacttacgtacttccggtacgttacgaccttacgttaaccgtttaaacggtttaaccgggtaaacggttcccggggtaccctaaagtaccgttaaagtacgtttcgaagggttcgtaaccgtaggtacgtacgttacgggacgggttaacctagtttaccgttaccctaccgttacccgtacctaacctaagtttaccgtaaacgttaccgtaaccttaaccgtaaaccgtagtttaaacgttactttaccgaacttaaccctttaatacgttaaccgtactaaccgttaacggttaacctaccttacccgtaccctaccgtacttacccgttcgggttaacggaccgtacgggaacgtaggtcggaacaacggttaacgaacgttcggngtaccgactacgaccctacgttgtacc

SEQ ID NO: 285928 - DNA, 171 bp, Homo sapiens
  misc_feature: GYAE6OF02IFV5H.4.57.F02.1.454.CMB.1.raw
  modified_base (170)..(171): a, c, t, g, unknown or other
  misc_feature (170)..(171): n is a, c, g, or t
tcagagcactgtagcacgaccggtgctcgatttagctcgatatagttggtttggggaagaggaagactgacggtccccaggagttcaggtgctgggcacagcggccctgggctgcctggtcaaggactacttccctacagtgctctgagcgggctggcaaggcgcatagnn

SEQ ID NO: 285929 - DNA, 170 bp, Homo sapiens
  misc_feature: GYAE6OF02GRA2R.4.57.F02.1.454.CMB.1.raw
  modified_base (170)..(170): a, c, t, g, unknown or other
  misc_feature (170)..(170): n is a, c, g, or t
tcagagcactgtagcacgaccggtgctcgatttagctcgatatagttgggtttggggaagaggaagactgacggtccccaggagttcaggtgctgggcacagcggccctgggctgcctggtcaaggactactccctacagtgctctgagcgggctggcaaggcgcatagn

SEQ ID NO: 285930 - DNA, 175 bp, Homo sapiens; identical to SEQ ID NO: 285652
  misc_feature: GYAE6OF02G6A4S.4.57.F02.1.454.CMB.1.raw
  modified_base (173)..(175): a, c, t, g, unknown or other
  misc_feature (173)..(175): n is a, c, g, or t

SEQ ID NO: 285931 - DNA, 495 bp, Homo sapiens
  misc_feature: GYAE6OF02IBP83.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagattttgctaacttactactgtcaacagagttacgattaccctccgcctcactttcggcggtagggaccaaggtggagatacaaacgactgtggctgcaccatctcg

SEQ ID NO: 285932 - DNA, 488 bp, Homo sapiens
  misc_feature: GYAE6OF02GIDF1.4.57.F02.1.454.CMB.1.raw
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtggggtccatcaagattcagtggcagtggatctgggacagatttcactctcaccatcagtagtctacaacctgaagtattttgctaacttactactgtcaacagagttacgataccctcgctcactttcgcgaggaccaaggtggagtatacaaacgactgtagctgcacatctacg

SEQ ID NO: 285933 - DNA, 548 bp, Homo sapiens
  misc_feature: GYAE6OF02I6MC3.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatccagtttacaaagtgggtcccatcaagattcagtggcagtggatctgggactagatttcactctcacatcagtagtctacaacctgaagtattttgactaacttaactactgtacaactagtacgttaacgacttacccctccgtcttacctacgtttcgggaccggacgggtaaccgaagggttggaaacggtacgtaaccgaaaccggtaaacgttcggtacggtccgttgactacccgtattccg

SEQ ID NO: 285934 - DNA, 488 bp, Homo sapiens
  misc_feature: GYAE6OF02I0QV9.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaagtgggtcccatcaagattcagtggcagtggatctgggacagatttcactctcaccatcagtagtctacaacctgaagtattttgactaacttactactgtacaacagagttacgatacccctccgctcactttcgcggaggacaggtgagatacaacgactgtggctgcaccatcg

SEQ ID NO: 285935 - DNA, 173 bp, Homo sapiens; identical to SEQ ID NO: 285623
  misc_feature: GYAE6OF02FWYQA.4.57.F02.1.454.CMB.1.raw
  modified_base (173)..(173): a, c, t, g, unknown or other
  misc_feature (173)..(173): n is a, c, g, or t

SEQ ID NO: 285936 - DNA, 487 bp, Homo sapiens
  misc_feature: GYAE6OF02JB30F.4.57.F02.1.454.CMB.1.raw
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagtatttgactaacttactactgtacaacagagttacgatacccctcgctcactttcggcgaggaccaggtgagatacaacgactgtgctgacacatctcg

SEQ ID NO: 285937 - DNA, 488 bp, Homo sapiens
  misc_feature: GYAE6OF02GNC1Z.4.57.F02.1.454.CMB.1.raw
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
tcagagcactgtagcacgaccggtgctcgatttagctcgatatagttgggtttgggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtcccatcaagattcagtggcagtggatctgggacagatttcactctcaccatcagtagtctacaacctgaagtattttgactaacttactactgtacaacagagttacgactaccctccgctcacttcggcgaggacaaggtgganagtcaaagactgtggctgcaccntcg

SEQ ID NO: 285938 - DNA, 495 bp, Homo sapiens
  misc_feature: GYAE6OF02GZ9NV.4.57.F02.1.454.CMB.1.raw
  modified_base (469)..(469): a, c, t, g, unknown or other
  misc_feature (469)..(469): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattgtatcagttctaaccaggaaagaccctaacgctcctgatctatgctgcatcctagttactaaagtgggtccatcaagattcagtggcagtggatctgggacgagatttcactctcaccatcagtagtctacaacctgaagtattttgactaaacttactactgtacaacagagttacactacccctccgctcacgtttcggcggacggacctaggtgganatcaaacgatgtcggctgctacatcg

SEQ ID NO: 285939 - DNA, 480 bp, Homo sapiens
  misc_feature: GYAE6OF02F34U3.4.57.F02.1.454.CMB.1.raw
  modified_base (477)..(477): a, c, t, g, unknown or other
  misc_feature (477)..(477): n is a, c, g, or t
tcagagcactgtagcacgaccggtgctcgatttagctcgatatagttgggtttggggccagtctcagtcaggacacagcatggacatgagggtccccgctcagctcctgggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatatgggacagatttcactctcaccatcagtagtctacaacctgaagattttgctaacttactactgtcaacagagttacgataccctcgctcacttcgcgaggaccaggtggagatcaacgactgtgctgcacatntcg

SEQ ID NO: 285940 - DNA, 488 bp, Homo sapiens
  misc_feature: GYAE6OF02G61IX.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtccatcaagattcagtggcagtggatctgggacagatttcactctcaccatcagtagtctacaacctgaagtattttgctaacttactactgtcaacagagttacgataccctcgctcactttcgcgaggacaaggtggagatacgaaacgacgtgtggctgcactatctcg

SEQ ID NO: 285941 - DNA, 531 bp, Homo sapiens
  misc_feature: GYAE6OF02H13GW.4.57.F02.1.454.CMB.1.raw
  modified_base (341)..(341): a, c, t, g, unknown or other
  misc_feature (341)..(341): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttcaaaccagggaaagccctaagctcctgatctatgctgcatccagtttacaaagtgggtccatcaagattcagtgcagtgatntgggacagatttcactctcaccatcagtacgtctacaacctgaatattttgactaactttactactagttacaactagaacgtttaccgacttaccccttccgccttctaccgtttcggacggtacggaccgtaagggtcggagactacgaaacgacgtacggtaggccttacggactaccgtattaccg

SEQ ID NO: 285942 - DNA, 484 bp, Homo sapiens
  misc_feature: GYAE6OF02F8NC5.4.57.F02.1.454.CMB.1.raw
tcagagcactgtagcacgaccggtgctcgatttagctcgatatagttgggtttggggccagtctcagtcaggacacagcatggacatgagggtcccgctcagctcctgggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctgggacagatttcactctcaccatcagtagtctacaacctgaagattttgctaacttactactgtcaacagagttacgataccctccgctcactttcgcgaggaccaaggtggagatcaaacgactgtggctgcaccatctcg

SEQ ID NO: 285943 - DNA, 486 bp, Homo sapiens
  misc_feature: GYAE6OF02JY3F7.4.57.F02.1.454.CMB.1.raw
  modified_base (194)..(194): a, c, t, g, unknown or other
  misc_feature (194)..(194): n is a, c, g, or t
  modified_base (414)..(414): a, c, t, g, unknown or other
  misc_feature (414)..(414): n is a, c, g, or t
  modified_base (471)..(471): a, c, t, g, unknown or other
  misc_feature (471)..(471): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagtttcaaaccagggaaagcccctaagctcctgatctatgctgcatccagtttacaaagtgggtcccatcaagattcagtgcagtgatctgggacagatttcactctcaccatcagtagtctaacaacctgaagtatttgactaacttactactgtcaangagttacgactaccctcgtctcactttcgcgaggaccaggtggagatcaacgaatgngctgacacatctacg

SEQ ID NO: 285944 - DNA, 492 bp, Homo sapiens
  misc_feature: GYAE6OF02GDJ6Y.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtccatcaagattcagtggcagtggatctgggacagatttcactctcaccatcagtagtctacaacctgaagtattttgactaacttactactgtcaacagagttacgactaccctcgctcactttcggcggaggaccaaggtggagatacaaacgactgtggctgcaccatcg

SEQ ID NO: 285945 - DNA, 511 bp, Homo sapiens
  misc_feature: GYAE6OF02FSKOE.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctaacaacctgaagtattttgctaacttactactgtacaacagagttacgactacccctccgctctacgtttcggcggagggacccaaggtggtaggagtactaacgaacgtacgtggtcgtcgcgaccatacg

SEQ ID NO: 285946 - DNA, 483 bp, Homo sapiens
  misc_feature: GYAE6OF02HROM1.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtgatctgggacagatttcactctcaccatcagtagtctacaacctgaagattttgactaacttactactgtcaacagagttacgataccctcgctcactttcgcgaggaccaaggtgagatcaaacgactgtggctgcacatcg

SEQ ID NO: 285947 - DNA, 501 bp, Homo sapiens
  misc_feature: GYAE6OF02IBXMJ.4.57.F02.1.454.CMB.1.raw
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatcagtttacaaagtgggtccatcaagattcagtgcagtggatctgggacagatttcactctcaccatcagtagtctaacaacctgaagtatttgactaacttactactgtacaactagtagttacgactacccctccgcttccactttcggacgtaggaccaaggtggaagatacgaaacgaactgtaggctgcaccatctcg

SEQ ID NO: 285948 - DNA, 502 bp, Homo sapiens
  misc_feature: GYAE6OF02HDPPF.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtccatcaagattcagtgcagtgatctgggacagatttcactctcaccatcagtagtctacaacctgaagatttgcaacttactactgtcaacagtacgttacgactacccctcgcctcactttcggcggtagggaccaaggtggaagactacgaaacgaactgtacggctgcacctatcctacg

SEQ ID NO: 285949 - DNA, 485 bp, Homo sapiens
  misc_feature: GYAE6OF02ILGZA.4.57.F02.1.454.CMB.1.raw
  modified_base (272)..(272): a, c, t, g, unknown or other
  misc_feature (272)..(272): n is a, c, g, or t
  modified_base (344)..(344): a, c, t, g, unknown or other
  misc_feature (344)..(344): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaancccctaagctcctgatctatgctgcatccagtttacaaagtggggtccatcaagattcagtgcagtggatcngggacagatttcactctcaccatcagtagtctacaacctgaagtattttgctaacttactactgtacaacagagttacgataccctccgctcactttcgcgaggacaggtggagatcaaacgatggtgctgcaccatctcg

SEQ ID NO: 285950 - DNA, 494 bp, Homo sapiens
  misc_feature: GYAE6OF02GKNJH.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatcgtgggacagatttcactctcaccatcagtagtctacaacctgaagtatttgactaacttactactgtacaacagagttacgactaccctctctcacttcgcgaggacaaggtggagactacaaacgtactgtcggctgacacctatcg

SEQ ID NO: 285951 - DNA, 173 bp, Homo sapiens; identical to SEQ ID NO: 285623
  misc_feature: GYAE6OF02GAX95.4.57.F02.1.454.CMB.1.raw
  modified_base (173)..(173): a, c, t, g, unknown or other
  misc_feature (173)..(173): n is a, c, g, or t

SEQ ID NO: 285952 - DNA, 518 bp, Homo sapiens
  misc_feature: GYAE6OF02FXMEN.4.57.F02.1.454.CMB.1.raw
  modified_base (194)..(194): a, c, t, g, unknown or other
  misc_feature (194)..(194): n is a, c, g, or t
tcagagcactgtagcacgaccggtgctcgatttagctcgatatagttgggtttgggggccagtctcagtcaggacacagcatggacatgagggtccccgctcagctcctgggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatcgtgggacagtatttcactctcaccatcagtagtctaacaacctgaagtattttagacttaacttacttactcgtacaactagagtttacgacttaccccgtcgtcctctacgtttcgacggacggtaccaaggtcggagtatacaaacgactgtcggtctgacacctatcttacg

SEQ ID NO: 285953 - DNA, 525 bp, Homo sapiens
  misc_feature: GYAE6OF02H9V4E.4.57.F02.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (343)..(343): a, c, t, g, unknown or other
  misc_feature (343)..(343): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnaagtcagagtgttagtattatttaaattgtatcagttcaaacaggaagccctaagctcctgatctatgctgcatccagttacaaagtgggtccatacaagattcagtgcagtgatctggacagnttcactctcacatcagtagtactaacaacctgaaagtaagttttcgactaaactttactaactcgtacaaacaagtacgttaacgacttacccctcgtacctcaacgtttcggacggacggaccgaaggtcggaagtactaacaaaccgaacgttgtacggacctggacctaccgtattacg

SEQ ID NO: 285954 - DNA, 481 bp, Homo sapiens
  misc_feature: GYAE6OF02GACWF.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtcccatcaagattcagtgcagtgatctgggacagatttcactctcacatcagtagtctacaacctgaagtatttgactaacttactactgtacaacagtagttacataccctcgctcacttcgacgaggaccgaggtgagatacaacgactgtgctgcacatcg

SEQ ID NO: 285955 - DNA, 176 bp, Homo sapiens
  misc_feature: GYAE6OF02I5GWZ.4.57.F02.1.454.CMB.1.raw
  modified_base (173)..(176): a, c, t, g, unknown or other
  misc_feature (173)..(176): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatagnnnn

SEQ ID NO: 285956 - DNA, 581 bp, Homo sapiens
  misc_feature: GYAE6OF02JB4UR.4.57.F02.1.454.CMB.1.raw
  modified_base (197)..(197): a, c, t, g, unknown or other
  misc_feature (197)..(197): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccggacaagtcagagtgttaagtatttaatttaaattggtatctagttacaaaaccgagggaaacaccctaagctcctgatctatgctgcactcctaagtttaacaaggtcgggtaccatacgaaagtattcaggtggactaggtggtatcgtgggaactagtatttactactctaccacctatcagtacgtactaactaaccgtagtaagttatttagtacttaacttaacttactagtacaacagtagtacgtacctaccctccgtcctaaaactcgttacggacgggacggaaccgtagggtacggtaagtacgtaaccgaaacgtaacgtaggtacggtcgtacgacctacctacttccg

SEQ ID NO: 285957 - DNA, 521 bp, Homo sapiens
  misc_feature: GYAE6OF02IZM05.4.57.F02.1.454.CMB.1.raw
  modified_base (221)..(221): a, c, t, g, unknown or other
  misc_feature (221)..(221): n is a, c, g, or t
  modified_base (518)..(518): a, c, t, g, unknown or other
  misc_feature (518)..(518): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccagggaaagccctaagctcctgatctatgctgcatcctagtttacaagtgggtcccatcaagattcagtggcagtggatcgtgggacagatttcacttctacaccatcagtacgtctaacaactgaagttattttgactaacttactactagtacaactagacgttacgactacccctccgctcctacgtttcggacggacggacctaagggtggacgaagtaccgaaacgactggtacggtctgaccacctntcg

SEQ ID NO: 285958 - DNA, 562 bp, Homo sapiens
  misc_feature: GYAE6OF02G8RG9.4.57.F02.1.454.CMB.1.raw
  modified_base (195)..(195): a, c, t, g, unknown or other
  misc_feature (195)..(195): n is a, c, g, or t
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttaatttaattggtatcagttanaaaccagggaaacgccctaagctcctgatctatgctgcatcagtttacaaagtcgggtccagtacaagattcagttggcagtggatcgtggacagtagtttcactntccacattaccagtacgttctaacaacgtcgtaaagtntttgctaacttacttaacgtgtaccaaagtagtaagttaccgtaactaaccccgttcccgactttacgacctttaccgggcgggaacgggtaccgaaggttcggaagtacgtacaaaccggaacgtggtacggtctacggaccacctagtcttaccg

SEQ ID NO: 285959 - DNA, 500 bp, Homo sapiens
  misc_feature: GYAE6OF02JCEU4.4.57.F02.1.454.CMB.1.raw
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaancccctaagctcctgatctatgctgcatccagtttacaaagtgggtcccatcaagattcagtgcagtgatctgggacagatttcactctcacatcagtagtctacaacctgaagattttgactaacttactactgtcaacagtagttacgattacccctccgctctactttcggcggtaggaccaagggtggaacgagtcaaacgaactggtgactgacaccattcg

SEQ ID NO: 285960 - DNA, 509 bp, Homo sapiens
  misc_feature: GYAE6OF02GYP7E.4.57.F02.1.454.CMB.1.raw
  modified_base (220)..(220): a, c, t, g, unknown or other
  misc_feature (220)..(220): n is a, c, g, or t
  modified_base (386)..(386): a, c, t, g, unknown or other
  misc_feature (386)..(386): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcacatcagtagtctacaacctnaagtatttgactaacttattactgtacaacagtactttaaataattacgcgtactctacgtttcggcggtaggaccaaggtggaacgatacgaaacgaactggtcgctagctaccatcttacg

SEQ ID NO: 285961 - DNA, 494 bp, Homo sapiens
  misc_feature: GYAE6OF02IB5ZS.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagccctaagctcctgatctatgctgcatcagtttacaaagtgggtcccatcaagattcagtgcagtgatctgggacagatttcactctcaccatcagtagtctacaacctgaagtattttgcaacttactactgtcaacagagttacgactacccctccgtctcactttcggcggagggaccaagggtggagatacaacgaactgtggctgactaccatccg

SEQ ID NO: 285962 - DNA, 489 bp, Homo sapiens
  misc_feature: GYAE6OF02FUPFK.4.57.F02.1.454.CMB.1.raw
  modified_base (195)..(195): a, c, t, g, unknown or other
  misc_feature (195)..(195): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtccatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctgggacagatttcactctcaccatcagtagtctacaacctgaagtattttgctaacttactactgtacaacagagttacgactaccctcgctcacttcggcgaggaccaaggtgagatacaaacgactgtggctgcacatctcg

SEQ ID NO: 285963 - DNA, 523 bp, Homo sapiens
  misc_feature: GYAE6OF02H6XJP.4.57.F02.1.454.CMB.1.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagngtgttagtatttatttaaattggtatcagttcaaaccagggaaagccctaagctcctgatctatgctgcatcctagtttacaaaggtgggtcccatcaagtatcagtggcagtggatcgtgggacagtatttcactctcacatcagtatctacaactgaagtattttgactaactttactactgtacaacagtagttaacgactacccctccgccttcactttcgggcggtacgggacctaagggtgaacgataccgaaacgacgttcggtaggcgtcggactacccgattccg

SEQ ID NO: 285964 - DNA, 488 bp, Homo sapiens
  misc_feature: GYAE6OF02HVWSX.4.57.F02.1.454.CMB.1.raw
  modified_base (354)..(354): a, c, t, g, unknown or other
  misc_feature (354)..(354): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaacaggaaagccctaagctcctgatctatgctgcatccagtttacaaagtgggtcccatcaagattcagtgcagtggatctgggacagatttnactctcaccatcagtagtctacaacctgaagtattttgactaacttactactgtacaacagagttacgataccctcgcctcactttcggcgagggaccaaggtggagatacaaacgatgtcggctgcacgatcg

SEQ ID NO: 285965 - DNA, 502 bp, Homo sapiens
  misc_feature: GYAE6OF02I264P.4.57.F02.1.454.CMB.1.raw
  modified_base (474)..(474): a, c, t, g, unknown or other
  misc_feature (474)..(474): n is a, c, g, or t
  modified_base (500)..(500): a, c, t, g, unknown or other
  misc_feature (500)..(500): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacagggaaagccctaagctcctgatctatgctgcatccagtttacaaagtgggtcccatcaagattcagtggcagtgatcgtgggactagatttcactctcaccatcagttagtactaacaacctagaagtattttcgactaacttactactgtaccaatagtagttaccactacccctcgctctacttcggcgtagggaccaaggtgganatacgaacgtatgtcggctgacaccntc

SEQ ID NO: 285966 - DNA, 520 bp, Homo sapiens
  misc_feature: GYAE6OF02IHG0H.4.57.F02.1.454.CMB.1.raw
  modified_base (408)..(408): a, c, t, g, unknown or other
  misc_feature (408)..(408): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaaagctcctgatctatgctgcatccagtttacaagtgggtccatcaagatcagtgcagtggatcgtgggacagatttcactctcaccatcagtagtctacaacctgaagtattttgacaatttactactntacaactagtagttacgacttacccctccgtcctacctactttcgggaccggtagggaccgaaggttcggaacgtatacgaaacgaactggtacggctcgacactactctcg

SEQ ID NO: 285967 - DNA, 502 bp, Homo sapiens
  misc_feature: GYAE6OF02G6KGS.4.57.F02.1.454.CMB.1.raw
  modified_base (331)..(331): a, c, t, g, unknown or other
  misc_feature (331)..(331): n is a, c, g, or t
  modified_base (336)..(337): a, c, t, g, unknown or other
  misc_feature (336)..(337): n is a, c, g, or t
  modified_base (367)..(367): a, c, t, g, unknown or other
  misc_feature (367)..(367): n is a, c, g, or t
tcagagcactgtagcacgaccggtgctcgatttagctcgatatagttgggtttggggtaggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattatttaaattggtatcattcaaaccaggaaagccctaagctcctgatctatgctgacatccagtttacaaagtgggtcccatcaagattnagtgnngtgatgtgagagtatactactctcacactnatatactacactatatattatactactactactactacactagtagtactactacctacctctctacgtacgtacgacggacgacgtagagtacgtacgtaacgaacgtacgtacgtacgtacgactactactac

SEQ ID NO: 285968 - DNA, 513 bp, Homo sapiens
  misc_feature: GYAE6OF02IEB4X.4.57.F02.1.454.CMB.1.raw
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttcaaacaggaaagcccctaagctcctgatctatgctgcatcagtttacaaagtgggtccatcaagattcagtgcagtggatctgggacagatttcactctacaccatcagtagtctacaacctgaatattttgactaacttactactgtacaactagaacgttacgacttacccctccgctctactttcggacggtacggaccgtaagggtcggaacgtatacgaaacgaactggtacgctgccaactactcttacg

SEQ ID NO: 285969 - DNA, 508 bp, Homo sapiens
  misc_feature: GYAE6OF02HBMJA.4.57.F02.1.454.CMB.1.raw
  modified_base (272)..(272): a, c, t, g, unknown or other
  misc_feature (272)..(272): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaanccctaagctcctgatctatgctgcatcctagtttacaaagtcgggtccatcaagattcagtgcagtgatctgggacagtatttcactctcaccatcagtatctaacaacctgtaagtattttgactaacttactactgtacaactagagttacactaccctccgcttcacgtttcggacggaggacctaagggtggaagactacgaaacgaactggtacggctagcctacattccg

SEQ ID NO: 285970 - DNA, 172 bp, Homo sapiens
  misc_feature: GYAE6OF02HYTQ2.4.57.F02.1.454.CMB.1.raw
tcagagcactgtagcacgaccggtgctcgatttagctcgatatagttgggtttgggggaagaggaagactgacggtcccccaggagttcaggtgctgggcacagcggccctgggctgcctggtcaaggactacttccctacagtgctctgagcgggctggcaaggcgcatag

SEQ ID NO: 285971 - DNA, 539 bp, Homo sapiens
  misc_feature: GYAE6OF02HS66F.4.57.F02.1.454.CMB.1.raw
  modified_base (219)..(219): a, c, t, g, unknown or other
  misc_feature (219)..(219): n is a, c, g, or t
  modified_base (380)..(380): a, c, t, g, unknown or other
  misc_feature (380)..(380): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctctgccgggnaagtcagagtgttagtatttatttaaattggtatcagttacaaaccagggaaagccctaagctcctgatctatgctgcatcctagtttacaaagtgggtccatcaagattcagtggcagtaggatcgtgggacagactttcactctcacatcagtatctanactagaatattttacgactaaacttactactcgtacaacagtacgttacgacttaccccctcgtctactacgtttcgggacggtacgggaaccgtaacgggtggaacgtagtaaccgaaacgtaacgtaggtacggtccttaggacccacgtattaccg

SEQ ID NO: 285972 - DNA, 515 bp, Homo sapiens
  misc_feature: GYAE6OF02I2BAW.4.57.F02.1.454.CMB.1.raw
  modified_base (195)..(195): a, c, t, g, unknown or other
  misc_feature (195)..(195): n is a, c, g, or t
  modified_base (270)..(270): a, c, t, g, unknown or other
  misc_feature (270)..(270): n is a, c, g, or t
  modified_base (423)..(423): a, c, t, g, unknown or other
  misc_feature (423)..(423): n is a, c, g, or t
  modified_base (512)..(512): a, c, t, g, unknown or other
  misc_feature (512)..(512): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccggcaagtcagagtgttagtatttatttaaattggtatcagttcaaacaggaaanccctaagctcctgatctatgctgcatcctagtttacaaaggttgggtcccagtcaagtattcagtggctaggtggatcgtgggacagtatttcgacttcctacacctatcagttagtctaactaacctgaatattttgactaacttactactntacaactagtacgttacgactaccctcctctctacgttcggcggtacggaccaaggtcggaagactaacgaacgatggtgtactgcacntcg

SEQ ID NO: 285973 - DNA, 545 bp, Homo sapiens
  misc_feature: GYAE6OF02IOR22.4.57.F02.1.454.CMB.1.raw
  modified_base (413)..(413): a, c, t, g, unknown or other
  misc_feature (413)..(413): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatcagttcaaaccagggaaagcccctaagctcctgatctatgctgcatccagtttacaaagtcgggtccatcaagattcagtggcagtgatctgggacagtatttcactctaccacatcagtagtctacaacctagaagtatttgactaacctttactactntacaactagagttacgtactacccctccgaccttctaccgtttcggcggtaacgggaccgaagggttcggaagtaacgtaacaaaaccggtaacgtaggtacggtactacggaccaaccgtactcgttaccg

SEQ ID NO: 285974 - DNA, 506 bp, Homo sapiens
  misc_feature: GYAE6OF02IXNND.4.57.F02.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (437)..(437): a, c, t, g, unknown or other
  misc_feature (437)..(437): n is a, c, g, or t
  modified_base (500)..(500): a, c, t, g, unknown or other
  misc_feature (500)..(500): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggnaagtcagagtgttagtattatttaaattggtatcagttcaaaccaggaaagccctaaagctcctgatctatgctgcatccagtttacaaagtggggtcccatcaagtattcagtgcagtgatctgggacagtatttcgactctcaccatcagtatctacaaccctgaagtattttgactaacttactactgtacaactagagttacatacccctccnctctacttcgggcgagggaccaaggtggacgtagtaacaaacgtacgtagtaggctgcaccgnttaccg

SEQ ID NO: 285975 - DNA, 172 bp, Homo sapiens
  misc_feature: GYAE6OF02FJV1N.4.57.F02.1.454.CMB.1.raw
tcagagcactgtagcacgaccggtgctcgatttagctcgatatagttgggtttgggggaagaggaagactgacggtcccccaggagttcaggtgctgggcacagcggccctgggctgcctggtcaaggaatacttccctacagtgctctgagcgggctggcaaggcgcatag

SEQ ID NO: 285976 - DNA, 520 bp, Homo sapiens
  misc_feature: GYAE6OF02I7JA4.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagccctaagctctgatctatgctgcatccagtttacaagtgggtccatcaagattcagtgcagtgatctgggacagtatttcacttctacaccatcagtagtctaacaacctgaagtattttgactaacttactactgtacaactagtagttaccgattacccctcgctctaccgtttcggcggtacggaccgtaaggtcggaagtacgtaccaaacgtaactcgtacgggcctggaccaccattaccg

SEQ ID NO: 285977 - DNA, 562 bp, Homo sapiens
  misc_feature: GYAE6OF02G07XD.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaattggtatcagttcaaaccagggaaacgccctaagctcctgatctatgctgcatcctagtttaacaaaggtcgggtccatacaagattcagtggcaggtgtatctagggacagtatttcactctcacatcagtagtctacaacctgaagttatttgactaacttactactagtaccaaatagtacgttacgaccttaccccgtccgtacctaccttaaccgtttcgggaccggtacgggtaaccgtaagggtcggaacgtacgtaaccgaaacggtaacgtacggttacggtccgttacgaccgtacctattaccgg

SEQ ID NO: 285978 - DNA, 488 bp, Homo sapiens
  misc_feature: GYAE6OF02HFRVW.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgctaacttactactgtcaacagagttacgataccctccgctcactttcgcgagggaccaggtggagatcaaacgactgtggctgcaccatcg

SEQ ID NO: 285979 - DNA, 174 bp, Homo sapiens; identical to SEQ ID NO: 285816
  misc_feature: GYAE6OF02IV853.4.57.F02.1.454.CMB.1.raw
  modified_base (174)..(174): a, c, t, g, unknown or other
  misc_feature (174)..(174): n is a, c, g, or t

SEQ ID NO: 285980 - DNA, 505 bp, Homo sapiens
  misc_feature: GYAE6OF02GOCXM.4.57.F02.1.454.CMB.1.raw
  modified_base (388)..(388): a, c, t, g, unknown or other
  misc_feature (388)..(388): n is a, c, g, or t
  modified_base (409)..(409): a, c, t, g, unknown or other
  misc_feature (409)..(409): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtccatcaagattcagtggcagtggatctgggacagatttcactctcaccatcagtagtctacaacctgaanattttgactaacttactactntacaacagtagttacgactaccctccgctctacttcggcggaggaccgaggtggagatacgaaacgtacgtgtcggcttagaccaccgtatcttcg

SEQ ID NO: 285981 - DNA, 516 bp, Homo sapiens
  misc_feature: GYAE6OF02J2L6E.4.57.F02.1.454.CMB.1.raw
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (394)..(394): a, c, t, g, unknown or other
  misc_feature (394)..(394): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtcctgcatctgtgggagacagagtcatcatctcttgccgggcaagtcagagtgttagtatttatttaaattggtatcagttcaaaccngggaancccctaagctctgatctatgctgcatccagtttacaaaggtgggtcccatcaagacttcagtggcagtggatcgtggacagtatttcgactctcaccatacagtagtctacaacctgaatntttacgctaacttactactgtctaacagtacgttacacttacccgtcgctctacgtttcgacggtacggacaaggtggaacgatacgaaacgtactggtcgtactgaccaccgtatcgttcg

SEQ ID NO: 285982 - DNA, 500 bp, Homo sapiens
  misc_feature: GYAE6OF02HLTKN.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccggcaagtcagagtgttagtatttatttaaaattggtatcagttcaaaccagggaaagcccctaagctcctgatctatgctgcatccagtttacaaagtgggtcccatcaagattcagtgcagtggatcgtgggacagatttcactctcacatcagtatctacaactgaatatttgactaacttactactgtacaacagtagttacgactacccctcgactctacttcgcgtaggaccaaggtcggagatacgaaacgtacgtagtcgctagactaccatcttacg

SEQ ID NO: 285983 - DNA, 660 bp, Homo sapiens
  misc_feature: GYAE6OF02JE1BF.4.57.F02.1.454.CMB.1.raw
  modified_base (219)..(219): a, c, t, g, unknown or other
  misc_feature (219)..(219): n is a, c, g, or t
  modified_base (653)..(653): a, c, t, g, unknown or other
  misc_feature (653)..(653): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgtgattatttaatttaagttgtatcgtagttaaccaaacggtaagggaaaccctaccccgtaaggtcccttaccgtagtacttacgtagtcgtcgttcgactacttaccgttaagtttaaacgaacggggttccgggtaccctagtaacgtaaacgttactaccgtagggtcggacgttaggtaggtacttcgggtacggaacgtagtttactttacgaccttctaccaactactacgtaggttacctacctaaccaccgtaaggtaagtttactttacgaacctttaacgttaccttacgacgttaacccaaagtacgttaacgttaccgtaacccttaccccgtctacctacttaccggttcggaccgggtacggacgtagggtcgaatactaacgaagtacgtaggtcgactcgacctacncgttacg

SEQ ID NO: 285984 - DNA, 574 bp, Homo sapiens
  misc_feature: GYAE6OF02G7H5J.4.57.F02.1.454.CMB.1.raw
  modified_base (276)..(276): a, c, t, g, unknown or other
  misc_feature (276)..(276): n is a, c, g, or t
  modified_base (423)..(423): a, c, t, g, unknown or other
  misc_feature (423)..(423): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttacaaaccagggaaacnccctaagctcctgatctatgctgcatcctagttacaaaggtgggtacccatcaagtattcagtggctaggtggatcgtagggacaggtatttcactctcaccatcagtagtctaacacctagaagtattttgactaacttactactntacaactagtacgttacgtactacccctccgtccttacgtaaccgtttccgggaccgggtacgggaacccgtaagggtacgggtaacggtaacgtaccgtaaaaccggtaacgttacggtacgggaccgttacggacctacccgattaccg

SEQ ID NO: 285985 - DNA, 492 bp, Homo sapiens
  misc_feature: GYAE6OF02HKEFN.4.57.F02.1.454.CMB.1.raw
  modified_base (196)..(196): a, c, t, g, unknown or other
  misc_feature (196)..(196): n is a, c, g, or t
  modified_base (408)..(408): a, c, t, g, unknown or other
  misc_feature (408)..(408): n is a, c, g, or t
  modified_base (459)..(459): a, c, t, g, unknown or other
  misc_feature (459)..(459): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaaccagggaaagccctaaagctcctgatctatgctgcatccagtttacaaagtgggtcccatcaagattcagtggcagtggatctgggacagatttcactctcacatcatgtctacaacctgaatattttagctaacttactactntcaacagtagttacgatacccctcgctcactttcgcgacggacaggtgganagtacaaacgtactgtcggctgactaccatacg

SEQ ID NO: 285986 - DNA, 492 bp, Homo sapiens
  misc_feature: GYAE6OF02HO8EU.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggcaagtcagagtgttagtatttattaaattggtatcagttcaaaccagggaaagcccctaagctcctgatctatgctgcatccagtttacaaagtgggtccatcaagattcagtggcagtgatcgtgggacagtatttcactctcaccatcagtagtctacaacctgaagtattttgacttaacttactactgtacaactagagttacgactacccctccgctcactttcggacgacggacaaggtgagatacaacgatgtcgctgcactatcg

SEQ ID NO: 285987 - DNA, 519 bp, Homo sapiens
  misc_feature: GYAE6OF02I55O6.4.57.F02.1.454.CMB.1.raw
  modified_base (271)..(271): a, c, t, g, unknown or other
  misc_feature (271)..(271): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaanccctaagctcctgatctatgctgcatccagtttacaaagtgggtccatcaagattcagtggcagtggatctgggacagattcactctcacctatcagttagtctacaacctgaagtatttgactaacttactactgtacaacagtacgttacacttacccctccgtcctctaactttcggacggacgggtaccaagggtggaagtacgtacgaaaccgtaacgttagtcggactcgacactagttccg

SEQ ID NO: 285988 - DNA, 569 bp, Homo sapiens
  misc_feature: GYAE6OF02HZ9HA.4.57.F02.1.454.CMB.1.raw
  modified_base (222)..(222): a, c, t, g, unknown or other
  misc_feature (222)..(222): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggnaagtcagagtgttagttatttaatttaaattggtatcagttacaaacagggaaagccctaagctcctgatctatgctgcatcctagtttacaaaggtgggtaccatcaagtattcgagtaggctaggtggatcgtagggactagtatttcactctcaccatcagtacgtctaacaactgaattatttgactaactttactactctaacaactaaggtacgttaccgactacccctccgccttctaaccgtttcgggaccgggtacgggaccgtaagggttacggacggtaactaccgtaaaaccgacgttagggtacggtacccgtaggtacctaccctattcccgg

SEQ ID NO: 285989 - DNA, 522 bp, Homo sapiens
  misc_feature: GYAE6OF02ITSM2.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaaagctcctgatctatgctgcatccagtttacaaagtggggtcccatcaagattcagtgcagtggatctgggacagatttcactctccaccatacagtagtctacaacctgaagtatttgactaacttactactgtacaacagtacgttacgaacttacccctccgcttccactttccggcgggaaggaccaaggtgggaagtaactacgtaaaacgaactggtaggcttagccaccatcttacg

SEQ ID NO: 285990 - DNA, 489 bp, Homo sapiens
  misc_feature: GYAE6OF02HRO5A.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtgcagtggatctgggacagatttcactctacaccatcagtagtctacaacctgaagtatttgctaacttactactgtacaacagagttacgactaccctcgctcacttcggcgaggaccaggtgagatacaaacgtactgtcggctgcacatctcg

SEQ ID NO: 285991 - DNA, 489 bp, Homo sapiens
  misc_feature: GYAE6OF02GMYC5.4.57.F02.1.454.CMB.1.raw
  modified_base (486)..(486): a, c, t, g, unknown or other
  misc_feature (486)..(486): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctgggacagatttcactctcacatcagtagtctacaacctgaagtattttgctaacttactactgtcaacagacgttacgactaccctcgctcacttcgcggaggacaaggtggagatacaaacgtactgtcgctgcactatntcg

SEQ ID NO: 285992 - DNA, 527 bp, Homo sapiens
  misc_feature: GYAE6OF02HW1OJ.4.57.F02.1.454.CMB.1.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (354)..(354): a, c, t, g, unknown or other
  misc_feature (354)..(354): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnaagtcagatgttagtatttattaatgtatcagttcaaacaggaagccctaagctctgatctatgctcgcatcctagtttacaaagtcgggtccatacaagattcagtggcagtgatcgtggacagtatttcactcncacatcagtagtctaacactgaatatttgctaacttactactcgtacaacgagtagttaacgtactacccctcgtcttcctacttcgggacggtacggacgtaacggtaggacgtaactaacgtaaaccggtaacgttggtacggacgttcggaccaccgtacgttcttacgg

SEQ ID NO: 285993 - DNA, 696 bp, Homo sapiens
  misc_feature: GYAE6OF02FF36I.4.57.F02.1.454.CMB.1.raw
  modified_base (359)..(359): a, c, t, g, unknown or other
  misc_feature (359)..(359): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtcgaccacccagatcgacccagtcctccactcccgtccctgtctgcatcgtggtagggacacaggactctactctactcgtcgttggccggactaagtcaggtagttagttaagttattttaacttaagttggttactacgtacgttaaccgaaaccgtacggggtaaaccctacccgtaagtccgttacctagtacttctagtcgtaccgtntaccgtacctaccgttaacgttaaacggtaacggtccgggtaaccctagtaacgtagtactacgtaggtacgacggtaggtagtacgtcggtacggaactacgtacttacaccttacacctacgtaactacgtactacgtactaacctaacgtagtaacgttactaccgtaacttaacctactactacgtaactaacgtacgttaccgtacctacccgtacccgttacgaccgttacgtaccgggtacgggaacgggtaccggacgtaggtaacggactaaaccgttaaccgaacggtacgtacggtcgtaccacggtaccctacgttcgttacccg

SEQ ID NO: 285994 - DNA, 500 bp, Homo sapiens
  misc_feature: GYAE6OF02IX5DW.4.57.F02.1.454.CMB.1.raw
  modified_base (275)..(275): a, c, t, g, unknown or other
  misc_feature (275)..(275): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaacnccctaagctcctgatctatgctgcatcctagtttacaaagtcgggtccatcaagattcagtgcagtgatcgtgggacagtattcactctcactatcagtagtactacaaccgtagtaagtattttcgactaacttactactgtacaacagtattacgactaccctcgctcacttcggacggaggaccaggtgagtagtacaaacgacgtgtcgctggcacattcg

SEQ ID NO: 285995 - DNA, 527 bp, Homo sapiens
  misc_feature: GYAE6OF02INCM0.4.57.F02.1.454.CMB.1.raw
  modified_base (195)..(195): a, c, t, g, unknown or other
  misc_feature (195)..(195): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttattaaattggtatcagttcaaacaggaagcccctaagctcctgatctatgctgcatccagtttacaagtgggtccatcaagtattcagtgcagtggatcgtggactagatttcacttcncacatcagtagtctaacaactgaatatttgactaacttactatnactaanagtacgttacgacttacccctccgtccttcgtacgtttcggacggtacggaccgtaagggtcggaagtaactacgtaaaacgtacgtacggtacggacgtcgaccacctactcttacg

SEQ ID NO: 285996 - DNA, 492 bp, Homo sapiens
  misc_feature: GYAE6OF02GPH7J.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctggacagatttcactctcaccatcagtagtctacaacctgaagtatttgctaactttactactgtacaacagagttacgactacccctcgctctactttcgcggaggaccaaggtggagatcaaacgtactgtgctgcacatctcg

SEQ ID NO: 285997 - DNA, 502 bp, Homo sapiens
  misc_feature: GYAE6OF02FO1SJ.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtgatctgggacagtatttcactctcacatcagtagtctacaacctgaagtatttgactaacttactatgtacaacagtacgttacgactacccctcgtctctacgttacggcggacggtaccaaggtggaagactacgaaacgactgtcggctcgcacatctcg

SEQ ID NO: 285998 - DNA, 581 bp, Homo sapiens
  misc_feature: GYAE6OF02ISAYP.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (390)..(390): a, c, t, g, unknown or other
  misc_feature (390)..(390): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaacaggaaagccctaagctcctgatctatgctgcactcctagtttacaaaggtgggtcccatacaagtattcagtggcagtgatcgtgggacagtatttcacttctacaccatcagttacgtacctanaacccgtgtaaagttattttagacttaaacttactactagtacaacgtagtacgttaaccgtaccttaccccttaccgccttaccgtaacgtttcgggaccgggtacgggtaacccgtaaggggttggaacgtacgtaaccgaaaccggtaaccgtaggttacggtccttacggaccctacctagttaccg

SEQ ID NO: 285999 - DNA, 517 bp, Homo sapiens
  misc_feature: GYAE6OF02GXWOH.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaagcccctaaagctcctgatctatgctgcatccaagtttacaaagtggggtacccatcaagattcagtggcagtggatctggggacaggatttcactctcaccatcagtagtctacaacctgaagtatttgactaaacttactactgttacaactaagagttacgattacccctccgtactctactttcggacggagggaccaagggtaggagaatacaaacgtaactggtacgctcgccacatctcg

SEQ ID NO: 286000 - DNA, 614 bp, Homo sapiens
  misc_feature: GYAE6OF02GJ8XQ.4.57.F02.1.454.CMB.1.raw
  modified_base (326)..(326): a, c, t, g, unknown or other
  misc_feature (326)..(326): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccaggtgacccacgtctccactcctcccctcgtctgcatctgtgggaggacagagtcatcatctcttgtccgggcgaagtcagagtgttagttattattttaaattaggtatacagttactaaacccaagggaaaggcccctaacgactccctgatctatgctgcatcactttanaaacgtagggtcccgatcaagattcagtggcagtggatcttgggacagtatttcactctacaccatctagtaagtctactaacctagaagtaaattttgtacctaaactttacgtaccttgtacctaaacaaggtacgttaaaccgtactaacccccttccgccttctaaccgtttttaccgggccggaacgggggaaccctaacggggttggaacggtaactaaccgtaaaaccgtaaaccgttggttcggaccgtaggtacccaaccctacgttacttggttaccc

SEQ ID NO: 286001 - DNA, 575 bp, Homo sapiens
  misc_feature: GYAE6OF02IWBY4.4.57.F02.1.454.CMB.1.raw
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
  modified_base (358)..(358): a, c, t, g, unknown or other
  misc_feature (358)..(358): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagttatttatttaaattggtatcagttcaaacagggaanccctaagctcctgatctatgctgcactcctagtttacaaaggtcgggtcccatcaaagtattcagtggacagtggatcgtggganagtatttcactctcacatcagtgtactacacctagtaatatttgacttaacttactactacgtacaactagtacgttaacgtacttaccccttccggtaccttacgtaaccgttttccgggaccggggtaaggacccggtaaaggggtggtaacggtaacgtaaccgaaaacggtaaccgttaggtcggtacccgtaggaccctaccgtacttaccg

SEQ ID NO: 286002 - DNA, 565 bp, Homo sapiens
  misc_feature: GYAE6OF02HOE53.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtattttatttaaattggtatcagttcaaaccagggaaagccctaagctcctgatctatgctgcatcctagtttacaaagtggggtcccatcaagattcagtggacgagtggatcgtgggactagatttcactctcacatcagtagtactaactaacgtgaagtatttgactaacttacttactagtacaactagtaacgttaaccgactacccctccgtcctacgtaccgtttccgggaccgggacgggtacccgtaagggtacgggaagtactaaccgtaaacgtaaccgtaggtacgggtactaggtacccaaccgtatcgttaccg

SEQ ID NO: 286003 - DNA, 546 bp, Homo sapiens
  misc_feature: GYAE6OF02I581D.4.57.F02.1.454.CMB.1.raw
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (273)..(273): a, c, t, g, unknown or other
  misc_feature (273)..(273): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacngagtcatcatctcttgccgggcaagtcagatgttagttatttatttaaattggtatcagttcaaacagggaaanccctaagctcctgatctatgctgcactctagttacaaagtcgggtccatcaagtattcagtgcgagtagatctgggacagtattcactctccacatcagtacgtctacaacctagtaagttatttgactaacttacgtactgtactaacgagtacgtaacgtacctaccctcctctctaccgttacgggacggacgggtacccgtaagggtcgggtaaagacgtaaccgaaacggtaccgttaggacggtactacggacctaccgtattaccg

SEQ ID NO: 286004 - DNA, 512 bp, Homo sapiens
  misc_feature: GYAE6OF02JF21H.4.57.F02.1.454.CMB.1.raw
tcagagcactgtagcacgaccggtgctcgatttagctcgatatagttgggtttgggggccagtctcagtcaggacacagcatggacatgagggtccccgctcagctcctgggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaagtgggtccatcaagattcagtggcagtggatcgtgggacagtatttcactctcaccatcagtatctacaacctgaagtatttagactaacttactactagtcaacagacgttacgactacccctccgctcactttcggcggtacgggacctaaggtcggaagatacgtaaacgaacgtgtcggctcgaccacctatcttacg

SEQ ID NO: 286005 - DNA, 564 bp, Homo sapiens
  misc_feature: GYAE6OF02FPU59.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggttatcagttcaaaccagggaaagcccctaagctcctgatctatgctgcatccagtttacaaagtgggtccatcaagattcagtgcagtggatcgtagggacagatttcgactctcaccatcagtagtctaacaacctgaagtacttttgactaacttactacttgtactaaacagtaagttacgaacttaccccgtccgactctaccgtttacggaccgggtacgggacccgtaagggtcgggaagtaacgtaaccgtaaaccggtaacgttacggtacgggtaccgtacggaccgtaaccgatttacccgg

SEQ ID NO: 286006 - DNA, 542 bp, Homo sapiens
  misc_feature: GYAE6OF02GGNAI.4.57.F02.1.454.CMB.1.raw
  modified_base (272)..(272): a, c, t, g, unknown or other
  misc_feature (272)..(272): n is a, c, g, or t
  modified_base (410)..(410): a, c, t, g, unknown or other
  misc_feature (410)..(410): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggcaagtcagagtgttagtatttatttaaattggtatcagttcaaacagggaaancccctaagctcctgatctatgctgcatccagtttacaaagtgggtcccatcaagtattcagtgcagtggatcgtgggacagatttcactctcacatcagtagtctacaacctagaagtatttgactaacttactactntcaaacagtagttacgacttacccctccgtacctctaccgtttccgggacggtacgggaccgtaacgggtggaacgtacgtaaccgaaacgtaacgttacggtcggtacctaggacccgtacctacttaccg

SEQ ID NO: 286007 - DNA, 500 bp, Homo sapiens
  misc_feature: GYAE6OF02H9JDC.4.57.F02.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (272)..(272): a, c, t, g, unknown or other
  misc_feature (272)..(272): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaaccagggaancccctaagctcctgatctatgctgcatccagtttacaaagtgggtccatcaagattcagtgcagtgatcgtggacagtatttcactctcaccatcagtacgtactacaacctagaagtattttgactaacttactactgtacaacagtattacgactaccctccgcttctacgtttcggacgtacggacaaggtggagactacaacgtactgtgctgcactatcttcg

SEQ ID NO: 286008 - DNA, 630 bp, Homo sapiens
  misc_feature: GYAE6OF02FQ2H4.4.57.F02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (284)..(284): a, c, t, g, unknown or other
  misc_feature (284)..(284): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctggtggganacagngtcatcatctctgccgggacaagtcagtagttgttagttattttaatttaaagttgttatctagttacaaacgagggaacnccctaagcctctgatctatcgctgctattcctaagtttaacgaaggtcgggtacctagtacgaagtacttcgaggtggacgtaggtaggtacgtcggtagggactagttacttctaacttcctactaactatacgtagttacgtactaacctaacgtagtaagttactttagaccttaacttacttactacgtacaagtacgttacgttaacctaccttaccccttaccgtccttaccgtacggtttaccgggacgggtaaccggacgtaagggtacggaacgtaaccgtaaccggtaaaccggacgttcgggtaccgtaccgtaccgtaccgtaccgtacttccg

SEQ ID NO: 286009 - DNA, 506 bp, Homo sapiens
  misc_feature: GYAE6OF02H6LT2.4.57.F02.1.454.CMB.1.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
  modified_base (502)..(502): a, c, t, g, unknown or other
  misc_feature (502)..(502): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttattaaattggtatcagttcaaacaggaagcccctaagctcctgatctatgntgcatccagtttacaaagtgggtccatcaagattcagtggcagtggatctgggacagatttcactctcaccatcagtagtctaacaacctgaagtattttgacaacttactactgtacaacagtagttacgtaactaccctcgcctcactttacggcggtaggacgaggtggaagactacgaaacgtaactgtacggctacgcactacgtntacg

SEQ ID NO: 286010 - DNA, 522 bp, Homo sapiens
  misc_feature: GYAE6OF02G67V9.4.57.F02.1.454.CMB.1.raw
  modified_base (273)..(273): a, c, t, g, unknown or other
  misc_feature (273)..(273): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacagggaaancccctaagctcctgatctatgctgcatccagtttacaaagtgggtcccatcaagattcagtgcagtgatcgtggacagtatttcactctcaccatcagtagtctaacaactgaagtattttgactaacttactactagtcaaactagacgttacacttaccccgtcgtaccttcaccgtttcggaccgtagggtaccaagggtcggaagactacgaaacggtactacggtcgacgtcgacctacattcg

SEQ ID NO: 286011 - DNA, 569 bp, Homo sapiens
  misc_feature: GYAE6OF02F2X2A.4.57.F02.1.454.CMB.1.raw
  modified_base (199)..(199): a, c, t, g, unknown or other
  misc_feature (199)..(199): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (427)..(427): a, c, t, g, unknown or other
  misc_feature (427)..(427): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatccctccctgtctgcatctggtggganacagagtcatcatctcttcggccggacaagtcagtagtgttagtattttaatttaaagttggtatcagttacaaaccgagggaaacnccctaagctctgatctancgctgcatcctagttaacgaaggtcgggtcccatacgaagtattcgagtggacgtagtgatcgtaggactagtacttcactctccaaccatacgagttacgtactaaccaacgtgtaaagttntttacgaccttaaacttactactagtaacaacgagtaacttaaccgactacccctcgctaccgttacgttcgggaccggaggtaaccaagggtcgaagtactaaccgaaacgtacgtggtcggtacgtcgacctacagttcg

SEQ ID NO: 286012 - DNA, 579 bp, Homo sapiens
  misc_feature: GYAE6OF02I2TDL.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcagtcagagtgttagtatttattaaattggtatcagttcaaacagggaacgccctaagctcctgatctatgctgcatccagtttacaaaggtgggtcccatcaagtatcagtggcagtggtatcgtgggacagtatttcactctacacctatcagtacgtactacaacctgtaagtatttgacttaactttactacttcgtacaacgtagtaacgttaaccgaccttacccctaccgtaccttaccgttaccgtttccgggaccgggtaaccgggaccgtaagggtacggaagtaaccgtaaccgaaaccggtaacgttcggtacggtacgtacggaccctaacctacgttcgttaccg

SEQ ID NO: 286013 - DNA, 559 bp, Homo sapiens
  misc_feature: GYAE6OF02HQQFJ.4.57.F02.1.454.CMB.1.raw
  modified_base (269)..(269): a, c, t, g, unknown or other
  misc_feature (269)..(269): n is a, c, g, or t
  modified_base (319)..(319): a, c, t, g, unknown or other
  misc_feature (319)..(319): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaattggtatcagttcaaacaggaanccctaagctcctgatctatgctgcatcagttacaagtgggtccatcaagnttcagtgcagtgatcgtggacagtatttcacttctcacctatcagtacgtactaccaactgaagtatttgactaacttactactgtacaaacgtagtacgttacgaacttacccctccgtacttaccgtaccgttttacgggaccggtacggggtaaccgtaacggggtggaacgtaacgtaaccgtaaaaccggtaacgttaggtacgggtaccgttacggaccgtacctaagttcccg

SEQ ID NO: 286014 - DNA, 533 bp, Homo sapiens
  misc_feature: GYAE6OF02G7JEH.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaacaggaaagccctaagctcctgatctatgctgcatccagttacaaaggtcgggtcccatacaagattcgagtggacaggtgatcgtagggactagtatttcactctcacctatcagttagtacctaacaaccgtgtaagttattttcgacttaaacttactactagtacaacagtaagttacactaccctcgtctctacgttcgcggtacggactaagggtcgaagtactacgaaacgtacgtaggtcggactaggactaccagttacg

SEQ ID NO: 286015 - DNA, 571 bp, Homo sapiens
  misc_feature: GYAE6OF02HF3F2.4.57.F02.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (424)..(424): a, c, t, g, unknown or other
  misc_feature (424)..(424): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccgggnaagtcagagtgttagttatttaatttaaattggtatctagttcaaaccagggaaagcccctaagctcctgatctatgctgcactcctagtttaacgaaacggttcggggtacccataccaaagtatttacgaggtggacgtagtggatcgtgggacagtatttcacttctacaccatcgagtacgtctaactactagtaatntttacgactaacttactactatactaacagtacgttacgactacccctcgaccttacgtacgttccgggacgtacgggaccgtaaggtcggaacgtacgtaaccgaaacgtacgtaggtacggtcgtagtaccacctatccgttacg

SEQ ID NO: 286016 - DNA, 560 bp, Homo sapiens
  misc_feature: GYAE6OF02JWZPN.4.57.F02.1.454.CMB.1.raw
  modified_base (195)..(195): a, c, t, g, unknown or other
  misc_feature (195)..(195): n is a, c, g, or t
  modified_base (547)..(547): a, c, t, g, unknown or other
  misc_feature (547)..(547): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggcaagtcagagttgttagttatttaatttaaattggtatctagttacaaacagggaaacgacccctaagcctcctagactctatgctgctactacctagtttaacaaaggttcgggtacccatacaagtattcagtggactaggtgtatcgtagggacagtatttacacttctcacatactagttagtactaactacctagaattattttacgacttaaacttactactcgtaacaataagtagttaacaccttacccacgtctactacgtttcgacggacggacgtaaggtggaagtaactaccgaaagtacgtacgtggaccgttanactaccgattccg

SEQ ID NO: 286017 - DNA, 546 bp, Homo sapiens
  misc_feature: GYAE6OF02HBAEH.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacgagggaaagccctaagctcctgatctatgctgcatccagttacaaagtcgggtccatcaagtatcagtggcagtgatcgtgggacagtatttcacttctacacctatctagtagtacctaacaacctgaagtattttcgactaacttactactagtacaactagtacgttacgactaccccgttccgaccttctaccgtttccggacggtacggaccgtaagggtggaacgacgtaacgaaacggtaacgtggtacggtccgtagaccctacctagttccg

SEQ ID NO: 286018 - DNA, 571 bp, Homo sapiens
  misc_feature: GYAE6OF02JU1P8.4.57.F02.1.454.CMB.1.raw
  modified_base (269)..(269): a, c, t, g, unknown or other
  misc_feature (269)..(269): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctctgccggcaagtcagagtgttagtatttatttaaattggtatcagttacaaacaggaaanaccctaagctcctgatctatgctgcatcctagtttaacaaggttcgggtaccatacaagattaccagtggcgagtggatcgtgggactagtatttactactctacacctatctagtagtactaacaacctagaagtattttagacttaacttacttacgtatacgaaactagtaattaccgaacttacccctaccgtactcctacgtttacggacggacgggtacaagggttacggaacgtaagtacgtaaaaccgtaccgttaggtacggtcttaaggacctaaccctagttaccgttacg

SEQ ID NO: 286019 - DNA, 653 bp, Homo sapiens
  misc_feature: GYAE6OF02I8W8A.4.57.F02.1.454.CMB.1.raw
  modified_base (198)..(198): a, c, t, g, unknown or other
  misc_feature (198)..(198): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtctccatccctccctgtctgcatctggtggganacagagtcatcatctctggccggcaagtcagagtgttagttatttatttaaattggtatctagttacaaacgaggaacgcccctaagctcctgactctatcgctcgctactcctaagttaacgtaaagggtcgggtaccctaagtacgtaaagtacttacgaggtggtacgtaggtggtactcggtagggaacgtagttactttacactacctacctaactatacacgacgtacgtacctaacgacgtacctaagtaacgttactttttaacgaaccttaaactttaacttaccgtacgtaccgtaaacctacgttaactttaaacgttaacttaccgtactacgttaccgttaccggttaccgggtacgggaacggtaaccggtaagggtacgtaacgtaacgttaaccgaacggtaacgttcggtacggtaccgtacggtaccaaccgttacg

SEQ ID NO: 286020 - DNA, 509 bp, Homo sapiens
  misc_feature: GYAE6OF02FI2FV.4.57.F02.1.454.CMB.1.raw
  modified_base (409)..(409): a, c, t, g, unknown or other
  misc_feature (409)..(409): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggttatcagttcaaacaggaaagccctaagctcctgatctatgctgcatccagtttacaagtgggtccatcaagatcagtgcaggtgatcgtgggacagtatttcacttctcacatcagtagtctaacaacctgaagtatttgactaacttactactntacaacagtagtacgactacccctcgcctctacgtttccggacggaggaccgaagggtcggacgataccgaaacgtactggtcggctagccacattaccg

SEQ ID NO: 286021 - DNA, 566 bp, Homo sapiens
  misc_feature: GYAE6OF02GWYHQ.4.57.F02.1.454.CMB.1.raw
  modified_base (220)..(220): a, c, t, g, unknown or other
  misc_feature (220)..(220): n is a, c, g, or t
  modified_base (561)..(561): a, c, t, g, unknown or other
  misc_feature (561)..(561): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctctgccggnaagtcagagtgttagtatttatttaaattggtatctagttcaaaccagggaaacgcccctaagctcctgatctatgctgcatccagtttacaaggtcgggtccatacaagtattacagtggactaggtggatcgtagggactagtactttacacttctactaccatcaagttacgtactaactaacctagaaacgttattttacgacttaactttacctagtcgtaccaataagtacgttaaccgacttacccccgtcgaccttaccgtaccgtttccggacgggacggtaccgaaggtaggaagtaacacgaaacgtaacgtgtacgctgaccactactnttacg

SEQ ID NO: 286022 - DNA, 508 bp, Homo sapiens
  misc_feature: GYAE6OF02HNGRP.4.57.F02.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaacaggaaagccctaagctcctgatctatgctgcatccagtttacaaagtggggtccatcaagattcagtggcagtggatcgtgggacagtatttcactctcacatcagtagtctacaacctgaagtatttgctaactttactactgtacaacagtagttacgactaccctccgctctacttcggacggacggaccgaaggtggaagatacgaaaccgtaactgtacggctagccacgtatcttacg

SEQ ID NO: 286023 - DNA, 599 bp, Homo sapiens
  misc_feature: GYAE6OF02HPSUM.4.57.F02.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccatccctccctgtctgcatctggtggganacagagtcatcattctcgttcggccgggnaagtcagagtgttagttatttatttaaattggtatctagttcaaacgaggaaacnccctaagctcctgatctatgctgcatctagtttacaaggtcgggtccatcaagtattcgagtggcaggtggatcgtagggacaggtactttcgacttctaccaccatcagttacgtactacaacctagtaagttattttagactaactttactactgtacaaacgtagtaacgttacgaaccttaccccgtcgccttacgtaaccgtttccgggacggtaacgggtaacccgtaagggtacggaacgtacgtaaccgaaaaccggtaacgttcggtacgggtacccttacgggaccctacccgtagtttacccg

SEQ ID NO: 286024 - DNA, 679 bp, Homo sapiens
  misc_feature: GYAE6OF02JZ472.4.57.F02.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcgttggccgggnaagtcagtagttgttagttaatttattaaattggtatctagttacaaacgaggaacgtcccctaagctccgtagatctatcgctgacatcctaagtttaacgaaacggttcgggtaaccctatacgaaagtacttacgaggtcggacgtaggtgtaacgtcgtagggtaactagtactttcacgtacctacgaacctatacgtaagttacgtaacctaacctaaccgtagtaagttactttacgaccttaaactttactacttagtaaccgtaaacgtacgttaacgttaaccgtacccttaaccccgttccgtaccttaccgttaccggtttaacggggaccggtaaccggggtaaccgtaacgggttacggaaaccgtaacgttaaacccggtaaaacgttaccggttaggttaccggacgttaccggaaccctaccggttacttccgttaacg

SEQ ID NO: 286025 - DNA, 506 bp, Homo sapiens
  misc_feature: GYAE6OF02GNHCS.4.57.F02.1.454.CMB.1.raw
  modified_base (395)..(395): a, c, t, g, unknown or other
  misc_feature (395)..(395): n is a, c, g, or t
  modified_base (413)..(413): a, c, t, g, unknown or other
  misc_feature (413)..(413): n is a, c, g, or t
  modified_base (500)..(500): a, c, t, g, unknown or other
  misc_feature (500)..(500): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatcctagtttacaaagtgggtcccatcaagattcagtggctagtggatcgtaggacagtatttcacttctacacatcagtagtctacaactgaagtntttgactacttactactntacacagagttacgacttacccctcgctctaccttcggcgacggacaggtacggagtactacgaaacgactggcgctcgacaccgtntcttcg

SEQ ID NO: 286026 - DNA, 576 bp, Homo sapiens
  misc_feature: GYAE6OF02G4W9L.4.57.F02.1.454.CMB.1.raw
  modified_base (222)..(222): a, c, t, g, unknown or other
  misc_feature (222)..(222): n is a, c, g, or t
  modified_base (271)..(271): a, c, t, g, unknown or other
  misc_feature (271)..(271): n is a, c, g, or t
  modified_base (342)..(342): a, c, t, g, unknown or other
  misc_feature (342)..(342): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccattcctccctgtctgcatctgtgggagacagagtcatcatctcttgccggganaagtcagagtgttagtatttatttaattggtatcagttcaacagggaanaccctaagctacctgatctatgctgcatcctagtttacgaaggtcgggtaccatacaagtattacagtggnaggtggatcgtgggacagtatttcactctacactatcagtacgtactactactagtaagttagtttacgacttaacttacttacgtacgtacaacgtaggtaacgttaccgtaaccttaccccgtaccgtcttaccgttacgttccgggtacgggaaccggtacggtaggtacggacgtaactaacgaaaccgtacgttggtacggtactcgtaccgtactacgttcgttaccg

SEQ ID NO: 286027 - DNA, 603 bp, Homo sapiens
  misc_feature: GYAE6OF02I5YV9.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctcttgccggnaagtcagagtgttagtatttatttaaattggtatcagttacaaacgagggaaacnccctaagcctcctgactctatgctgctatcctagtttaacaaagttcgggtacctagtcaaagtacttacaggtggctaggtggtactcgtgggaactagtactttcgacttctaccaactatctagttagtactaacgaacctagtaagttattttacgaccttaactttactactagtacaactacgtacgttaacgaccttaaccccgttccgacgttacctacgtttacggaccgggtacgggtaaccgtaaggggtacggaagtaaccgtaaccgtaaacggtaccttaggtacggtacctacggaccctaccgtacgttaccg

SEQ ID NO: 286028 - DNA, 538 bp, Homo sapiens
  misc_feature: GYAE6OF02H38CH.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (277)..(277): a, c, t, g, unknown or other
  misc_feature (277)..(277): n is a, c, g, or t
  modified_base (376)..(376): a, c, t, g, unknown or other
  misc_feature (376)..(376): n is a, c, g, or t
  modified_base (531)..(531): a, c, t, g, unknown or other
  misc_feature (531)..(531): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggnaagtcagagtgttagtattttaatttaaattggtatcagttacaaaaccgagggaaancccctaaagctcctgatctatgctgcatccaagtttaacaaagtcgggtccaatcaagtattcaggtggcaggtagatcgtggacagtactttcactcncacatacagtatctaacaactgaagttatttcgactaacttactactatacaatagtacgttacgtactaccctcgtctactacgtttcgggagacgggtacgaaggtcgggaatactaacgaaaacgacgtggtcggtacctcgtaccaacctntacttcg

SEQ ID NO: 286029 - DNA, 551 bp, Homo sapiens
  misc_feature: GYAE6OF02GZWXW.4.57.F02.1.454.CMB.1.raw
  modified_base (329)..(329): a, c, t, g, unknown or other
  misc_feature (329)..(329): n is a, c, g, or t
tcagagcactgtagcacgaccggtgctcgatttagctcgatatagttgggtttgtggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgtcgggcaagtcagagtgttagtatttattaaattggtatcagttcaaacaggaaagcccctaagctcctgatctatgctgcatccagtttacaaagtgggtcccatcaagattnagtggcagtggatcgtgggacagatttcactctcaccatcagtagtactacaacctgtaagtattttagactaacttactaactgtacaaacagtaagttacgaacttaccccttaccggccttactaccgtttcgggaccggtaagggaacccgtaaagggtacggtaacggaacttaccgaaaacgtaacgtaggtacgggaccttaggcctacctaacg

SEQ ID NO: 286030 - DNA, 534 bp, Homo sapiens
  misc_feature: GYAE6OF02F7TCH.4.57.F02.1.454.CMB.1.raw
  modified_base (196)..(196): a, c, t, g, unknown or other
  misc_feature (196)..(196): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (424)..(424): a, c, t, g, unknown or other
  misc_feature (424)..(424): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttattaaattgtatnattcaaacaggaanccctaagctcctgatctatgctgcatacctagtttaacgaaaggtcgggtacccatacgaagtattcagtggacgtagtggatcgtagggactagtatttcactctacactatcagtactctaacaactgtaatatttcgactaaacttactactntacaatagtacgtaacactaccctcgtactctacgttcggacggtacggaccgaggtcggaacgtactaaccgaaacgtacgttggtacggcgtacgactacctagtccg

SEQ ID NO: 286031 - DNA, 525 bp, Homo sapiens
  misc_feature: GYAE6OF02H4M7V.4.57.F02.1.454.CMB.1.raw
  modified_base (195)..(195): a, c, t, g, unknown or other
  misc_feature (195)..(195): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaaattggtatcagttcaaaaccaggaaagcccctaagctacctgatctatgctgcatccagtttacaaaagtgggtaccatacaagattcagtgcagtgatctgggacagatttcactctcacatcagtagtctaacaacctgaaagattttgactaaacttactaactgtacaacagaagttacatacccctacgtctctattccggcggaacggaccgaacggttggaagtaactacgaaaacgtaaacgtgtcggacttcgaccgaactatcttacg

SEQ ID NO: 286032 - DNA, 627 bp, Homo sapiens
  misc_feature: GYAE6OF02JFJXZ.4.57.F02.1.454.CMB.1.raw
  modified_base (198)..(198): a, c, t, g, unknown or other
  misc_feature (198)..(198): n is a, c, g, or t
tcagagcactgtagcacgaccggtgctcgatttagctcgatatagttgggtttggggagccagtctcagtcaggacacagcatggacatgagggtccccgctcagctcctggggctcctggctactctggctccgagatgccagatgtgacacccagatgacccagtctccatccctccctgtctgcatctgtggganacagagtcatcatctcttgccgggcaagtcagagtgttagttattttaatttaattggtatctagttacaaaccgagggaaacgcccctaagctccgtgacttctatgctgacactacctaagtttacgaaaggtcggggtaccctatacaagtattcagtggcgtagtggatcgtgggactagtacttcgaccttctacccactactcgtaagttacgtacttaaccaaccgtagtaaagttacttttacgacttaaaccttacttacctcggttaaccaacgtagttaacgttaaccgtaaccttaccccgtaccgtccttaccgtaccgtttccgggaccggtacggggtaaccgtaagggtggaacgtaaactaccggaaaacgttacggtcggttacggcgttaccgaccgtaccgtatttccg

SEQ ID NO: 286033 - DNA, 608 bp, Homo sapiens
  misc_feature: GYAE6OF02IUWAD.4.57.F02.1.454.CMB.1.raw
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccgggcaagtcagtagtgttagtatttatttaattggtatcagttcaaacagggaacnccctaagctcctgatctatgctgcatcctaagtttaacgaaggttcggggtacccatacaagtacttcgagtggctaggtggtactcgtgggacaggtatttcgacttcgtaccacctatctagtagtactaactaaccgttagaacgttatttagaccttaactttacctaacgttactacgaactacgtaacgttaccgtaccttaccccctccgtaccttaccgttaccgtttaccgggaccggtacggggaccgtaagggtacgggaactacgtaacctaaaccggtacgttaggtacggtaccgtcgtacccgactaccgttcgttaccg

SEQ ID NO: 286034 - DNA, 571 bp, Homo sapiens
  misc_feature: GYAE6OF02GEQ76.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccggcaagtcagagtgttagtattttattaaattggtatcagttacaaacagggaaacgccctaagcctctgatctatgctgcatccagttaacaaaggttgggccatcaagtattcagtgcaggtgatcgtgggactagtactttcaactctcacctatacagtacgtacctaacaacctagaattattttcgactaacctttacttactagtactaacaaggttacgttaacgacttacccctccgtctaccgtacgtttccgggacggtacgggtaccgaacggggttggaacggtaactaaccggaaacgtaaccgttgggtacggtaccgttggacccgtacctatttcccg

SEQ ID NO: 286035 - DNA, 536 bp, Homo sapiens
  misc_feature: GYAE6OF02H670Y.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttgccggcaagtcagagtgttagtattttaatttaaattggtatcattcaaacaggaacgacccctaagcctcctgattctatgctgcatcctagtttaacaaggtcggggtccagtcaaagtattcaggtggcaggtgatctgggacagtatttcactctcacatcagtatctaacacctagaatatttgactaacttactacttagtacaacgtagtaacgttacgaccttacccctcgaccttcacgtttcggacggtaggaccgaaggtggaagactacgaaacgtaccgtggtacggctacgaccacgtactcttacg

SEQ ID NO: 286036 - DNA, 579 bp, Homo sapiens
  misc_feature: GYAE6OF02IWZPC.4.57.F02.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcttggccgggnaagtcagagtgttagtatttaatttaattggtatntagttacaaacagggaacaccctaagctctgtatctatgctgcatcctaagttacgaaaggtcgggtaccataacagtatttacgagtgtacagtgatcgtaggactagtatttcacgtctacactatacgtagtatctaacacctagaagttactttgactaacttanaacgttnaactaacgtagtagttaacgacctacccgtccgtactaccgtacgtttacggacgggtaccggacgaacgggtaggtaacgaacgttaacgtaaaccggtaacgttacggacgttacgtaccgacgaaccttacgtacgttaccg

SEQ ID NO: 286037 - DNA, 522 bp, Homo sapiens
  misc_feature: GYAE6OF02GGETW.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaacgccctaagctcctgatctatgctgcatccagtttacaaagtcgggtccatcaagattcagtggcagtggatcgtgggacagtatttcgactctacaccatcagtacgtctaacaacctgaagtatttagactaacttactactgtacaactagtacgttacgacttacccctcgtcttactacgttcggacggacggaccgaaggtggaagactacgaaacgtactggtacgcgtacgactacctatctacg

SEQ ID NO: 286038 - DNA, 538 bp, Homo sapiens
  misc_feature: GYAE6OF02FO4IB.4.57.F02.1.454.CMB.1.raw
  modified_base (195)..(195): a, c, t, g, unknown or other
  misc_feature (195)..(195): n is a, c, g, or t
  modified_base (361)..(361): a, c, t, g, unknown or other
  misc_feature (361)..(361): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctcttgccgggcaagtcagagtgttagtatttatttaaattggtatcagttcaaacaggaagccctaagctcctgatctatgctgcatccagtttacaaagtgggtccatcaagattcagtggacagtggatcgtgggacagtatttcactcnctaccatctagtagtctacaacctgtaagtattttagactaacttactactagtacaactagacgttacgacttacccctccgtctaccgtacgtttaccggcgggtacgggaccgaagggtcggaacgtaactaccgaaaacgtacgtacggtcggaccgttgacctaccattccg

SEQ ID NO: 286039 - DNA, 577 bp, Homo sapiens
  misc_feature: GYAE6OF02F1LNV.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttattaaattggtatcagttacaaaccagggaaacgcccctaaaggcctacctgactacgtatgctgctatcctagttaacaaggtcgggtaccatacgaagtattcgaggtcggacgtaggtaggtactcgtagggactaggttactttcaccttcgtaccaacctatacgtagttacgtacctaacaaccgtagtaagttatttacgacttaaccttactactcgtacaacgtagtacgtacacctaccctcgctacgtacgttcggacggtacgaccgtagggtaggacgtacgtaacgtaaacgtagtcggtacggctacgacctactattaccg

SEQ ID NO: 286040 - DNA, 566 bp, Homo sapiens
  misc_feature: GYAE6OF02HOJIA.4.57.F02.1.454.CMB.1.raw
  modified_base (227)..(227): a, c, t, g, unknown or other
  misc_feature (227)..(227): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccgggcaagtcagngtgttagtatttatttaaattggtatcagttacaaaccgagggaaagcccctaagctcctgatctatgctgctatacctaagtttacaaaggtcgggtaccatacaagtattacgtagtggctaggtggtatcgtgggacagtatttcactctaccacactcagtacgtactaaccaactagaaagttatttcgtaactaacttactaactgtaccaatagtaagttactaactacccgtaccgtctactacgttccggacgggacggacgtaaggtacggacggtaactaccgaaacgtaacgtggtacggtactccgactaacccgtatcgttaccg

SEQ ID NO: 286041 - DNA, 653 bp, Homo sapiens
  misc_feature: GYAE6OF02JUO2L.4.57.F02.1.454.CMB.1.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
tcagagcactgtagcacgaccggtgctcgatttagctcgatatagttgggtttggggagccagtctcagtcaggacacagcatggacatgggggtccccgctcagctcctggggctcctgctactctggctccgagatgccagatgtgacacccagatgacccagtctccatcctccctgtctgcatctgtggganacagagtcatcatctcttgccgggcaagtcagtagtgttagtatttatttaaattggttatctagttacaaacgagggaacnccctaagctcctgaatctatcgctgcactccgtaagtttacgaaaggtcgggtacctaacgtacaacggtatttcgaaggtcgggtcaacggtggaacttacgtacggggaactaggtactttcaccgtctacacctagtcgtaacgtcgttacctaacgtaaccgttagtaacttacgtttacgaacttaaaccgtttacttaacttacgttaacaaacgtagttaaacgttaaccgaacctttaccccgttacgtaacccttaccgttaaccgttcgggaacgggtaacgggtaccgtaagggttacggaacggttaactaacgtaaaccgtaacggtagtacggtacctaggacctacgtacttccgttacg

SEQ ID NO: 286042 - DNA, 554 bp, Homo sapiens
  misc_feature: GYAE6OF02I6X3N.4.57.F02.1.454.CMB.1.raw
  modified_base (220)..(220): a, c, t, g, unknown or other
  misc_feature (220)..(220): n is a, c, g, or t
  modified_base (274)..(274): a, c, t, g, unknown or other
  misc_feature (274)..(274): n is a, c, g, or t
  modified_base (295)..(295): a, c, t, g, unknown or other
  misc_feature (295)..(295): n is a, c, g, or t
  modified_base (413)..(413): a, c, t, g, unknown or other
  misc_feature (413)..(413): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccggganaagtcagtagtgttagtatttattaaattggtatcaagttacaaacagggaacnccctaagcctcctagatctangctgactactcctaagtttacaaaggttcgggtaccctaagtacaaatagttcagtggcagtggatgtaggacagtactttcactctacacatctagtatactaacaactagtaagtntttacgacttaaacttactactgtaacaaactagtacgtacgacctaccctcgactactacggttacgacggacggactaacgggtagaagtactaacgaaacgtaactcggtagaccgtacgactactacgtcgttaccg

SEQ ID NO: 286043 - DNA, 521 bp, Homo sapiens
  misc_feature: GYAE6OF02GYQK6.4.57.F02.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaaccagggaaagacccctaagactcctcgatctatgctgcatccagtttactaaagtcggggtccatacaagattcagtggcagtggatcgtgggacagatttcactctcaccatcagtagtctacaacctagaagtatttgactaacttactactgtacaacagtattacgactaccctccgctctacttcggcggacggacgtaacggtggaggaattaccgaaagtaaccgtgtacggcgtcgacaccgtatcttcg

SEQ ID NO: 286044 - DNA, 551 bp, Homo sapiens
  misc_feature: GYAE6OF02FHGT7.4.57.F02.1.454.CMB.1.raw
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttacaaaccgagggaacgcccctaagctcctgatctatgctgcatcctagttactaaaggtggggtccatacaagtattcagtggcagtggatcgtggacagtattcactctacacctatcagttacgtctaactaactagtaagttatttcgacttaacttactactgtacaatagtagttaccgactacccctcgtacctctaccgtttcggaccggtaacgggtaccgaaggtcggaagacgtaaccgtaaacgtacgtcggtacggtcgtacgaccacctattccgttacg

SEQ ID NO: 286045 - DNA, 652 bp, Homo sapiens
  misc_feature: GYAE6OF02IIWSD.4.57.F02.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccgganaagtcagagtgttagttatttattaaagttgtatcagttacaaacgaggaacaccctaagcctctagatctatcgactgactactaccgtaagttttaaccgaaaggttcgggtaccctaagtacgaaaggttacttaccgaaggtttacggacgtaaggttcgggaacgttaccgtggggaactaaggttacctttactaaccgttactaccctaacctaactacgtaacgttaagtacccttaaacctaaccgttaggtaaacgtttattttacgaaccgttaaactttacctacgttacgtacaaacgtagtacgttaccgaacttaccctccgcttacctacgttcggacggtacggaccgtaaggtggaactaacgtaacgtaaacgtacgtacggtcggtaccgtacgacctaccgtattaccg

SEQ ID NO: 286046 - DNA, 740 bp, Homo sapiens
  misc_feature: GYAE6OF02FGGXX.4.57.F02.1.454.CMB.1.raw
tcagagcactgtagcacgaccggtgctcgatttagctcgatatagttgggtttgggagccagtctcagtcaggacacagcatggacatgagggtccccgctcagctcctggggctcctgctactctggctccgagatgccagatgtcgaccacccagatcgacccagtcctccactccctccctgtctagctactccgttaggagggacacgaggactcatccatctcgttacggccggactagtcaggttacgttagtttaacttattttaagtttaacgcggttaactaccgtaagttaaccccgaaaaccggagggtaacccctcccgtaacgttcctaccttagtacttacctagtccggtcttacgacccttagtttaaacccgtaacgttttaaccggaggttaccggacctaagtaacgtaaacgttcaggttacggacgtacgtaggtacgtacgttacggacgtactaacctctaccgacttccacgtacctagtaccgtacgtactaccctaaagtactaaaggttctttacgtacctaacttaccgtactacgtacgtaaccacgtacggttaaccctacccgaccccgttacctccggtacttaaccgggtccgggtacccgggaaagggtcgtaaaccggaggttaaaccgaacgtaacccgtaaaaccgttaggtacccgttcggaccggttaccaccgggtaacccttagtttaccggttaaccc

SEQ ID NO: 286047 - DNA, 547 bp, Homo sapiens
  misc_feature: GYAE6OF02GWFL3.4.57.F02.1.454.CMB.1.raw
  modified_base (352)..(352): a, c, t, g, unknown or other
  misc_feature (352)..(352): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggacaagtcagagtgttagtatttatttaaattggtatcagttcaaacagggaagccctaagctctgatctatgctgcatccagtttacaaagtcgggtccatcaagattcagtggcaggtgatcgtgggacagntttcactctacaccatcagacagcctacacgcctagaagtattttacgctaaactttattacctagtactaacagtacttaaattaacttacgacgtcctactacgtttcgggacgtaacgggtaccgtaagggtacggaacgtagtaaccgaaacgtaacgttacgggtaggtcctacggtaccacgttaaccg

SEQ ID NO: 286048 - DNA, 577 bp, Homo sapiens
  misc_feature: GYAE6OF02FMWU6.4.57.F02.1.454.CMB.1.raw
  modified_base (270)..(270): a, c, t, g, unknown or other
  misc_feature (270)..(270): n is a, c, g, or t
  modified_base (323)..(323): a, c, t, g, unknown or other
  misc_feature (323)..(323): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttattaaattggtatcagttcaaaccagggaancccctaagctcctgatctatgctgcatctagttacaagtgggtccatcaagtntcagtgcagtgatcgtggacagtatttcactctcacatcagtactctaacaacctagaagttatttagaccttaaacttacctattcgtaccaaacgtagtaacgttaccgtaacttaccccgtccgccttaccgtacgtttccgggacgggtaacggtaccgtaagggtacggtaacgtaactaaccggtaaaacgtaaccgttaggtacgggtaccttacgggaccctaacccgttacttcgtttaacccgg

SEQ ID NO: 286049 - DNA, 596 bp, Homo sapiens
  misc_feature: GYAE6OF02IB4Q4.4.57.F02.1.454.CMB.1.raw
  modified_base (225)..(225): a, c, t, g, unknown or other
  misc_feature (225)..(225): n is a, c, g, or t
  modified_base (548)..(548): a, c, t, g, unknown or other
  misc_feature (548)..(548): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcattctcgttgccgggnaagtcagagttgttagttattttatttaaattggtatctagttacaaaccagggaaacgccctaagcctacctgatctatgctgactactcctaagtttaacgaaaggttcggggtacccaagtacctaagtacttacgagtggcaggtggatcggtgggactagtactttcacttctacctacctatacgtagttacgtactaacaaccgttagtaacgttattttacgaacttaaccttaactactacgtactaactaagtacgttacgtaccttaccccttaccgtcctctaccgttcgggacgtacgggaaccgtaggnggtagactaccgaaacgacgttggtacgcgtacgacctacctattccg

SEQ ID NO: 286050 - DNA, 176 bp, Homo sapiens
  misc_feature: GYAE6OF02F392Z.4.57.F02.1.454.CMB.1.raw
  modified_base (175)..(176): a, c, t, g, unknown or other
  misc_feature (175)..(176): n is a, c, g, or t
tcagagcactgtagcacgaccggtgctcgatttagctcgatatagttgggtttggggggaagaggaagactgacggtccccccaggagttcaggtgctgggcacagcggccctgggctgcctggtcaaggactacttccctacagtgctctgagcgggctggcaaggcgcatagnn

SEQ ID NO: 286051 - DNA, 749 bp, Homo sapiens
  misc_feature: GYAE6OF02I5F67.4.57.F02.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (250)..(250): a, c, t, g, unknown or other
  misc_feature (250)..(250): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctcactcctcctgtctgcatctgtgganacagngtcatcatctcgtgccggcaagtcagagtgttagtatttaattaattgtatnagttacaaccgaagggaacacccctaagcctacctgtacttactagtgactcgacctaacgttacccgtaagtttaaacgaaacggttcgggtacccctaagtacgtaaacgttacgttacgaggttccggagtacggttaggtaacgttcggtaacgggtaacctaaggttacttttaccactttaccaactaaccgtactacgtaaggttacttaacccgaaacttaaaccgttaggtaaacgtttattttacggtaaccttaaaccttttaccgtaacgttactaaacgtaaaccgttaaggttaccgtttaaccgtaaccccttaaccccggttccgtaacccttacggtttaacccggtttaccgggaaccggggttaaccggtaaccgttaaagggggttacggaaaccgttaacgttaaacccggaaaaccgttaacgggttgtaccgggtacttacccgaacgttaaccccgtaacttccgtttaacccgg

SEQ ID NO: 286052 - DNA, 534 bp, Homo sapiens
  misc_feature: GYAE6OF02G71QN.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctggacagatttcactctcaccatcagtacgtctacaacctgaagtattttcgactaaactttactactgtacaacagtacgttacgtactaacccctccgtctacctacgttttcgggacggtacgggaccgtaagggttcggaagtaactcgaaaacgtactaggtaggtcctggaccaccatcttacg

SEQ ID NO: 286053 - DNA, 638 bp, Homo sapiens
  misc_feature: GYAE6OF02GTTOZ.4.57.F02.1.454.CMB.1.raw
  modified_base (270)..(270): a, c, t, g, unknown or other
  misc_feature (270)..(270): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggcaagtcagagtgttagtatttatttaattggtatcagttcaaacagggaacnccctaagctctagatctatgctgcactcctaagtttaacgaaaggttcgggtaccctagtacaagtacttacaggtggacgtaggtaggagttcgtaggggacaggttactttacacccttctaccgacctagtactagttacttacctaacctaaaccgtagtaaagttacttttacgaccttaaactttaacctacttagtaccaaactagtaacgttaaccgaccttaccccgtccgtccttacgttacccgttcgggaccggtaacgggacccgtaaagggtgggaaagtacgttaaaccggaaaccgttaacgtacggttacggtccgttaccggaccgtaacccgttacgttaccgttaccg

SEQ ID NO: 286054 - DNA, 641 bp, Homo sapiens
  misc_feature: GYAE6OF02FIJRG.4.57.F02.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (335)..(335): a, c, t, g, unknown or other
  misc_feature (335)..(335): n is a, c, g, or t
tcagagcactgtagcacgaccggtgctcgatttagctcgatataggttgggtttgggggccagtctcagtcaggacacagcatggacatgagggtccccgctcagctcctgggctcctgctactctggctccgagatgccagatgtgacacccagatgacccagtctccatcctccctgtctgcatcgtgtggganacagagtcatcatctcttgccggnaagtcagagtgttagtatttatttaaattggtattcagttcaaaccagggaaacgcccctaagcctcctgatctatgctgcatcctagtttacaaaggtcgggtcccatcaagtnttcgagtggcaggtgatcgtgggacagtactttcacctctacaccatcgagtacgtctaccgaaacctggaaagttattttacgacctaaacgtttacctaacgttcgtactaacgtagtaacggtttaccgtaacttaacccccgttccgtaccttaccgttaaccgttttcccggggaccggggttaaccggggtacccgaacggggttacgggtaaaccggtaaggttaacccgtaaaaacgggtaacgtttacgggtacgggtcccgttacgggaccctaacccgtacttaccgttacccgg

SEQ ID NO: 286055 - DNA, 547 bp, Homo sapiens
  misc_feature: GYAE6OF02GME3W.4.57.F02.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttggccggnaagtcagagtgttagtatttatttaaattggtatcagttcaaaccagggaaancccctaagctcctgatctatgctgcatccagtttacaaagtgggtacccatcaagattcagtggcagtgatcgtgggacagtatttcgactctcacatcagtactctaacaacctgaatattttacgactaactttactactagtacaagtagtaacgttacgactacccctcgaccttctacgtttcggaccggtacgggaccgtaagggtggaagtacgtaacctaaaacggtacggttcgaggtaccgttacgacctaccctagttaccg

SEQ ID NO: 286056 - DNA, 531 bp, Homo sapiens
  misc_feature: GYAE6OF02GQZRY.4.57.F02.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (272)..(272): a, c, t, g, unknown or other
  misc_feature (272)..(272): n is a, c, g, or t
  modified_base (493)..(493): a, c, t, g, unknown or other
  misc_feature (493)..(493): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtatcagttcaaacagggaaacncccctaagctcctgatctatgctgcatcctagtttacaaagtcgggtaccatacaagtattacgagtggacaggtgatcgtagggactaggtatttccactctacacatcagtacgtactaactaacctagaactatttcgactaacttacctactcgtacaacgtagtacgttacgactaccctccgctctacgttcggacggtaggaccgaggtagganactacgaaacgtacgtgtagctagccaactgtcttacg

SEQ ID NO: 286057 - DNA, 570 bp, Homo sapiens
  misc_feature: GYAE6OF02GOAIH.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggacagtcagagtgttagtatttatttaaattggtatcagttacaaaccagggaacgcccctaagctcctgatctatgctgcactcctagtttacaaaggtcggggtacccatcaagtattcagtgcagtggtatcgtaggacagtatttcactctaccactatctagtagtcctaacaacctagaagttattttacgactaacctttactactagtaccaacgtagtacgttaccgtaacctacccccgtccgtacctaccgtaccgtttccgggacgggtacgggaccgtaagggtggtaacgacgtaaccgaaacgtacgtggtacggtaccgtgacctacgtacttccg

SEQ ID NO: 286058 - DNA, 566 bp, Homo sapiens
  misc_feature: GYAE6OF02IJYI1.4.57.F02.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnagtcagagtgttagttatttatttaaattggtatcagttacaaacgagggaaacncccctaagcctcctgactctatgctgctatcctaagtttaacaaaggttcgggtacccaatacaaagtacttacgagtaggcaggttggatcgtagggacagtactttcacttctacactatacagttatacctaacaacctagaattatttcgactaacttactactcgtacaactagtacgttaaccgacttaccccgtcctctaccgttaccgtttcggacggtacggacgtaaggtcggaatactaacgaaacgtaacgtggacggtcgttacgaccacctagttccg

SEQ ID NO: 286059 - DNA, 564 bp, Homo sapiens
  misc_feature: GYAE6OF02FZKOC.4.57.F02.1.454.CMB.1.raw
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (268)..(268): a, c, t, g, unknown or other
  misc_feature (268)..(268): n is a, c, g, or t
  modified_base (418)..(418): a, c, t, g, unknown or other
  misc_feature (418)..(418): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagngtgttagtatttattaattgtatcagttacaacaggaacnccctaagctcctgatctatgctgcatcctagtttacaaggtcgggtaccatacaagtatcgagtggcagtggatcgtggacagtactttcactctacaccatcagtagtacctaactacctagtaacttatttagactaacttactactntacaactagtaagttaccgacttaccctaccgtactcgtaacgttcgggacggtaacgggtacgtaacgggtaggtaagtaaccgtaacgaaaaccgtaacgttacggtacggtaccgtacggacctaaccgtagttccgttaccg

SEQ ID NO: 286060 - DNA, 579 bp, Homo sapiens
  misc_feature: GYAE6OF02FJVKK.4.57.F02.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcgttgccggganaagtcagagtgttagtattttatttaaattggtatctagttcaaaccagggaaancccctaagctcctgatctatgctgcatccagtttaacaaggtcgggtccatacaagattcagtggcagtgatcgtagggacagtattcactctcaccatctagtacgtctaactaacctagtaagttattttagactaacttactactcgttacaactagtacttaacgaccttacccctccgtacctaccgttacgtttccgggaccgggtaccgggaaccgtaaggggtacggagaaccgtaaccgaaaaccggtaacggttcggtacggtacctacgaccctaccgtagtttcccg

SEQ ID NO: 286061 - DNA, 587 bp, Homo sapiens
  misc_feature: GYAE6OF02HASJC.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctcttgccgggcaagtcagagtgttagtatttaatttaaattggtatcagttacaaaccgaggaaacgccctaaagctacctgatactatgctgcactacctaagtttaacaaaggttcgggtaccctaatcaaagtattacgagtggacgagtggatcgtagggacagtatttcaactctccaactatcgagtagtctaacaacctagtaaatattttagactaactttacctatacgtacaaagagtaacgttacgactacccgtcgactacgtaccgtttcgggacggtacgggaccgtaaagggtggtaacgtaacgtaaccgaaaaccggtaacgttcggttacggccttacggaccctaccgtagttaccg

SEQ ID NO: 286062 - DNA, 666 bp, Homo sapiens
  misc_feature: GYAE6OF02HQL5M.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttggccgggcaagtcagtagttgttagttatttaatttaaagttggtattcagttacaaaccgagggaaactccctaagctcctgtatctatgctgctactacctagtttaacgaacggtcgggtacccaagtaccgtaaagtacttcgaaggtcggactaaggtcggtaagttcggtaacgggtactaaggttactttaccgaccttcctaccaacctattacgtaagttacgtacctaaccgtaaaccgtaggtaaacgttattttacgaaccgtttaaacttaacgtacgttactaaccaaagtacgttaacggttaacctaaccttacccccgtctaccgttactaccgggtttccgggaccgggtaacgggtaacaaggggttaacgacgtaaactaaccgaaacgtacgttacgggtacgtccgtaccgtaacctacgtacgttacg

SEQ ID NO: 286063 - DNA, 890 bp, Homo sapiens
  misc_feature: GYAE6OF02ILSTV.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactcgtgcctcgagtatcgaccgagtagtggtacgaacccacccgagtagtacccgacccgtacgttccctacctaccttccccttcccgttcgttcgtcgtactacttcgttgggtagggaacgaacgaagtacgtactactacttacttccgttcgttccgggcccggaacgtaacgtacgaaggtaggtttaggtttaagttttaatttttaaaagttttaaaggttaggttaactacggtttaaccgttaaaacccgaaaaccggggtaaaacggggtaaacccccttaaccccgttaaacgtccccgtttaccgttaaggttaacctttacgttaggttcgtccgtacgtaaccttaccgttaaccgtttaaagttttaaaacggtacgggggttacccggtacctaacgtaacgtaaagttacgttacgagggtacgtacgttaggtagtacttacggggtaacggtaacgtacgttttactttaccctacgtttaccgtaacccaactacgttacgttaacggtttaccttaacccgtaaaccgtaacgttaaggttaaattttcgtttaccgaaactttaaacctttactaacgttacaaacctaacggtacgtttaaccggtaccttacccctaccccgttcgtaccttaccgtttaccgggtaccgggaacggggtaaccgtaacgaggggttacgtaacaaccgttaaaccggtaaacgtaggttaggcctacggtccaccctaagttcctagtttcc

SEQ ID NO: 286064 - DNA, 627 bp, Homo sapiens
  misc_feature: GYAE6OF02HE00H.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccggnaagtcagagtgttagtatttatttaaattgtatcagttcaaacaggaanccctaagctcctgatctatgctgctatcctaagtttacaaaggttcggggtaccctatacaaacgtattacgaaggtggctaggtaggtattacggtgggaactagtatttaccgtactacctcaacctatacgtagtacgttactaacctaaccgtagtaagttattttacgaccttaacttacttacgtactacaacgtaagtacgttaaccgacttacccccgtaccgtccgttaccttaccgtttaccgggaccggtacggggtaacccgtaaggggtacggaaggttaaccgtaacgttaaaccggtaaccgttacggtaccgggtacgttccggacctacccgtattacccgg

SEQ ID NO: 286065 - DNA, 546 bp, Homo sapiens
  misc_feature: GYAE6OF02IW3O7.4.57.F02.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
tcagagcactgtagcacgaccggtgctcgatttagctcgatatagttgggtttgggagccagttctcagtcaggtacacagcatggacatgagggtccccgctcagctccgtggggctcctgctactctggcctccgagatgccagatgtgacacccagatgacccagtctccattcctccctgtcctgcatctgtgganacngagtcatcatctcttagccggnaagtcagagtgttagtatttaattaaattggtatnagttcaaacctaggaaagccctaagctcctgatctatgctgcatcagttacaaagtgggtccatcaaagtattcagtgcagtgatcgtaggacagtatttcactcgtcacatcagtatctacaacctgaagtattttacgactaaactttactactcgtacaaacgtagacgttaacgacttaccctccgtctactacgttcggacgacggaaccgacgggtaacgacgtaactaccgtaaacggtaactcggtacggtccgttacggaccgtacctacgttaccg

SEQ ID NO: 286066 - DNA, 570 bp, Homo sapiens
  misc_feature: GYAE6OF02F4KH7.4.57.F02.1.454.CMB.1.raw
  modified_base (196)..(196): a, c, t, g, unknown or other
  misc_feature (196)..(196): n is a, c, g, or t
  modified_base (280)..(280): a, c, t, g, unknown or other
  misc_feature (280)..(280): n is a, c, g, or t
  modified_base (376)..(376): a, c, t, g, unknown or other
  misc_feature (376)..(376): n is a, c, g, or t
  modified_base (565)..(565): a, c, t, g, unknown or other
  misc_feature (565)..(565): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttggccgggacaagtcagagtgttagttatttaatttaaattggtatcagttcaaaccgagggaaacnccctaagctcctgactctatgctgctactcctaagttttaacgaaaggttcggggtacccatacaagtattcaggtggcaggtggatcgtaggganagtattcactctacacatctagtactactactacctagtaagttatttagacttaacctttactactagtacaacgagttacgttaaccgaccttaccccgtcaccttccgtaacgtttcgggacgggtacggaccgtaagggtcggagtaactacgaaacgtacgtcggtaggacctggaccctacgnttccg

SEQ ID NO: 286067 - DNA, 509 bp, Homo sapiens
  misc_feature: GYAE6OF02FXLUU.4.57.F02.1.454.CMB.1.raw
  modified_base (435)..(435): a, c, t, g, unknown or other
  misc_feature (435)..(435): n is a, c, g, or t
tcagagcactgtagcacgaccggtgctcgatttagctcgatatagttgggtttggggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaagtgggtccatcaagatcagtggcagtggatctgggacagatttcactctcacatcagtatcctacaacctgaagtatttagactaacttacctatcgtacaacagacttacgactacccctcncctactacgttcggcggacggacgaaggtcggaacgactacaaacggtactcggtgcgtacgcaccatcttacg

SEQ ID NO: 286068 - DNA, 171 bp, Homo sapiens
  misc_feature: GYAE6OF02H97TM.4.57.F02.1.454.CMB.1.raw
tcagagcactgtagcacgaccggtgctcgatttagctcgatatagttgggtttgggggaagaggaagactgacggtccccccaggagttcaggtgctgggcacagcggccctgggctgcctggtcaaggactacttccctagtgctctgagcgggctggcaaggcgcatag

SEQ ID NO: 286069 - DNA, 689 bp, Homo sapiens
  misc_feature: GYAE6OF02GSAX0.4.57.F02.1.454.CMB.1.raw
  modified_base (303)..(303): a, c, t, g, unknown or other
  misc_feature (303)..(303): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcaccatcacttgccgggccagtcgagggcattttcagttatttagcctggtatcagacaaaaaccagggaaagcccctaagctacctgactctagtggtnacactcctaactttagacgaaaaggttcggggtaccctaatacgaaagggtttcaacggtcgggacaaaggttgggaacgttcgtagggggtaactaaggtaacttttaccgaacttcctacctaaccagttaccaagcctaagaccctaacgacgacccgttaggaaacgtttgttttaacgaccttaaccttttaatttaaccgttcgtaactaaacgtagttaacctttaaagtaaacgtttaccgacctaccgttaaccgttaccgttttaccgggaccgggttaacggggaaccggtaaacggggttacgggtaaaggaaccttaaccgtaaaacgggtaaactttacgggtacggtaccgtcggtaccctaaccgttacg

SEQ ID NO: 286070 - DNA, 744 bp, Homo sapiens
  misc_feature: GYAE6OF02HIS6R.4.57.F02.1.454.CMB.1.raw
  modified_base (201)..(201): a, c, t, g, unknown or other
  misc_feature (201)..(201): n is a, c, g, or t
tcagagcactgtagcacgaccggtgctcgatttagctcgatatagttgggtttgggggccgagtctcagtcaggacacagcatggacatgagggtccccgctcagctcctggggctcctgctactctggctccgagatgccagatgtgacacccagatcgacccagtcctccatccctccctgtctgcatcgtggtggganacagagtcatcatcttcgtcgccgggcaagtcagtagtgttagttatttattttaaagttggttatctacgttacgaaaccgaagggaacgaccccgtaacgtcgtcctagtacttactagtcgctcgacagttaccgtaagtttaacgtaaaggttacgggtcctaacgttaccaaaggtactttacgaggttcggacgtaggtaggtacttcgtacggggtacaacggttacttttccgtaccttaccgtaccctaacctacttacgtaacggttaccgtaccttaaccgtaaccgttaacgtaacgtttacgttttaacgtaccttaaaccgtttaaaccgtacttacgtaaccgtaactaacggttaccgttaacccgtaacccttaccccgttaccgttaccctaccggttaccgttttaccgggacgggtaaccgggtaacccggtaagggtaccgggtaacgtaacggttaccgtaaacccggtaaccggtacgtacgggtccgtacgtaccggtaaccctagttccggtttaccg

SEQ ID NO: 286071 - DNA, 662 bp, Homo sapiens
  misc_feature: GYAE6OF02IPZ6W.4.57.F02.1.454.CMB.1.raw
  modified_base (484)..(484): a, c, t, g, unknown or other
  misc_feature (484)..(484): n is a, c, g, or t
tcagagcactgtagcacgaccggtgctcgatttagctcgatatagttggggtttggggagccagtctcagtcaggacacagcatggacatgacgggtccccgctcagctcctggggctcctgctactctggctccgagatgccagatgtgacacccagatcgacccagtctccatccctcctgtctgcatctggtgggagacaggagtcatcatcctcgtcggccgggacaagtcgagagttgttagttatttaatttaaattggtatcgtagttacaaaccgaaggaaccgacccgtaagcctccgtagtatcttacgtgtacgtgactacttaccgttaaagtttaaccgaagggttccgggtaccacgtaacaagtacttacgaggtacggcgtaaggtggacttcggtagggtaactagttactttaccacttcctacacctataccgtagttacgtactaactaaccgtagtaacgttntttacaacttaacttactacgtactactaactaagttacctaacgtaacccttacccgtccgtactaccgttacggttaccgggacgggaccgggtaaccggaaggggttacggaacgtaacgtaaacccgtaaacggtacgtcgggttacggccgttaccgaacctacgtagtaccg

SEQ ID NO: 286072 - DNA, 664 bp, Homo sapiens
  misc_feature: GYAE6OF02FL2SJ.4.57.F02.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatccctccctgtctgcatctgtggganacagagtcatcatctcgtggccggcaagtcagagtgttagtatttaatttaattggtatcagttcaaacgagggaacnccctaagcctctgactctatgctgactactcctaagtttaacgaaggttcgggtacccagtacaagtattacgaggtcgggactaggtggtaacttcggtagggtactacggtttactttaccgtacttccgtaccgaacctaattaccgtaaaggttactacccgttaaacctaacccgtaaggtaacgttacgtttttacgaaccgtttaaaccttacctttaaccgtacgttaactaaacgtaaggtaccgtttaaccgtaacccgttaccccttaccggtaccttaccgtaccgtttaccggggacgtacgggtacccgtaagggtacgggactaacgtaccgaaaacgtacgtacggtacggcctacgaccgtacctattccg

SEQ ID NO: 286073 - DNA, 701 bp, Homo sapiens
  misc_feature: GYAE6OF02H0IYK.4.57.F02.1.454.CMB.1.raw
  modified_base (253)..(253): a, c, t, g, unknown or other
  misc_feature (253)..(253): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctctgccggcaagtcagagtgttagtatttatttaaattggtanctagtcaaacaggaaacgaccctaagctcctgatctatgctgctatccagttttaacgaaaggttcggggtaccatacaagtacttcgaagtggtacagtaggatcgtagggaactagtatttacgacttacgtaccaactacgtactaaggttacgttaccttaaacaaaacccttggtaaaactttaacgttttacgtaactaaaaccttttaacctaacgttacgttaaccaaagttaaccgttaactttaaaagttaaaccttttaacccgggccgttaaccgtttaccttaaaccggtttttcccggggaaccgggggtaaacggggtaaccccgtaaagggggtttacgggaaacggtaacggttaaccgaaaaaaccggttaaccggttagggttaccggtaccggtacggtaacccaaacccgttgttaccctttaccgg

SEQ ID NO: 286074 - DNA, 555 bp, Homo sapiens
  misc_feature: GYAE6OF02H6HHH.4.57.F02.1.454.CMB.1.raw
  modified_base (195)..(195): a, c, t, g, unknown or other
  misc_feature (195)..(195): n is a, c, g, or t
  modified_base (291)..(291): a, c, t, g, unknown or other
  misc_feature (291)..(291): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcttgccggcaagtcagtagtgttagtatttattaaattggtatcagttcaaacgaggaaagccctaagctcctgatctatnctgcatcagttaacaagtgggtaccatacaagtattcagtggctagtgatcgtggacagtatttcgactcncaccatcagttagtctacaacctgtaaacgttntttacgactaaacgttacttactagtactaaacgtaagtaacgttacgaaccttacccctaccgtacttaccgtaacgttccggacggtacggtaccgtaaggtcggagtactacgaaaccgtaactggtacgaccgtcgtacctaccgtactcgttacg

SEQ ID NO: 286075 - DNA, 568 bp, Homo sapiens
  misc_feature: GYAE6OF02FWJD9.4.57.F02.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (410)..(410): a, c, t, g, unknown or other
  misc_feature (410)..(410): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggaagacagagtcatcatctcttgccgggnaagtcagagtgttagtatttatttaaattggtatcagttcgaacagggaaacncccctaagctcctgatctatgctgcatcctagtttacaaaggtcgggtcccatacaagtattcagtggactaggtgatcgtgggactagtatttcactctacacctatcgtaagtctactacaacctagtaacttntttgactaacttactactgtactaactagtacttaccgacttaccccgtacgtccttacgtacgttaccgggacggtacgggaaccgtaaggggtcggaacgtaacgtaaccgaaaccgtaacgttcggtacggtacctagacccgaccgtattccgg

SEQ ID NO: 286076 - DNA, 605 bp, Homo sapiens
  misc_feature: GYAE6OF02GSW3M.4.57.F02.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (434)..(434): a, c, t, g, unknown or other
  misc_feature (434)..(434): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcttggccgganaagtcagtgtgttagtatttatttaattggtatcagttcaaaccagggaaacncccctaagctcctgatctatgctgcatccagtttaacaaaggtcggggtaccatacaagtattcgagtggcagtggatcgtaggacaggtatttcgactctacaccatcagtacgtctaacgaacctagaagtattttacgactaacgtttacacgttntaacaactaggtaacgtttaaccgacttacccccgtcgtccttaccgtaccgtttaccgggacgggtaaccgggaccgtaacgggttacggaacggtaaccgtaaccggtaaaacgtaaccgttacggtacggtaccgtacggacccgtaacccgtagtaccgtttaccgg

SEQ ID NO: 286077 - DNA, 671 bp, Homo sapiens
  misc_feature: GYAE6OF02JUIVL.4.57.F02.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (290)..(290): a, c, t, g, unknown or other
  misc_feature (290)..(290): n is a, c, g, or t
  modified_base (323)..(323): a, c, t, g, unknown or other
  misc_feature (323)..(323): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtagaccaccagatcgaccctagtctccatccctcctgtctgacatctggtggganacagagtcatcatctcgtcggccgganaagtcagtagttgttagttaatttacttaagttggtactcgtaagttaccaaacgagggaaccncccctaagcctaccgtagactctagtcgcgtcnctaacttctaagttacgaagggtcggtcctaatacgaagtactttcgaggtcgtacgtggtagacgttcggaacggaactaggtttacttaccgaccttactacctaaccgttataaccgtaggttaacctactaacgtaacttaggtaactttcgttacaccttaacgttactacgtctaaaccgaagttcgtaaccttaaccctaccgtaccccgtcgttaccgttaccgtaccgggtttaccggaacggggaacgtaccggtaagggttacgaacggttaactaaccggtaaaaccgttcgttacggtacgtaccgtagtacccgtaacttacggtcctttaacg

SEQ ID NO: 286078 - DNA, 570 bp, Homo sapiens
  misc_feature: GYAE6OF02JB920.4.57.F02.1.454.CMB.1.raw
  modified_base (222)..(222): a, c, t, g, unknown or other
  misc_feature (222)..(222): n is a, c, g, or t
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgganaagtcagagtgttaagttatttatttaaattggtatctagttacaaacgagggaaacnccctaagctcctagactctatgctgcatctagtttacaaggtcgggtaccatcaagtnttacagtggctaggtgatcgtaggactagtattcactctaccactatcgtagtacgtactaactaaccgtagtaagttatttacgacttaacttactactgtacctaaatagtaacgtaaccgtaacctaccccgtctacctaccgtacgttccgggacggtacggaaccgtaagggtcggtaacgactaacgaaacgtatcggtacggtctaccggacctaccgtattccg

SEQ ID NO: 286079 - DNA, 597 bp, Homo sapiens
  misc_feature: GYAE6OF02GE5B6.4.57.F02.1.454.CMB.1.raw
  modified_base (195)..(195): a, c, t, g, unknown or other
  misc_feature (195)..(195): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaaattggtatcagttcaaaccagggaaagccctaagctcctgatctatgctgcatcctagtttacaaagtcggggtacccatacaagattcagtggcagtgatcgtggacagtatttcactctacaccatcagtacgtactacaacctgaatatttagactaacttactactcgtacaactagtaacgttaccgaacttaccccgtccgtaccttccgtaaccgttttccgggaccggggtaacgggaacccgttaaggggtacgggtaaggtaaccgttaaccgtaaaaccgtaaacggttcggttagggtacccttaacggccctaaacccgttaccgttatttaacccggg

SEQ ID NO: 286080 - DNA, 534 bp, Homo sapiens
  misc_feature: GYAE6OF02I4646.4.57.F02.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccgggcaagtcagagtgttagtatttatttaaattggtatcagttcaaacaggaaagccctaagctctgatctatnctgcatcagttacaaagtgggacccatcaagattcagtgctagtgatcgtggacagtatttcactctacacatcagtatctacaacctgtaagtatttagactaaacgttactacgtattacaaacgagtaagtacacgttaccccctccgtactctaaccgttcggaccggacggaccgtaaagggcggtaaagacctaacgaaaacgtaagttcgtagggcttcgaccaccgtataccg

SEQ ID NO: 286081 - DNA, 525 bp, Homo sapiens
  misc_feature: GYAE6OF02H3S1O.4.57.F02.1.454.CMB.1.raw
  modified_base (268)..(268): a, c, t, g, unknown or other
  misc_feature (268)..(268): n is a, c, g, or t
  modified_base (327)..(327): a, c, t, g, unknown or other
  misc_feature (327)..(327): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctcttgccggcaagtcagagtgttagtatttattaaatgtatctagtcaaacaggaacnccctaagctcctgatctatgctgcatccagtttacaaagtcgggtccatacaagtattnagtggcagtggatcgtaggactagtatttcactctacacctatcgagtagtactaacacctgtaaagtatttagactaacttactactntacaactagtacttacgacctacccgtccnctctacgttacggacggtaggacctagggtgaagtacgtacaaacgtacgtggtacgctacgtaccaacgtactcttcg

SEQ ID NO: 286082 - DNA, 646 bp, Homo sapiens
  misc_feature: GYAE6OF02IXK56.4.57.F02.1.454.CMB.1.raw
  modified_base (195)..(195): a, c, t, g, unknown or other
  misc_feature (195)..(195): n is a, c, g, or t
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (640)..(640): a, c, t, g, unknown or other
  misc_feature (640)..(640): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctctgccgggacaagtcagagtgttagtattatttaatgtatcattcaacaggaanccctaagctcngtatctatgctgctataccgtagtttaacgaaaggttcgggtacccatacgaaagttactcgaggtggacaggttagactcgtacgggactacggtattttccgacttacgtacctaacctacgtataacggttacgtacctaactaacgtagttaaagttacttttacggaccttaaacttaacctttacgtacgttaaccctaaagtaacggtttaacgttaacccgtaaccgttaaccccccttcgtaaccttaccttaaccgggtttcggggaacccggtacggggtaacccgtaagggttacggtagtaaccgtaaccgtaaaaccggtctacgggtaggccctaggtaccaaccggttnttaccg

SEQ ID NO: 286083 - DNA, 548 bp, Homo sapiens
  misc_feature: GYAE6OF02GF5WX.4.57.F02.1.454.CMB.1.raw
  modified_base (197)..(197): a, c, t, g, unknown or other
  misc_feature (197)..(197): n is a, c, g, or t
  modified_base (275)..(275): a, c, t, g, unknown or other
  misc_feature (275)..(275): n is a, c, g, or t
  modified_base (392)..(392): a, c, t, g, unknown or other
  misc_feature (392)..(392): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccgggcaagtcagagtgttagttatttaatttaaattgtatcagttacaacagggaacnccctaagcctcctgtatctatgctgcatcctagttaacgaaggtcgggtaccctagtacaagtattacaggtcgcgagtggatgtagggactagtacttcactctacacatctagtntactacacctagtaagttatttacgactaacttactacttagtacaactagtacgttaacgacctaccctcgtcctactccgttcggacggtaggaccgagggtagacgtacgtaacgaacgtaacgtggtacggaccttcgacctactacttacg

SEQ ID NO: 286084 - DNA, 727 bp, Homo sapiens
  misc_feature: GYAE6OF02GHC1T.4.57.F02.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtcgaccacccagatcgacccagtcctccatccctcctgtctgcatctggtggganacagagtcatcatctctcgccggtacaagtcagagtgttagtatttacttaaagtggtactctagttaccaaaaccgagggaaacnccccgtaagcctacctagtactaccttagtcgctgactacttccgaagttttaacgaaaggttcgggtaccctagttaccaaacgtattaccgagggttacgaccgtaggtacggtaacgttccggtagggactaacggtactttccgaacctttcgacctaacctaacgtaccgtaacgttacgttaaccgtaaaccctaacccgttaggtaaacgtttacgttttacggaaccttaaacctttaacgtaccgttacgtaaacctaaacgtaacggttaacgtttaaacccggtaccttaaacccccgtcccgtacttacccgtaacgtttacccggggaacgggtacgggtaacccgtaaggggttcggaacggtaacgtaacccgtaaaaccgtacgttacgggtacgtccgttacggacctaaccgttcgttaccg

SEQ ID NO: 286085 - DNA, 559 bp, Homo sapiens
  misc_feature: GYAE6OF02IVX2G.4.57.F02.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccggganaagtcagagtgttagtatttattaaattgtatcagttacaaacgaggaacnccctaagcctcctagactctatgctgctactactagtttaacgaaaggttcgggtaccatacaagtacttcagtacggcagtgatcgaggacagtactttcactctacacatcagtacgtactaacaacctagaacttatttacgactaacttactactgtacaacgtagtaacgttacgaccttacccctacgtaccttcgtaaccgtttcggacgggtacggaccgtaagggtcggagtacgtaaccaaacggtacgtaggtcggactcgacctactactacg

SEQ ID NO: 286086 - DNA, 624 bp, Homo sapiens
  misc_feature: GYAE6OF02I7HDZ.4.57.F02.1.454.CMB.1.raw
  modified_base (188)..(188): a, c, t, g, unknown or other
  misc_feature (188)..(188): n is a, c, g, or t
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccatcctcctgtctgcntctggtggagacagatcatcatctctcgcggctaagtcagtgtgttatatttaatttaattgtatctagttacaacgaggaacnccctaagcctctgatctatgtcngtaccattcctaagtttaacgaaaggttcgggcctaatacgaaagtacttcaggtgacgtagtggagtcgtagggactagttacttctaccgtctacctacactacgtagttacgttacctaactaacccgtagtaagtttattttacgacttaaacgtttaaccgttaactacgttaaccgtaaacgtacggttaacgttaacccggtaaccctttacccccgtaccgttacccttacgttaccggtttacggggaccggtacgggacgtaacgggtaaggaagaccgttaacgtaacgtacgtggtacgctcggactacgtcttacg

SEQ ID NO: 286087 - DNA, 691 bp, Homo sapiens
  misc_feature: GYAE6OF02JXNCM.4.57.F02.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagagcactgtagcacgaccggtgctcgatttagctcgatatagttgggtttggggagccagtctcagtcaggacacagcatggacatgaggggtccccgctcagctcctggggctcctgctactctggctccgagatgccagatgtgacacccagatcgacccagtctccatccctccctgtctgcatctggtggganacagagtcatcatctcgttcggccggganaagtcagtagtgttagttattttaatttaattggtatctagttacaaaaccgagggaaacgtcccctaagcctactagtatctatcgctgactacttaccgtaagtttaacgaaacgggtcgggtacccataacgtaacgtacttacgaggtacggacgtaggtacggtacgttcggtaggggaacgtacgtttaacgttccgtacttacctacccgtaacctagtaccttaggttacctacgtaacctaacgtagtaagttatttacggtactaaaccgttacttactacggtaactaacgtacgttaacgttacccgtaaccctaccccgttccgtacctttacccgttacgttacccggggagggtaccgggtaaccggttaacggggtggaacgtaacgtaaccgttaaccggtaacggttcggtacggtaccgttacgaccctaccgtaagttcccg

SEQ ID NO: 286088 - DNA, 645 bp, Homo sapiens
  misc_feature: GYAE6OF02JA1QJ.4.57.F02.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
  modified_base (228)..(228): a, c, t, g, unknown or other
  misc_feature (228)..(228): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatccctccctgtctgcattcgtggtggganacagngtcatcatctcgtcgccggganaagcagtagttagttattatttaatttaattggtatctagtacaaacgaaggaacgtaccctaagcctcctagactctatgctgcacttacgtaagtttaacgaaacgggtcgggtacctagtacaagtacttacgaggtggactaggtgtatcggtaggactacgtatttaccgacttcgtaccaactagtacgtaaggttacgttacctaaccgtaacccgttaggtaaacgtttactttaccgaccttaaacctttacttacgttacctaacctaagtaacgtacgtttaaccgacccttacccgtccgttcgtaccttacgggtaccgggacggtaccgggtacgtacgggtcgaacgtacgtaaacccgtaacgtacgtaggtccgtacgtacgtacccgtactacgttccg

SEQ ID NO: 286089 - DNA, 532 bp, Homo sapiens
  misc_feature: GYAE6OF02FZIYS.4.57.F02.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (326)..(326): a, c, t, g, unknown or other
  misc_feature (326)..(326): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaattggtaatcagttcaaaccagggaaacgcccctaagctcctgatctatgctgcatccagttacaagtcggtccatcaagntcagtgcagtgatctgggacagtatttcactctacaccatcagttacgtctaacaactgaaagtacttttnactaactttactacttagtacgaaacngtaactacgtaacttaccccctcgaccttcacgtttccggacggacggaccgaagggtcgaagtactaccgaaacgtacgtgtacggactacgccacgtactcgtacg

SEQ ID NO: 286090 - DNA, 549 bp, Homo sapiens
  misc_feature: GYAE6OF02GFFY6.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagttatttatttaaattggttatctagttacaaacgaggaaacgccctaagcctctgatctatgctgcatcctagtttacaaaggtcgggtacccatactaagtattcaggtggcaggtgatcgtaggactagtattcactctcactatctaagtactactaacctaacctagtaattagtttacgactaaccttactactacgtaacaacagtacgttaacgacttacccctcgtctactacgttcggacggtaggaccgtaaggtggacagtaccaaacgtaacgtggcggtaccacgaccaccttagtaccg

SEQ ID NO: 286091 - DNA, 618 bp, Homo sapiens
  misc_feature: GYAE6OF02IA2I3.4.57.F02.1.454.CMB.1.raw
  modified_base (282)..(282): a, c, t, g, unknown or other
  misc_feature (282)..(282): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttggccggcaagtcagtagtgttagtatttatttaaattggtatcattacaaacaggaagtacccctaanctacctgatctatgctgctactccgagtttaacgaaaggttcggggtaccctatactaagtattacagtggactaggtggattactgggaactaggtaattttcacttcgtccaaccctaattaccaaggttacgttactaacctaaaccgtgtaaagttacgttttacgtactaacttacttacgtcgtaactaacgtagtaacgtttaccgaacttacccccgtccgtacttaccgttacgttccgggtacgggtacggaccgtaaacgggttggaacgtacgtaacgaaaaccgtaacgtggtacggtacgtacgacctactactcgttaccg

SEQ ID NO: 286092 - DNA, 612 bp, Homo sapiens
  misc_feature: GYAE6OF02JSRUW.4.57.F02.1.454.CMB.1.raw
  modified_base (229)..(229): a, c, t, g, unknown or other
  misc_feature (229)..(229): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctcgagatgccagatgtgaccacccagatcgacccagtctccatcctccctgtctgcatctggtgggagacagagtcatcattcctcgttggcccgggtnaagtccgagagttgttagttatttaatttaaagttggttatactagttacaacgaagggaactaccctaagcctctgatctatgctcgcatctaagttacgaagtcgggtccatacaagtctacgagtgacgtgtagcgtgtaggntagtagttcncttacnctaacactacgtactacgtactaactaccgtagtagttacgtttatacgtaaacctttacgtactacgttaacaaagtaacggtaagttacccgtaccttaacccctgttaccgtaaccctacgggttaaccgggaccggtaccggtaacgtgggtacggtaagtaacgttaaccggaaacttacgtgggttacgtccgacgtaccgtacctcgttaccgg

SEQ ID NO: 286093 - DNA, 571 bp, Homo sapiens
  misc_feature: GYAE6OF02H8LNQ.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcttgccgggnaagtcagtagtgttagttatttatttaaattggtatcagttcaaaccagggaaagacccctaagcctcctgatctatgctgctatccaagtttaacaaaggttcggggtaccctatacaagtatttcaggtggactagtggatcgtagggactagtatttccacttctctacttgtcagtctagtctgactaatttagaagtttattttacgaccttaacttactaacttgttacaacgtagttagtttacagtttacttcccgttaggtacctttcggaccgtaacgggtaaccgtaaggtaggtaaactacgaaacgtaacgtggtacgacgtcgacactatcttacg

SEQ ID NO: 286094 - DNA, 655 bp, Homo sapiens
  misc_feature: GYAE6OF02IH0HH.4.57.F02.1.454.CMB.1.raw
  modified_base (196)..(196): a, c, t, g, unknown or other
  misc_feature (196)..(196): n is a, c, g, or t
  modified_base (283)..(283): a, c, t, g, unknown or other
  misc_feature (283)..(283): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccaccagatgacccagtctccatccctccctgtctgcatctgtggganacagagtcatcatctcttggccggacaagtcagtagtgttagttattttatttaaattggtatctagttacaaaccgtagggaaacncccctaagctccgtgattctatcgctgactacttacctagtttaacgaaacggtcggggtaccatacaagtacttcgagtgacgtagtggtatcgtagggacagtactttcgactccttacacctagttaccaagttacgttaccttaaccgaaaccgttaggtaaaacttacgttttacgaaccttaaacctttaaccgttacgtacgtaacaacgtaagtacgtttaccgaaccctttacccccgtccgtccttaccgttacccgttacggggaccggtaacgggtaaccgtaacgggttacggaacgtaacgtaaccggaaaacgtaccgtagggttcgacgttaccgacctaaccgtcgtcttaccgg

SEQ ID NO: 286095 - DNA, 638 bp, Homo sapiens
  misc_feature: GYAE6OF02IGY9B.4.57.F02.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (304)..(304): a, c, t, g, unknown or other
  misc_feature (304)..(304): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcgtgccggganagtcagagttgttagttatttatttaaattggtatntagttacaaacgaggaacncccctaagcctcctagactctatgtcngactactacctaagtttaactaaaggtcgggtaccatacaagtattcgagtggataggtggtatacgtgggactagtatttcactactaccactatacgtaagtatacctaacctaaccgtagtaagttagttttacgacttaacctttactacttacgtaacaacgtagttaacgtacctaacccttaccccgtaccgtaccttaccgtaccggtttaccgggacgggtaacgggtaccggtaacgggtagggaaacgtaccgtaaaccggtaaaaccggtacgtttacgggtacggtaccgttacggaccctaacgtaccgttcttaaccgg

SEQ ID NO: 286096 - DNA, 642 bp, Homo sapiens
  misc_feature: GYAE6OF02G0L57.4.57.F02.1.454.CMB.1.raw
  modified_base (222)..(222): a, c, t, g, unknown or other
  misc_feature (222)..(222): n is a, c, g, or t
tcagagcactgtagcacgaccggtgctcgatttagctcgatatagttggggtttggggagccagtctcagtcaggacacagcatggacatgagggtccccgctcagctcctggggctcctgctactctggctccgagatgccagatgtgacacccagatgacccagtctccatcctcctgtctgcatctggtgggagacagagtcatcatctcttgccgggnaagtcagagtgttagtatttatttaaattggtatcagttacaaacgaggaaacgccctaagctcctgactctatcgctgacactcctaagtttaacgaaaggttcgggtaccctagtaccgaaagtattacgaaggttggaccgtaggtggtacttcgtaggggacaaggtttactttcgactctacaaccatacgaagttacgtacttaaccgaacctagaaagttacttttacgaacttaacctttaactacttacgtaaccaaacgtaacgttacgttaccgtaccgttaccccgtccgttacctacccgtacggtttccgggacgggtacgggaccgtaaggggtacgaacgtaacgtaacccgtaaaacggtacgttacggtacggtccgacgtacccgtaacgtacgtttaccg

SEQ ID NO: 286097 - DNA, 583 bp, Homo sapiens
  misc_feature: GYAE6OF02IPIGM.4.57.F02.1.454.CMB.1.raw
  modified_base (196)..(196): a, c, t, g, unknown or other
  misc_feature (196)..(196): n is a, c, g, or t
  modified_base (453)..(453): a, c, t, g, unknown or other
  misc_feature (453)..(453): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctcgcgggcaagtcagagtgttagtattatttaaattgtatcagttacaaaccagggaaacgccccttaagctcctgatctatgctgcatcctagtttacgaaagtcgggtcctaatcaaagtattcgagtggctagtggacgtctagggactagtattccgacttctaccacactactagtagtacctaacgtaaacctagaagttactttgtacctaactttactacttagaccgtaaanagttaacgttaccgtaacttacccctaccggtctacctaaccgtttcggaccgggtagaccgtaagggtaggtaactacgtaactaaaccgtaacgttcgtacggtccttacggactaccctgttacccg

SEQ ID NO: 286098 - DNA, 640 bp, Homo sapiens
  misc_feature: GYAE6OF02JC4HX.4.57.F02.1.454.CMB.1.raw
  modified_base (325)..(325): a, c, t, g, unknown or other
  misc_feature (325)..(325): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggcctccgagatgccagtatgtgaccacccagatcgacccagtctccatccctccctgtctgacactcgtggtgggacacagagtcatcattcctcgtcggaccggctaagtccagtagtagttagttaatttaagtttaattgtactacgtagttacgaaaccgaggaactaccctagctcctagatatagtctacncgctactacgttacttaacgtaacggtcggtacccagtacaagtactcgacggtgactaggtgtacgtacgtacggtacctagtcttacgtacctacctaccactactcgtaacgttcgtaactaaccgtaacgtaacgttatttaacgttcctaacttaactttacgtacgtaaccgtaactaacgttaccggtaaccgttaacccgtacccttaaccctccgtacttacccggttgaacccgggtaagacccgggtaagtaggaagtacgaacgtacgaaccgtagtcgcgtcgtaccacgttaccacgttcg

SEQ ID NO: 286099 - DNA, 552 bp, Homo sapiens
  misc_feature: GYAE6OF02GSTGN.4.57.F02.1.454.CMB.1.raw
  modified_base (271)..(271): a, c, t, g, unknown or other
  misc_feature (271)..(271): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaacnccctaagctcctgatctatgctgcatccagtttacaaagtgggtccatcaagtattcagtggcagtggatcgtgggactagtacttttcgactctaccactatcagttacgtactaacgaacctgaagttatttagacttaacttactactgtacaacgtagtagttacacttacccctccgtccttactaccgtttcgggaccggtagggaccgtaagggtacggaagtaacgtacgaaaacgtacttaggcggtactacggaccaaccgtatcgttacg

SEQ ID NO: 286100 - DNA, 718 bp, Homo sapiens
  misc_feature: GYAE6OF02HYHVZ.4.57.F02.1.454.CMB.1.raw
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (588)..(588): a, c, t, g, unknown or other
  misc_feature (588)..(588): n is a, c, g, or t
  modified_base (712)..(712): a, c, t, g, unknown or other
  misc_feature (712)..(712): n is a, c, g, or t
tcagagcactgtagcacgaccggtgctcgatttagctcgatatagttgggtttgggagccagtctcagtcaggacacagcatggacatgacgggtcccccgctcagctccgtggggctcctgctactctggctccgagatgccagatgtcgaccaccagatcgacccagtcctccactcccgtccctgtcctgctatcgtggtcggganacaggactacatacattcctcgttcggcccggtanaacgtcgaagtgttagttagtttaactttatttaacgttgtatcgtaagttaaccgaaaccggtagggaaaccctacccgtaacgtcccttaccgtagaaccttcgttacgtgtccgtcgacttaaccgttaaccggttaacggtttaaacggaacgggttacccgggtttaccaaacgtttaccggtaaagttaccgttaggtaacgggtcggtaacggttaggtacggttacgttacggggtaacggtaacgttacgtttacttccgtaacctcctaactacgtacgtacgtagttaccgtaactacgtaaccgtagtaattcgttactaacttaaccttanctagtaacgaacgtagttaaccgtcaacccttaccgtccgtactcgtacgggtacgacggacggtaaccgtggtaacgacgtaactaacgtaacgtacgttcgacggtcctacggctaaccgtnttaccg

SEQ ID NO: 286101 - DNA, 674 bp, Homo sapiens
  misc_feature: GYAE6OF02H7VFV.4.57.F02.1.454.CMB.1.raw
  modified_base (192)..(192): a, c, t, g, unknown or other
  misc_feature (192)..(192): n is a, c, g, or t
  modified_base (197)..(197): a, c, t, g, unknown or other
  misc_feature (197)..(197): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctggnggganactagagtcatcatctcgtgccggacaagtcaggtagttgtagttatttaatttaaattggtatctagttacaaacgaggaaacgtccctaagctccgtagactactatcgctgctatcctaacgtttaacgaaacggttcgggaccctaataccgtaaagtacttcgaaggttggacgtaaggtggtactacggtacgggtacaaggttacttttaccacttctaacctaccattacgtaagttaacggtcctaaacgtaaccgtagtaaagttctttacgtaacttaaaccttactaacgttcgaaccgttaacgtaaacggtaacgttacccggtaaacttacccccgttaccgccttaaccgtacgtttacccgggacgggtaaccgggtaacccggtaggtacggaacgtaacgtaaccgaaaaccgttacggtacgttacggacgtacgtacccgaaactgtaccgttacg

SEQ ID NO: 286102 - DNA, 174 bp, Homo sapiens
  misc_feature: GYAE6OF02FXENL.4.57.F02.1.454.CMB.1.raw
tcagagcactgtagcacgaccggtgctcgatttagctcgatatagttgggtttggggggaagaggaagactgacggtccccccaggagttcaggtgctgggcacagcggccctgggctgcctggtcaaggactacttccctacagtgctctgagcgggctggcaaggcgcatag

SEQ ID NO: 286103 - DNA, 682 bp, Homo sapiens
  misc_feature: GYAE6OF02F7MNT.4.57.F02.1.454.CMB.1.raw
  modified_base (197)..(197): a, c, t, g, unknown or other
  misc_feature (197)..(197): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagagcactgtagcacgaccggtgctcgatttagctcgatatagttgggtttgggggccagtctcagtcaggacacagcatggacatgagggtccccgctcagctcctgggctcctgctactctggctccgagatgccagatgtgacacccagatgacccagtctccatccctccctgtctgcatcgtgtaggganacagagtcatcatctcttggccggcaagtcagtagtgttagtatttatttaaattggtatntagttacaaccgagggaacncccgtaagtctcctgatctatgctgactatcctagttaacaaggtcgggtacccagtactaagtacgttacgaggtaggcgtaaggttggacttcgtacggggactaaggttacttttacgaccttactaaccgtaccctaagtaccgtaagttacgtaaccttaaccgaaaccttagtaagttacgttttagacctttaaccgtttaacttacgtacgtaccaacgtaacggtaagtttaacccgtaacccttaccccgttcccgactttacccctacggtttaccgggaacccggggttacgggaaccgtaacgggtaacggtaacggtaaccgtaaacccgtaaacggtaaccgttcggtacggtacgtaccggaaccctaacccgtagttccgttaaccg

SEQ ID NO: 286104 - DNA, 551 bp, Homo sapiens
  misc_feature: GYAE6OF02FHD2K.4.57.F02.1.454.CMB.1.raw
  modified_base (273)..(273): a, c, t, g, unknown or other
  misc_feature (273)..(273): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacagggaaancccctaagctcctgatctatgctgcatccagtttacaaagtggggtacccatcaagattcagtggacagtggatcgtgggacagtattcactctcacatcagtatctacaacctgaagtatttgactaacttactacttagtactaacgagtacgttaacgaccttaccccgttccgtaccttacctaccgtttccgggaccggtacgggacccgaagggtcggaagtactaaccgaaacggtaactggtacggtcctaggacccgtactacttaccg

SEQ ID NO: 286105 - DNA, 612 bp, Homo sapiens
  misc_feature: GYAE6OF02I50HC.4.57.F02.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggnaagtcagagtgttatatttattaagttggtatcagttacaaaccgagggaacgcccctaagctcctgatctatgactgcatcctagttacgaaaggtcggggtaccatacaagtattcgagtgtgagtggactcgtagggactagtatttcactctacacctatacgtagtacgtaccaacgtaaacctgaaactttatttacgtaccttaaaccgtttactaccttcgtaaccgtaacgtaacggtaacgtttaaccgtaacctaacccccgtccgttaccttaccgttaccggttccgggaccggtaacgggtaccgaaagggttcggaacgtaacgtaaccgtaaacgtacgttcggtcgtccgtacggcctaacgtactccgtttacgg

SEQ ID NO: 286106 - DNA, 600 bp, Homo sapiens
  misc_feature: GYAE6OF02FMXLL.4.57.F02.1.454.CMB.1.raw
  modified_base (196)..(196): a, c, t, g, unknown or other
  misc_feature (196)..(196): n is a, c, g, or t
  modified_base (276)..(276): a, c, t, g, unknown or other
  misc_feature (276)..(276): n is a, c, g, or t
tcagagcactgtagcacgaccggtgctcgatttagctcgatatagttgggtttggggagccagtctcagtcaggaaacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttacaaaccagggaaacnccctaagcctcctgatctatgctgcatctagtttaacgaagtcgggtaccatacaagtattacagtggcagtgatcgtagggacagtacttcactctacactatacagttagtactaactaacctaggaaattacttttacgaccttaaacgtttacctacttacgtaaccaacgtacgtaagtttaaccaccttaccccgtcgtaccgttaccttaccggtttacgaccgggtaacgggtaccgtaaggggtacggtaacgtaacgtaaccggtaaacgtaacggttcggtacggtctacggcctaacctacgtacgttaccg

SEQ ID NO: 286107 - DNA, 592 bp, Homo sapiens
  misc_feature: GYAE6OF02GMM29.4.57.F02.1.454.CMB.1.raw
  modified_base (196)..(196): a, c, t, g, unknown or other
  misc_feature (196)..(196): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacaggaagccctaagctctgatctatgctgcatccagtttacaagtgggtcccatcaagtattcagtgcagtggatcgtgggacagatttcagttctactaccgatacgtacgttaagtctaactaaacctgtaagttaagttttacgacttaaaccttacgtactacggtacaacgtacgtaacggtttaaccgacttaaccccctcggtaccttacctaaccgtttccgggaccgggtaacggtaaccgtaaggggtaccggtaaggtaactacgaaaaaccggtaccgtaggttaccggaccgttaaccgtctacccgtattccgg

SEQ ID NO: 286108 - DNA, 587 bp, Homo sapiens
  misc_feature: GYAE6OF02GVR9V.4.57.F02.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctctgccggnagtcagagtgttagtatttatttaattggtatctagttcaaaccgagggaaacgacccctaagcctcctagtactctatcgctgcatcctagtttaacgaaaggttcgggtaccctagtacgaagtacttacgaggtggcgaggtggagtcgtagggacagtactttcgacttctaccactactctaagttacgtactaacacgtagtaagttatttcgacttaacttactatagtacactagtaacttacgaccttacccgtctacctaccgttaccgttacgggacggtaacggaccgtagggtacggaacgtactaacggtaaacgtaacgtggtacggaccgtacgacctacgtacgtcgtacg

SEQ ID NO: 286109 - DNA, 661 bp, Homo sapiens
  misc_feature: GYAE6OF02H9Q40.4.57.F02.1.454.CMB.1.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (540)..(540): a, c, t, g, unknown or other
  misc_feature (540)..(540): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatcctcctgtctgcatctgtgganacagagtcatcatctcgttgccggganaagtcgaggtctattttcagtttattagccttaggtatcgaacgacaaaaaccgacggaaacgcccctaagcctccgtagacttccgtaagtggtacgactactcctaacgtttgacgtaaacgggtcggttaacccagttacgtaaaggtcgaggtacggacgtaaggttggaactcggtacgggaacgtagttacgtttcgacctactacccgaccgtaatccgaacgtctaccgtacctagacgtccgtaagtaacgtttacgttacgtaactaactttaacttacgtacgtaacacgtaaacgttactttaaanaaccgtttacggcgttaccttacgttacgttacccggggaggtaaccgggtacgtaaacgggttggaaccttaaagtaaccgaaacgtacggttcggtaccggtatacccgacgtaacccg

SEQ ID NO: 286110 - DNA, 535 bp, Homo sapiens
  misc_feature: GYAE6OF02FKMW1.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagccctaagctcctgatctatgctgcatcagtttacaagtcgggtccatacaagattcagtgcagtgatcgtagggacagtatttcgactctcacctatcagtagtacctactaacctgaagttatttacgactaacttactatcgtacaacagtacgttacacttacccctccgactctacgtttcgggacggtacgggaccgtaagggtcggaagtaactacgaaacgtaacgtggtacggacctaggacctaccattaccg

SEQ ID NO: 286111 - DNA, 592 bp, Homo sapiens
  misc_feature: GYAE6OF02INS7O.4.57.F02.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtgganacagagtcatcatctcttgccggnaagtcagagtgttagtatttatttaatgtatnagttcaacaggaacgccctaagctcctgactctatgctgcatcctaagtttacaaggtcgggtacccatacgaagtattcaggttgcgtagtgtactcgtgggactagtattcactcctacacctatctaagttacgtactaacaaccgtagtaaagttacgtttacgacttaaacctttacttaactagtacctaaacgaggttaaccgttacgtaacccgttaccctcccgtacttaccttaaccggtttacgggaccgggtacggtaaccgtaaggggtcggaagtactaaccggaaacgtaacgttcggtacggtaccgtagacctaccgagttaccg

SEQ ID NO: 286112 - DNA, 621 bp, Homo sapiens
  misc_feature: GYAE6OF02HMD8R.4.57.F02.1.454.CMB.1.raw
  modified_base (199)..(199): a, c, t, g, unknown or other
  misc_feature (199)..(199): n is a, c, g, or t
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtcctccatcctccctgtctgctatctgtggganacagagtcatcatctcgttcgccggganaacgtcagtagttgttagttaatttaatttaaattggtatctagttacaaacgaggaaacgtccccgtaaanctcctgatctangctnctactactagttaacgaaaggttcgggtaccatacgaagtattccgaggtgactaggtcgatcgaggtacaagttcttacactcctacaacctatcgtaagttcgtactaacgtaactagtaaacgttatttcgaactaacttactacgtacgtacaacgtacgtacgttaccaaccgttaccccgtcgtaccttacgtaccgtttaccggggacggtaacgggtaccgtaacggggtgaacggtacgtaaacccgtaaaggtaacgttcgggacgtccgtacggaacctaccgtacgttacccgg

SEQ ID NO: 286113 - DNA, 696 bp, Homo sapiens
  misc_feature: GYAE6OF02H4N5Z.4.57.F02.1.454.CMB.1.raw
  modified_base (218)..(218): a, c, t, g, unknown or other
  misc_feature (218)..(218): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctcctgtctgcatctgtggagacagagtcatcatctcttgccggnaagtcagagtgttagtatttaatttaaatttggtatactagttacaaaccgtagggaaacgacccctaagcctcctcgattcttatgtctgcctatcctagttttaacaaacggttcggggtacccataccgtaagtacttacgacggtggacgagtaggtacttacggtcgggtaacgagtacttttaccgacttcctacctaaccgtaactacgtaagttacgtaccgtaacctaaaccgttagtaaagttacttttttacgaaccttaacctttaaccgttacttacgttacctaaagtacggtaacgtttaaccggtaacccttaacccccgttaccgtacccttacgttaacccgtttacggggaccgggtaacgggaacccggtaacgggtacgggtaacgtaacgttaaccgaaaaccgtaaccggttacggtaccgggtacgttacccggacccgtaccgtacgttaccg

SEQ ID NO: 286114 - DNA, 665 bp, Homo sapiens
  misc_feature: GYAE6OF02FV40W.4.57.F02.1.454.CMB.1.raw
  modified_base (288)..(288): a, c, t, g, unknown or other
  misc_feature (288)..(288): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccactccctccctgtctgcatcgtggtgggagacagagtcatcatctcgtcgccgggacaagtcagtagttgttaagttattttaatttaaagttggttatcagttacaaacgaggaacnccctaagcctactgtatctatgtctgctacttacctaacgtttaacgtaaacgggtcgggtaccctagtacgtaacgtacttcgagtggacgtagtaggtacgtcgtagggactagttacttactaccgttcctacgacctataccgtaaggttacttacctaacgtaaccgtagtaaactttcgtttacgaacttaacctttactaccgttagtaacctaaacgtacgttaacgtaccgtaaccgtacccccttcgtacccttacgttaccggttaccggggaccggtacgggtaaccgtaaggggtacggtaactaaccggtaacgaaaccggttaggtcggttaacggtccgacgtacccgtactacgtttacg

SEQ ID NO: 286115 - DNA, 740 bp, Homo sapiens
  misc_feature: GYAE6OF02JFWC6.4.57.F02.1.454.CMB.1.raw
tcagagcactgtagcacgaccggtgctcgatttagctcgatatagttgggtttggggccagtctcagtcaggacacagcatggacatgacgggtcccgctcagctcctggggctcctgctactctggctccgagatgccagatgtgacacccagatgacccagtctccatccctcctgtctgcatcgtcggtgggagacagacgtcatacagttcctcgttacggcccgggactaacgtcgacggtagttgtttaacgttaattttaactttaaagttggtaactacgtaacgttaccaaaaccgtaacgggaaaaccgtccccttaaagccttaccgtagacttctaagtcgcttcggacctaacgttcctaagggttttaaccaaaggggttccgggtacccagtaccgtaaaggtacttacgaggtcggtacgaggtaggtatccgtagggtactaagttacttttaccacgtttaccgtacccaactacgtacgtagttaaccgttcctaaacctaaaccgtgtaaacgttacgtttaacggaccttaaaacgttcctaacgttacggttaaccaaaccgtaggttaaccgttaaccgtacccttaaccccggtacgttccttaccggttacccgtttaacgggaccggttaacggaccgtaaggggtcgtaacttaaccgaaccgtaaaccggtagttaccggtcgtacgtaccgaacgttccacgtttcgtacg

SEQ ID NO: 286116 - DNA, 691 bp, Homo sapiens
  misc_feature: GYAE6OF02JAD3P.4.57.F02.1.454.CMB.1.raw
  modified_base (231)..(231): a, c, t, g, unknown or other
  misc_feature (231)..(231): n is a, c, g, or t
  modified_base (452)..(452): a, c, t, g, unknown or other
  misc_feature (452)..(452): n is a, c, g, or t
tcagagcactgtagcacgaccggtgctcgatttagctcgatatagttgggtttggggccagtctcagtcaggacacagcatgggacatgagggtccccgctcagctcctggggctcctgctacgtctggctccgagatgccagatgtcgacacccagatcgacccagtctccatccctccctgtctgcatctggtagggagacagacgtcatcacttcctctggcccgggnaagtcagtagtgttagtaattttaatttaacgttggtaatcgtaacgttacaaaccgtaaggggaactaccccgtaagtccctacctgtactctagtgactgctatacccgtattaccgaaggtccggtacccatacgaaacgtagttaccgagtaggtacacggttaggagttcggttagggtaactaagttaccttttacacttacctcctaaaccgtnttaaccggtacttaacgttaccgtaaccgtaaccgtagtaacgttacgtttacaactttacgtttaccttagtacctactaaacgtacgttaagttaacccgtaacccgttaccccgttccgtaacccttcccgttaacgttccgggtaacggggtaccggtaaccggtaacggtacggacggtaacctaacgtaaacgtacgttacggtacgtcgttaccgaccaccgttatcgtacc

SEQ ID NO: 286117 - DNA, 573 bp, Homo sapiens
  misc_feature: GYAE6OF02GI91A.4.57.F02.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
  modified_base (437)..(437): a, c, t, g, unknown or other
  misc_feature (437)..(437): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagtntgttagtatttatttaattggtatcagttcaaacaggaacacccctaagctacctgactctatgctgcatccagttaacaaggtcgggtccatacaagtnttacgagtgacaggtgntcgtgggactagtactttacacttcctaccacctatactagttaacgtacctaacaaccgttagaattatttcggacttaacttactaactntaccaatacgtaacgttaccacctaccctccgccttacctacgtttacgggacggacgggtaccaacgggtggaacgtaacgtaaccgaaaaccgtacgtaggtacgtacgtccaccgtaacgtacttcgttaccg

SEQ ID NO: 286118 - DNA, 673 bp, Homo sapiens
  misc_feature: GYAE6OF02IYORD.4.57.F02.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtggganacagngtcatcattctcttcggccgggacaagtcagtagtgttagttatttatttaaattggtaatctagttacaaaccagggaacgccctaagctcctgatctatcgctgcatcctagtttaacgaagttcgggtacccatacaaagtattaccgaaggtcggtacgaggttaggacgtcgtagggaactagtacttttaccgacttccgtactaaccgtattacgtaacgttacgttacctaaaccgtaacgttacggtaagtttaacgttttcgaaccttaacctttaaccttacgttacgtaacctaaacgtaacgttaacgttaaccgtaaccttaccccgtaccgtaccttccgtaaccgttccgggaacgggtacggtaaccggtaagggtacggtaacggttaacctaaccggtaaacgtaacgttacggtcggtacgtaccggtacctaacccgtagttcgttaccgg

SEQ ID NO: 286119 - DNA, 614 bp, Homo sapiens
  misc_feature: GYAE6OF02H6DHE.4.57.F02.1.454.CMB.1.raw
  modified_base (201)..(201): a, c, t, g, unknown or other
  misc_feature (201)..(201): n is a, c, g, or t
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
  modified_base (610)..(610): a, c, t, g, unknown or other
  misc_feature (610)..(610): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccaagatgacccagtctaccatcctccctgtctgctatctggtaggganacagacgtcatcgatcgtcgttcggccgggcaagtcagtacgttgttaagttatttattaaattggtatcaagttaccaaaccgtaggaaacgtcccctaagtcttctgactctangctgctagtcctaagttaacgaaggttcggccagtacaagtnttcaggtggactacggtagactcgtaggacaagtcttcacgtcctaacgacctaataccgtaagttacgtcctaaactaaccgtaggtaacgttatttacgaccttaaacttctaacctcgtaactaacgtagttaccgttaactaccgttacccctccgtatacccgttacgttacgggtaccggacggtaaccggtaaggtcggaaggtacctaaacgaaaccggtactggtacgctagaccctacgtntccg

SEQ ID NO: 286120 - DNA, 617 bp, Homo sapiens
  misc_feature: GYAE6OF02IP8WJ.4.57.F02.1.454.CMB.1.raw
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (281)..(281): a, c, t, g, unknown or other
  misc_feature (281)..(281): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtcctccatcctccctgtctgcatctggtggganacagngtcatcatctctcggccggnaagtcagngtgttagtaatttatttaaattggtatctagttacaaaaccgagggaaacnccccgtaagcctacctgatctatgctgctactctaagtttaacgaaaggttcgggtacccagtactaaagtactttacgaggtcggtactaggtggtacttcgtagggacacggttaatttcaccttctaccacctatactaggtacttactaacctaacgtagtaaagttacgttttacgacctaactttacttacgtcgaactaacgtaagtaacgttacgtacctaccccgtcgtcttacctacgtttcggacggtacggacgtaacgggtggaactacgtaactaaaccggtacgttcggtcgtacgtaccgactaccgtagttccttaacg

SEQ ID NO: 286121 - DNA, 688 bp, Homo sapiens
  misc_feature: GYAE6OF02FWGAP.4.57.F02.1.454.CMB.1.raw
  modified_base (230)..(230): a, c, t, g, unknown or other
  misc_feature (230)..(230): n is a, c, g, or t
  modified_base (297)..(297): a, c, t, g, unknown or other
  misc_feature (297)..(297): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccatccctccctgtctgcatctggtgggacacagacgtcatcatctcgttcggccgganaagtcagtagttgttaagttattttaattaaagttggtactacgtacgttacaaacgagggaaaccncccgtaagctacctagactactatcgctacgccactacctaaggtttaacgaaaggttccgggtacccagttacgaaacgtctttaccgaggttacggacgtacggtaggtaacgtcggtagggacttaaggttactttaccgaccttcccgtacctacctaagtaccgtaaggttaccgtaaccgttaaaccaaccgtagtaacggtttactttacggacttaaacttactacttacgtaacaaacgtaagttacgttaacgtacccttacccgtccgtccttaccgtacgtttccggggaaccggtacgggtaaccggtaggtacgggaactaaccgtaaccgtaaacgtacggttcggtacggtacctcggacctaccgtattacccg

SEQ ID NO: 286122 - DNA, 602 bp, Homo sapiens
  misc_feature: GYAE6OF02GK7WT.4.57.F02.1.454.CMB.1.raw
  modified_base (219)..(219): a, c, t, g, unknown or other
  misc_feature (219)..(219): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctcttgccgggnaagtcagagtgttagtatttatttaaatggtatcgtagttacaaaccgaggaaacgcccctaagctcctgatctatgctgcatcctagtttacaaggtcggtccatcaagtntcagtggcagtgatcgnggacagtactttcacttcgtacacctatacctaagttacgtacctaacctaaccgtagtaagtacgttttacgaccttaaacctttaacttaccgttagtaaccaacgttacgtaacgttaacccgtaccttacccccgtccgtccttaccgttaccgtttaccgggaccggtaacgggaccggtaagggtacggaaggtaactaaccgaaaacgtaacgtaggtcggtactaccggactaccgtattacgtcg

SEQ ID NO: 286123 - DNA, 560 bp, Homo sapiens
  misc_feature: GYAE6OF02GGVJI.4.57.F02.1.454.CMB.1.raw
  modified_base (229)..(229): a, c, t, g, unknown or other
  misc_feature (229)..(229): n is a, c, g, or t
  modified_base (279)..(279): a, c, t, g, unknown or other
  misc_feature (279)..(279): n is a, c, g, or t
  modified_base (554)..(554): a, c, t, g, unknown or other
  misc_feature (554)..(554): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccatcctccctgtctgcatcgtggtgggagacagagtcatcatctcgttcggccgganaagtcagagtgttagtatttattaattgtatctattacaaacgaggaacnccctaagctctgatactatgctgctatccgtagtttacgaaaggtcgggtacccatacaagtacttcagtggctaggtgtatcgtaggactagtacttcacgtctacacactacgtagtactcctaacaacctagtaacgttatttacgactaacttactacgtagtacaacgagtacgttacgaccttaccctactcctacctaacgttcggcggacggtaccgacgggtgaacgtacgaacgtaaacgtacgtacgtaggcctagacaccgtnttaccg

SEQ ID NO: 286124 - DNA, 785 bp, Homo sapiens
  misc_feature: GYAE6OF02I7OMX.4.57.F02.1.454.CMB.1.raw
  modified_base (201)..(201): a, c, t, g, unknown or other
  misc_feature (201)..(201): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccacccagatcgacccagtcctccactcctccctgtctgcatcgtggtggganacgagagttcactacgtacttccgtacttcgggcccgggataacggtcaaggtagttgtttaagtttaattttaagtttaaattggtactctaaggttaccaaaccggtaagggaaccgtcccctaagtccttcctagtaacttcgtaacttgccttcgcctaacgttaccgtaaggtttaaccgaacgggttaccgggtccctaaagtactaaacgtacgtttaccgaggttaccgggtacgtaggttacggtagttccgtaaggggtacctacggtaacgttttccaccgtttaccctactaaccccgtagttaccgtaacgttacgttaacccgtaaccgttaaccggttacgtaacgtttaacgttttaaccgtaaccttaaacctttaaccgttcttaaccgtacctaaacgtaacggttaaccgttaccgtaacccgtacccccgtacgttaccgttaccggttacggttaccggggaccgggtaacggtaccggtaaggtacggtaaccgtaccggtaaaccgtaacggtaaccgttggtacggtctaccggtacctaccggttctacggtttaccc

SEQ ID NO: 286125 - DNA, 666 bp, Homo sapiens
  misc_feature: GYAE6OF02I9H1N.4.57.F02.1.454.CMB.1.raw
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtgacacccagatcgacccatcctccactccctccctgtctgcatctggtggagacagagtcatcattctcgttcggccggacaagtcagtagtgtttaagttattttaatttaaagttgttatacgtacgttacaaaccggaacggaaaccgaccctaacgtccgtccgtacgtactactatcgtcgtcgctactacctaacgttaacgtaaacgggttcgggtacccatacgaagtacttacgtaggtggtacgtaggttcggtacgtcgtagggactaagttactttacctactctacacctatactagtacgttactaacctaacgtagttaattacgttagtaacctaacgtttaacctctactactaaacgttaacgtaacgttaacccacccgtttacccgtccgttacccttaccgttaccggttacgggaaccgggacggtaaccgggaaggtacggaactaacgtaacgtaacgtaacgttggacggtcgtacgcctaacttaccgtgttc

SEQ ID NO: 286126 - DNA, 731 bp, Homo sapiens
  misc_feature: GYAE6OF02IFBAO.4.57.F02.1.454.CMB.1.raw
  modified_base (198)..(198): a, c, t, g, unknown or other
  misc_feature (198)..(198): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgaccacccagatcgacccagtctccatccctccctgtctgcatctggtggganacagtagtcatcatctcgttggccgggactaagtcagtagttgttagttaattttaatttaaattggttatcgtagttaccaaaaccgagggtaaacgacccccttaaaggtcctaccccgtgtaacttccttaagtcggtcctaggcctaacttacccgttaagttttaaccgaaaggttccggggtacctaacgtactaaacgtattcgaggtacgacgtacggtggtactgtagggtacagtactttaccactttacctaccgtaacctatcgtaagttacgtaccgttaacgtaacccgttagtaaacgttacgttttacgaacctttaaccgtttacttaacgttacggttaaccaacgttaacgttaaaccgttaccgtaaaccttacccccgttaccgtcctttaccgttaaccggttttccggaaccgggtaacgggtacccgtaagggtcggtaaacgtaccgtaaacgtaaaacgtacgttacgggtcggacgttccgaccgtaacttccgtacgtttacccg

SEQ ID NO: 286127 - DNA, 620 bp, Homo sapiens
  misc_feature: GYAE6OF02GAX7V.4.57.F02.1.454.CMB.1.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
  modified_base (428)..(428): a, c, t, g, unknown or other
  misc_feature (428)..(428): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcatctgtgggagacagatcatcatctcttgccggnaagtcagngtgttagtatttatttaattggtatcagttacaaaccgagggaacnccctaagcctctgatctatgctgctatacctagtttaacaaggtcgggtacccatacaagtattcgagtggactaggttggatcgtagggactaggtactttcgacttctacaccctatcgtaagtacgtacctaacgtaaccgttgaaacgttntttacgaccttaacttactctacgtacaacgtagtaacgttaccaccgttaacccctccgtaccttaccgttaccggtttcggggacccgggtaacgggtaccggtaagggtacggtaacgtaaccgttaaccggtaaaacggtacgttaggttcggtaccgtacggacctaaccgttacgttcgttacccg

SEQ ID NO: 286128 - DNA, 787 bp, Homo sapiens
  misc_feature: GYAE6OF02HYJQ1.4.57.F02.1.454.CMB.1.raw
  modified_base (201)..(201): a, c, t, g, unknown or other
  misc_feature (201)..(201): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgaccacccagatcgacccagtctccatccctcctgtctgcatcgtggtggganacagactcatcattcctacgttcggccgggataagtcgaaggtagttagttaagttaacttttaaagttaagttaggtaattacgtaacgttaaccaaaccggacgggtaaaacctccccgtaagtcccttaccgttagacttaccgtaagtcggtaccttacggaccttaacgttaccgttaacggtttaaaccgtaaacgggttcccgggtaccctaaagtacgtaaacgttacgttaccggtagggtacggtaacgtacgggttcgtaacgtttacggtacggggtaacttaacggtttaccttttacccgtaccgttacctacccgtaaacccgttaacgtaccgtaagttaccgtaaccctaaccgtaaccggttagtaacgtttacgtttacgaaccgttaacttacgtacgtacgtacgtaaactacggttaacgtaaccgtacccttacccttacgtaccgttaccgtaccggtttacgggaccgggtaacgggttaccggaagggtacggtaactaacgtaaccgtaaacggtacgttacgggtacgtaccgtaacgtaccgtaccttaacgttccg

SEQ ID NO: 286129 - DNA, 691 bp, Homo sapiens
  misc_feature: GYAE6OF02GOMQ2.4.57.F02.1.454.CMB.1.raw
  modified_base (284)..(284): a, c, t, g, unknown or other
  misc_feature (284)..(284): n is a, c, g, or t
tcagagcactgtagcacgaccggtgctcgatttagctcgatatagttggggtttggggagccagtctcagtcaggacacagcatggacatgagggtccccgctcagctcctgggggctcctgctactctggctccgagatgccagatgtgacacccagatgacccagtctccatcctccctgtctgcatcgtggtgggagacagagtcatcatctcgtcggccgggacaagtcagtagtgttagttattttaattaaattggtatctagttacaacgaggaacnccctaagctcctgtatctatgctgctactctagtttaacaacggtcgggtacccagtacaagtattcgaggtcggacgtaggtaggtagtcggtacgggactaggtactttctaccttactaccaaccctagtacgtaacggttacgtacccttaaaccgtaaaccgttaggtaaacggtttaacttttacggaaccttaaaccttttaacctaaccgttacgttaaccctaaaccgtaacgttaaaccgtttaacccgtaacccttacccccgttaccgtaccttacccgttaaccggtttaccgggaccggggtaccgggtaaccggtaacggggtcggaaacgtacgtaaaccgtaaaccggtacgttaggttacggacgttaccgacgtaacccgtattcccg

SEQ ID NO: 286130 - DNA, 521 bp, Homo sapiens
  misc_feature: GYAE6OF02GJMY6.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (516)..(516): a, c, t, g, unknown or other
  misc_feature (516)..(516): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggnaagtcagagtgttagtatttatttaaattggtatcagttcaaaccagggaaagccctaagctcctgatctatgctgcatccagtttacaagtgggtcccatcaagattcagtgcagtgatcgtaggacagtatttcgactctacacatcagttagtactacaactagaagttatttagactaacttactactacgtacaactagtacgttacgactacccctcgtcttcctacgtttcggacggacggtaccgaggtcgaacgactacgaaacgtactggtcgctcgaccactactnttacg

SEQ ID NO: 286131 - DNA, 679 bp, Homo sapiens
  misc_feature: GYAE6OF02GSVN6.4.57.F02.1.454.CMB.1.raw
  modified_base (198)..(198): a, c, t, g, unknown or other
  misc_feature (198)..(198): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcatctggtggganacagagtcatcatctcttggccgggacaagtcagtagttgttagttatttattaattggtatntagttacaaacgaggaaacgccctaagctctgatctatnctgactatccgtaagttaacgaaggtcgggtaccatacaagtacttcgaggttgacgtaggtcgtagtcgtagggatacgttacttcgacttaccgtccaaccgtaagtccgtaacggttacgtacctaaacgtaccgttaaggtaaacttacgttttacgaaacctttaaactttaaccgtactttaacgtaacccgaaacgttaacggttaaacgtttaacccgtaacccgttaacccccgttccgttaacctttaccggttaacccggtttaccgggaaccggtaccgggtaaccgtaaggggtacggtaacgtaaacgtaacccgtaaacggtacgttcggtacgggtcctacgggaaccttaccggtattccgg

SEQ ID NO: 286132 - DNA, 569 bp, Homo sapiens
  misc_feature: GYAE6OF02IUEH9.4.57.F02.1.454.CMB.1.raw
  modified_base (200)..(200): a, c, t, g, unknown or other
  misc_feature (200)..(200): n is a, c, g, or t
  modified_base (284)..(284): a, c, t, g, unknown or other
  misc_feature (284)..(284): n is a, c, g, or t
  modified_base (565)..(565): a, c, t, g, unknown or other
  misc_feature (565)..(565): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctccctgtctgcactcgtggtggganacagagtcatcatctcgttggccggcaagtcagtagttgttagttatttatttaaagttggtatcagttacaaacgagggaacnccctaagcctctgactctatgctgctactcctaagttaacgaaggttcggaccagtaccgaagtattcgaggtggctaggtgactcgtagggactgtacttcactcctacactatacgtagttacgtactactaactagtaattatttcgactacttactactacgtacaagtagtacgtacgtacctaccctcgtctacgttaccgttccgggacggtacgggaccgtaagggtggaacgtacgtaaccgaacgtacgtcggtcgtccgacgactacctnttcg

SEQ ID NO: 286133 - DNA, 624 bp, Homo sapiens
  misc_feature: GYAE6OF02IY9KW.4.57.F02.1.454.CMB.1.raw
  modified_base (170)..(170): a, c, t, g, unknown or other
  misc_feature (170)..(170): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
  modified_base (239)..(239): a, c, t, g, unknown or other
  misc_feature (239)..(239): n is a, c, g, or t
  modified_base (454)..(454): a, c, t, g, unknown or other
  misc_feature (454)..(454): n is a, c, g, or t
  modified_base (468)..(468): a, c, t, g, unknown or other
  misc_feature (468)..(468): n is a, c, g, or t
  modified_base (499)..(499): a, c, t, g, unknown or other
  misc_feature (499)..(499): n is a, c, g, or t
tcagagcactgtagcacgaccggtgctcgatttagctcgatataggttgggtttgggggccagtctcagtcaggacacagcatggacatgagggtccccgctcagctcctggggctcctgctactcgtggcctccggagatcgccagatgtgaccacccagatcgacccngtcctccatccctccctgtcctgcatcttggnggganacgagacgtcatctactctcgtggcccggganaagtcaggtagttagttagttatttaatttaagttcggttacttacgtacgtttaaccgaaaccgtaagggaaactaccccgttaagcctacgtagacttctaagtcgtcctgtacctacttaccgtaacgtttaacgaacgggttccgggtactacgttacgaagtagttacgaaggtcggtagaggtcgagttacgcggaactagttccttanctcgtaccaacttnactacggttactacacctaactagtaacttnttacgacttaactctaattagactaacagtactacctacctccgtaccgtatcgtacgtcgggtactcgggactacggacgtacgaactaacgaacgtactggtacctgtaccagactcgtctcg

SEQ ID NO: 286134 - DNA, 775 bp, Homo sapiens
  misc_feature: GYAE6OF02HTI4O.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatccctccctgtctgcactctggtgggagacagagtcatcatctacgttcggccgggtcaagtcagtagtgtttagttaattttaatttaaagttggttactacgtagttacaaaaccgacgggaaacaccccgtaaagcctaccgtgactctatcgtctgctacttaccgtaagtttaacgaacggttaccgggtaccctaagttacgaaagttacgtttacgtaggtggtacgtaggttaggtacgttacggtacggtaacgtaggttaacttttccgtaaccgttccttaccctaaacccgtagttaaaccgtaacggtttaacgttaaacccttaaaccgtaaacccgttaaggtaaacgtttaagttttaccgtaaaccttaaaccgtttttacctaacgttacggttaaacccaacgttaacggtaaacgttaacccgttaacccgttaacccccgttccgtaacctttacccgttaccgggtttaaccgggaccggggttaaccgggaaccgttaagggtacggtaaaccgtacgtaaaccgtaaacggtaacgttggtaccggtacgttaccgaaccttaacgtcgtacggtttaccc

SEQ ID NO: 286135 - DNA, 601 bp, Homo sapiens
  misc_feature: GYAE6OF02INRSO.4.57.F02.1.454.CMB.1.raw
  modified_base (153)..(153): a, c, t, g, unknown or other
  misc_feature (153)..(153): n is a, c, g, or t
  modified_base (172)..(172): a, c, t, g, unknown or other
  misc_feature (172)..(172): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
  modified_base (494)..(494): a, c, t, g, unknown or other
  misc_feature (494)..(494): n is a, c, g, or t
  modified_base (498)..(498): a, c, t, g, unknown or other
  misc_feature (498)..(498): n is a, c, g, or t
  modified_base (592)..(592): a, c, t, g, unknown or other
  misc_feature (592)..(592): n is a, c, g, or t
tcagagcactgtagcacgaccggtgctcgatttagctcgatatagttgggtttgggggccaggtctcagtcaggacacagcatggacatgacgggtccccgctcagctcctggggctcctgcctactcgtcggctaccgagatgccagtatgngactacccagatcgacccngtcctccatccctccgtgtctacggctactgtggagggacacgagagttccataccattcgtacttcgggcccggaataagtcaggtgttacgttaagttatttaatttaaagttggttaactcgtaacttacgaaaaccgacggaaactaccccgtaagctacctgtaancttaacgcacgtnactactcgtaaatttaccgaaggtcggtaccatacgaagtactttgacggtgacgagtgactcgtaaggacgtntaactttcactactccgacgtaatcgtancgttaacacaacgtagattacttgactattaacgntacncaacagtacgttacacctaacccgcgttcaactcggttagacggtacgagtaaggcgtaagtacgactaaagccgtaggtcgctacaccggtanactcggtta

SEQ ID NO: 286136 - DNA, 715 bp, Homo sapiens
  misc_feature: GYAE6OF02HIR5T.4.57.F02.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (288)..(288): a, c, t, g, unknown or other
  misc_feature (288)..(288): n is a, c, g, or t
tcagagcactgtagcacgaccggtgctcgatttagctcgatatagttgggtttggggccagtctcagtcaggacacagcatggacatgagggtcccgctcagctcctggggctcctgctactctggctccgagatgccagatgtgacacccagatgacccagtctccatcctcctgtctgctatctggtgggagacagagtcatcatctcttgcggcaagtcagtagtgttagtatttattaattggtaatnagttcaaacgaggaacnccctaagctctgatctatntctgctactcctaacgtttaacaaacggttcgggtccctaagtaccaaagtacttacgaggtcggactacggtaggacttacgtcggggtaactacgttaagttttacccacgtttaccctacgtaccctaattcgaaggtttacgtacctaaccgtaacgttaagtaaaggttactttttacggaaccttaaaccgtttaaccttaaccgtttactaacccgtaaaacgtaacgggttaacgttttaacccgggaaccctttaaccccccgtaccgttaacccgttaaccgttaacccgttttaccgggacggggtaaccggtaccccgtaaaggggtaccgtaacggtaccggtaaaccgtaaaccggtaaccgtacggttaccggtaactacccggtaacgaacccttacgttaccgttaaccg

SEQ ID NO: 286137 - DNA, 676 bp, Homo sapiens
  misc_feature: GYAE6OF02IGYU8.4.57.F02.1.454.CMB.1.raw
  modified_base (489)..(489): a, c, t, g, unknown or other
  misc_feature (489)..(489): n is a, c, g, or t
  modified_base (638)..(638): a, c, t, g, unknown or other
  misc_feature (638)..(638): n is a, c, g, or t
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagatcgacccagtctccatcctcctgtctgcatctgtgggagacagagtcatcactcttcgttcggccgggacaagtcaggtagttagttagttaattttaatttaaagttggttatactacgttaacaaaaccgaagggtaaaccgacccgtaagccttacctgtacttactattgctgctacttcctaagtttaacgaagggttccgggtaccatacgaagttacttacgtaggtcggagtaggtggtacttacggagggtaacgtagtaacttttctacgttcctactaacctactacgtaagtcttaacctaacctaaccgttagtaacgttntttaacgaccttaaacgttacgtactacgtaaactaacgaggttaacgttccgtaaacccttaccccgtacgtacccgttacgtaaccggtttcgggaaccggacgggtaaccgtaagggttaggaacgtaactacggtaaaaccggtntacgggtcgtacgtaccgaactaccctacgttcttacg

SEQ ID NO: 286138 - DNA, 649 bp, Homo sapiens
  misc_feature: GYAE6OF02FP63J.4.57.F02.1.454.CMB.1.raw
  modified_base (195)..(195): a, c, t, g, unknown or other
  misc_feature (195)..(195): n is a, c, g, or t
  modified_base (219)..(219): a, c, t, g, unknown or other
  misc_feature (219)..(219): n is a, c, g, or t
  modified_base (273)..(273): a, c, t, g, unknown or other
  misc_feature (273)..(273): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggnaagtcagagtgttagtatttaatttaattggtatctagtacaaacgagggaacnccctaagctctgatctatgctgcactcgtagtttaacgaacggtcggtacctatacgaagtattcgagtgacgtagtcggagtcgtaggactagtactttgacctcgtacactagtactaggttacgtactaaccgacttaaggtacgttaacgtttacgacgtttaaacttacgttaacctacgttaaccaaacgtaacgtaaacggtttacccgaaacccgtttacccctaccgtcctttaacccgttaccggtttccgggaccgggtaaccgggtacctaaaggggtcgggtaaacgtaaacgtaacccggtaaaacgtaccggttcgggttaggttaccctaggtacccaaccggttacgtttcgttacccg

SEQ ID NO: 286139 - DNA, 584 bp, Homo sapiens
  misc_feature: GYAE6OF02FRZZ9.4.57.F02.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (429)..(429): a, c, t, g, unknown or other
  misc_feature (429)..(429): n is a, c, g, or t
  modified_base (530)..(530): a, c, t, g, unknown or other
  misc_feature (530)..(530): n is a, c, g, or t
tcagagcactgtagcacgaccggtgctcgatttagctcgatatagttggggtttggggagccagtctcagtcaggacacagcatggacatgagggtccccgctcagctcctggggctcctgctactctggctccgagatgccagatgtgaccacccagatgacccagtcctccatccctccctgtctgctatcgtggtggganacagagtcatcatcttctgccgggacaagtcagagttgttattatttatttaagttgtatctagttacaacgaggaacgtcccaancctctgtatctagngctcgactactactagttaacgaacggttcgggtacctatacgaatattgagtgacgtagtgtactcgtagggactagtacttcactctcctaactatactagtactactaacctactagtaattnttacgacttaacttactactcaacgtagaacgttacgtaacgtaccttccccgtactaccgttactacggttacgggaccgggtacggaaccggtaagggngtaacgtaacgtaacaaacggttcgtaggtacgtacgacgacctacgtagtccg

SEQ ID NO: 286140 - DNA, 776 bp, Homo sapiens
  misc_feature: GYAE6OF02HT0K6.4.57.F02.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgacccagtcctccatccctccctgtctgcatcgtggtggganacagagtcatcattctcgttggccggganagtcagtagttagttaagttatttaatttaagttgtatctaagttacaaacgaaggaaaccaccctaagctaccgtagtactctatcgctgactacttacctaagtttaaccgtaaagggttccgggtacctaacgtacgtaaacggttacgtttacgtaagggtacggtacgtagggttacgggtaacgtttcgggttaacgggggtaaccttaaggttttaaccgttttacccgtaaccgttcccgttaacctaaccccgtaacgttaacccggtaacggtttaaaccgttaacccgttaaaccgtaaacccggttaaggttaaaacgtttacgtttttaaccgaaccgtttaaaacctttaaccgttaacgttacgttaacgtaaaccggtaagttaaccggtttaacccgtaacccttaccccgttaccgtcccgttacgttacccgtttacggggaaccggtacgggtaaccgtaacgggtaggaaccgtacgtaaccgtaaacgtacgtggtacgtcgtaacgaccgtacttacgttcg

SEQ ID NO: 286141 - DNA, 625 bp, Homo sapiens
  misc_feature: GYAE6OF02IXDH4.4.57.F02.1.454.CMB.1.raw
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
  modified_base (501)..(501): a, c, t, g, unknown or other
  misc_feature (501)..(501): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgaccacccagatcgaccagtctccactcctccctgtctgcatctggtgggagacagacgtcatcacttctcgttcggccgggacagtcgagtagttgttagttattttaatttaagttggtatctagttacaaacggaggaacctaccctagtcctctgatcgtatcgtcncnctactacgtagttacgaacggttcgggacccaagtacaaggtcttanagggtgacgtaggtagcgttcggtacggaacgtagttcgttactaccctacgtaccaacgtagtacgtaagtacctaactaaccgtaacagttaaacgtttacgttttacacctttaacttacgtactacgtanaacgtgtaacgttaaccaccttacccctcgtcctaccgttccgttacggggaccgtacggacgtaggtacggagtaacgtaacgtaacggtagttcggtacggtacctagacctacctgttacg

SEQ ID NO: 286142 - DNA, 638 bp, Homo sapiens
  misc_feature: GYAE6OF02F77CV.4.57.F02.1.454.CMB.1.raw
  modified_base (102)..(102): a, c, t, g, unknown or other
  misc_feature (102)..(102): n is a, c, g, or t
  modified_base (207)..(207): a, c, t, g, unknown or other
  misc_feature (207)..(207): n is a, c, g, or t
  modified_base (233)..(233): a, c, t, g, unknown or other
  misc_feature (233)..(233): n is a, c, g, or t
  modified_base (384)..(384): a, c, t, g, unknown or other
  misc_feature (384)..(384): n is a, c, g, or t
tcagagcactgtagcacgaccggtgctcgatttagctcgatataggttgggtttggggagccagtctcagtcaggacacagcatggacatgagggtccccgntcagctcctggggctcctgcctactctggctccgagatgccagatgtgaccacccagactgaccccagtcctcccatccctccctgtcctgctatctggtggganacagagtcatcatctcttgccgggtnaagtcaagagtgttaagttatttaatttaaagttggttaatcgtaagttacaaaccgtagggaaacctcccctaaaggcctaccgtgacttctagtcgtcgtacgctacgtcctaaggtttaccgaaaggtccgggtacctagtacaagtntcgaagtcggacagtagatacgtagggacagtactcacttcctaccgtactactacgtacgtactacgtaacctaaccgttagtaagttacgtttacgtactaaccgttactaccgtagtacctaagtacgtagttaccgtaacctaccccgttctccctacgtaccgtttacgggcggtaccggtacgtaacgggtacggaacggtacgtaaccgtaacgagttacgcgtaccgacggtccacctcgttaccg

SEQ ID NO: 286143 - DNA, 862 bp, Homo sapiens
  misc_feature: GYAE6OF02FVNGL.4.57.F02.1.454.CMB.1.raw
  modified_base (197)..(197): a, c, t, g, unknown or other
  misc_feature (197)..(197): n is a, c, g, or t
tcagagcactgtagcacgaccggtgctcgatttagctcgatatagttgggtttggggagccagtctcagtcaggacacagcatggacatgagggtcccgctcagctcctggggctcctgctactctggctccgagatgccagatgtgaccaccagatgacccagtctccatcctcctgtctgctatcgtggtggganacagagtcaatcacttcttcgtggaccgggtacaagtcaggtaggttgtttaacgttatttttaagttttaaagttggttaattccgtaagttttaccgaaaaccgaacggggtaaaacgacccccgttaaaggtcccttaccgttaggtaacttacttaacgttcggtccttacgggactaaccgttacccgtttaaacgggttttaaaaccgtaaaacggggttcgggggttacccccaaacgttaaccgtaaacgttactttaccggtaaacgggtcgggtaaaccgtaggggtacggtaacgtttaccgtacgggggtaaacccgtagggtttaacttttccgaaccggtttcccttaaccctaaaccctaacgtttaccgaaacgggttttaaccgtaccggtttaaaccctaaaccgtacgggttaaactttaaccggggtttttaacaaccgtttaaacccttttaaacgtacgtttaaccgttaaacgtaaacgtaacgggttacccttttaaacggaccccgtttaacccgttccggtaccctttaacgtaccgttttaccgggggacgtaacggggtaacctaggggtaacgtaacgacgttaaacaaccggttaacgtgggtacctcggttaacggacccttacgcgtttaccg

SEQ ID NO: 286144 - DNA, 659 bp, Homo sapiens
  misc_feature: GYAE6OF02IHWOJ.4.57.F02.1.454.CMB.1.raw
  modified_base (197)..(197): a, c, t, g, unknown or other
  misc_feature (197)..(197): n is a, c, g, or t
tcagagcactgtagcacgaccggtgctcgatttagctcgatatagttgggtttgggagccagtctcagtcaggacacagcatggacatgagggtccccgctcagctcctggggctcctgctactctggctccgagatgccagatgtgacacccagatgacccagtctccatcctccctgtctgcatcgtggtggganacaggacgtcatcattcctcttcggccggacaagtcaagtagttagttagttaattttaatttaaagttggtactactaagttaccgaaaaccgtaaagggaaaccgtaccccgttaagccttaccgtagtaactactagtacgcttacgctaactaccgttaagtttaaacgaaaggttccggggtaccctataccgtaaagtacttacgaggtacgacgtaaggttggtactacggtagggaacctaaggttactttaccaccttcgtaccactataccgtagttaactctaaactaacgtagtaacttagtttacgattaaaccttactagtacgtacaaacgtagtaacgtacctacctaccctactcctacgtcgttacgggaggacgtacgtaggtacggtactacgtaacgaaacgtaacggtcggtacgtaccgtacgtaccgtacctagtccg

SEQ ID NO: 286145 - DNA, 833 bp, Homo sapiens
  misc_feature: GYAE6OF02JV0IL.4.57.F02.1.454.CMB.1.raw
tcagagcactgtagcacgaccggtgctcgatttagctcgatatagttggggtttgggggccagtctcagtcaggacacagcatggacatgagggtccccgctcagctcctgggctcctgctactctggctccgagatgccagatgtgaccacccagatcgacccagtcctccactccctccctgtctcgactactcgtggtagggaacgacgaggacgtacactcctaacttcgttccgttcgggcccggggaactaaacggtccgaaggttaggttaggtttaacggtttaatttttaaagttttaaagttggttaacttacgttaacggtttaaccgaaaacccggtaaaggggtaaaccgtacccccgttaacgtacccgttacccgttacggtacttacgttacgttaccggtaccttacggtacctaacgttacccgttaaaggtttaacggtaaaacggggtttccggggtaacccctaagtaaccgtaaagttaaccgttacggtaacggttacgggtacgtaaggttacggtaacgtacgggttagggaaccttacggttacttttcccgaaccgtttacaccctaaccgttactaccgtaaaggttaccttaccgtaaacctaaccgtagtaaatttcgtttaccgaacttaacgtttaacctaagttctaaaccgtaacgtaacgtacggttacccaacccgttacccgtttaccacgtttccgtacccggttacgggacgggtaaccggtacgtaggtacggtaactaccgtacgaacgttacgtcggtacggtacctagacccgtacgttactccgttacg

SEQ ID NO: 286146 - DNA, 579 bp, Homo sapiens
  misc_feature: GYAE6OF02I9GTB.4.57.F02.1.454.CMB.1.raw
  modified_base (167)..(167): a, c, t, g, unknown or other
  misc_feature (167)..(167): n is a, c, g, or t
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (365)..(365): a, c, t, g, unknown or other
  misc_feature (365)..(365): n is a, c, g, or t
tcagagcactgtagcacgaccggtgctcgatttagctcgatatagttgggtttggggccagtctcagtcaggacacagcatggacatgagggtccccgctcagctcctggggctcctgctactctggctccgagatgccagatgtgacacccagatgacccagtccnccatcctccctgtctgcatctgtgggancagagtcatcatctcttgccggnagtcagatgttagtattattaatggtatcagttcaaaccagggaacncccctanctcctgatctangactgcattcagtttacgaaacgtgggtacccatacaagattcagtcgntagtgactgtaggactaatcttcactctcacntacgatacgttactacaaccttagaacttattcgtactaacttaccgtattcgtaactactaaggttaaccgttaccgaacccgttaccccctcggttaccttaccgtaccgtttcgggacggttaaccgggaccttaagggtaccgtaacggtaactaaccggtaaaccgtaacgttggtacgacctaccgtacgtacctagtacttaaccgg

SEQ ID NO: 286147 - DNA, 665 bp, Homo sapiens
  misc_feature: GYAE6OF02HSEJ7.4.57.F02.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (524)..(524): a, c, t, g, unknown or other
  misc_feature (524)..(524): n is a, c, g, or t
  modified_base (609)..(609): a, c, t, g, unknown or other
  misc_feature (609)..(609): n is a, c, g, or t
  modified_base (647)..(647): a, c, t, g, unknown or other
  misc_feature (647)..(647): n is a, c, g, or t
tcagagcactgtagcacgaccggtgctcgatttagctcgatatagttgggtttgggggccagtctcagtcaggacacagcatggacatgacgggtccccgctcagctcctggggctcctgctactctggctccgagatcgccagatgtgaccaccagatcgacccagtctccatccctcctgtctgacatcgtggtggganacgtaggctcatcattcgtccgttggccggtanaacgtcgaggtagtagtttagttattttaagtttaaagtggttaactctaacgttaaccgaaaacgagggaaccgacccctaaggtccttacctaggtactacgtagttcgactggacctacgtacctaagtttaacgaaggtccgggtaccagttacgaatctacgtagtagcgtagtggtagtcgtagggtactaggttactttacctactcgacctaacctattaccgaagtaccgttaaccaaccgttaacaggtacgtttaattactaaccgacgtttaacctancgtaacgtaactaaggttaaccgtacctacccttaccccgcttacgttccgttacggttcgggaacgtaccggacgtggtaacgngtaaaccgagtaaaccggtactagggtctcgtgaaccnccgttacgtggtttaccc

SEQ ID NO: 286148 - DNA, 746 bp, Homo sapiens
  misc_feature: GYAE6OF02I1Y40.4.57.F02.1.454.CMB.1.raw
  modified_base (738)..(738): a, c, t, g, unknown or other
  misc_feature (738)..(738): n is a, c, g, or t
tcagagcactgtagcacgaccggtgctcgatttagctcgatatagttgggtttgggggccagtctcagtcaggacacagcatggacatgagggtccccgctcagctcctggggctcctgctactcgtcggctccgagatgccagatgtgacacccagatcgacccagtcctccactcctccctgtcctgactatcgtggtgggacacagacgtacactcattcctcttcggcccgggactaagtccgaggtagttagtttaagtttaattttaatttaaagtttggttaactcgtaagttaccgaaaccgtaacgggaaaccgtcccctaacggtcccttacctagtaacttcgttacttcgtcgtacgacctaacgttaccgttaacgtttaaaccggtaaacggggttccggggtacctaactacgaaacgttaaccgttacgtaacggttcggacgttaggtacggtagttaccggttacgggaacttaagggttacttttaccgtacgttacctaccaaccgtaactacgttaacggttaacgttaccgtaaccgtaaaccttagggttaaccgtttacgttttacgaaccgttttaaaccttacttaccgttacgtaccaaacgtagtaacgtttaccgaaccctttacccggacctacttaccgtaccgttcgggacggtacggacgtaaggtcgaagtactacgaacgtagtgtcggactcgactaacgtntaccgttc

SEQ ID NO: 286149 - DNA, 802 bp, Homo sapiens
  misc_feature: GYAE6OF02GNF9F.4.57.F02.1.454.CMB.1.raw
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccactcctccgtgtctgcgatcgtggtagggagacgaaggtacgtcactacctacttccgttccgttcggcccgggtaactaacggttacgaagggttaacgtttacggtttaacgtttaaagtttttaaacgttttaaaagtttaggtttaactcgttaacggtttaaacccgtaaaacccggaaacggggtaaacctacccccgttaaacggtccgttacccgtaggtacgttacgttacgtacggtcgttacgggtaacctacgtttaacccgttaaggttttaaccggaaaggggtttaccggggtaccctaacgtacgtaacgtacgtttacgtaggtacggtacaggtacggtactaggtacggtactacgtttacttaccgtactacctaccgaacgtacgtacgtaacgtactacgtaaaccgtaacgttagtaacgttagtttaaccgacctttaaacgtacgttactacgttaaccgaacgttaaggtaaccgttacggtacccttacccgtcgttacccgtacgttaccgttacgggaacggtacgggtaacgtaagggacgtaacggtaacgtaccaaacggtactaggtcgaccgttacgactacccgttagtccgttaacg

SEQ ID NO: 286150 - DNA, 656 bp, Homo sapiens
  misc_feature: GYAE6OF02FMHEW.4.57.F02.1.454.CMB.1.raw
  modified_base (284)..(284): a, c, t, g, unknown or other
  misc_feature (284)..(284): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcgttggccgggcaagtcagagtgttagttattttaatttaaattggtatctagttacaaaccgagggaaacnccccgtaagccttacctagtacttctagtcgtctgacctattacctaagtttaacgaaacgggttcgggtacccagtacgtaagtacttcgaggtcggacgtaggtggtaactcggtagggtactagttactttaccaccttctaccaaccgtataccgtaagttacgtacctaaccgtaaccgtagtaaacttgtttacgacttaactttactacgtagtacctaagtacgtacgttaccgtaacccttacccctccgtaccttacccgtacggtttaccgggaccgggtacgggtaaccgtagggtacggaagtacgtaaccggtaaacggtacggttggaccgtaccgtcgtaacccacgttatcccgg

SEQ ID NO: 286151 - DNA, 731 bp, Homo sapiens
  misc_feature: GYAE6OF02GJL4K.4.57.F02.1.454.CMB.1.raw
  modified_base (726)..(726): a, c, t, g, unknown or other
  misc_feature (726)..(726): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatcgccagatgtcgaccacccagatcgacccagtctccactccctcctgtctgcattcgtggtgggagacgagtacgtctatctacttcgttccgttcgggcccgggactaaggtacgaggtagttagtttagttaatttttaagtttaaagttaggttatacgtacgttaaccgaaaccgtaacgggaaaccgtaccccttaaacgccgttaccgtagtacttacttacgtcgtactacgtacctaacgtaccgttaaacggtttaaccgtaaacggggttccgggtaccctaacgtaacgtaaacgttacttccggtaaggtcggacgtaggtacggtagttcggtacggtaacgtagttacttcactcctcctaacctatactacgtactacctaacaaccgtagtaacgttactttacgaacctttaacttaacttacttacgtaactaaacgtaagttaccgttaaccgtacccttaccccgtcgttacctacgttaccgttaccgggacgggtacggtaaccggtagggtacgaacgtaacgtaacgtaaccgttaggtcggtacggtacgaccgtcaccgttntaccg

SEQ ID NO: 286152 - DNA, 180 bp, Homo sapiens
  misc_feature: GYAE6OF02GTIPD.4.57.F02.1.454.CMB.1.raw
  modified_base (172)..(180): a, c, t, g, unknown or other
  misc_feature (172)..(180): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggactacttccctaagtgctctgagcgggctggcaaggcgcatagnnnnnnnnn

SEQ ID NO: 286153 - DNA, 740 bp, Homo sapiens
  misc_feature: GYAE6OF02JMMWF.4.57.F02.1.454.CMB.1.raw
  modified_base (239)..(239): a, c, t, g, unknown or other
  misc_feature (239)..(239): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctcgagatgccagatgtgacacccagatcgacccagtcctccactccctccctgtctgcatcgtggtagggagacagatctaatcctagttccttcgttcggacccgggnaacgtcgaggtacgttgtttaagttattttaatttaaagttggtattacgtacgttaaccaaacggtaacgggtaaaccgtaccctaacgtccgttaccgtacgtactaccgttagtcggtactacgctaaccgtttaccgtaacgttttaaccggaacgggttccggtaaccctagtaaccgtaaagttacgttccgtaagggtacggaccgtaggttaggtacgttaccggttaggtaacgtatttaccgtttaccacccttacgtaccacgttaccgtatacgttaaccgtcgttaaacctaacgttagtaccgtttagttactaccttaaccttacgttactacgtaacgtacggttaacgttaacccgttaactaccccgttacccctacgtacccgttacgttaccgggtaaccggtacgggaacgtaccggtaacggtaagcgtaacgttaacgaagttcgtaaggtccgtaccgccgtacctacgtcgttacc

SEQ ID NO: 286154 - DNA, 188 bp, Homo sapiens
  misc_feature: GYAE6OF02H8V24.4.57.F02.1.454.CMB.1.raw
  modified_base (140)..(140): a, c, t, g, unknown or other
  misc_feature (140)..(140): n is a, c, g, or t
  modified_base (172)..(188): a, c, t, g, unknown or other
  misc_feature (172)..(188): n is a, c, g, or t
tcagagcactgtagcacgaccggtgctcgatttagctcgatatagttgggtttgggggaagaggaagactgacggtcccccaggagttcaggtgctgggcacagcggccctgggctgcctggtcaaggctacttccctanagtgctctgagcgggctggcaaggcgcatagnnnnnnnnnnnnnnnnn

SEQ ID NO: 286155 - DNA, 676 bp, Homo sapiens
  misc_feature: GYAE6OF02HG56R.4.57.F02.1.454.CMB.1.raw
  modified_base (199)..(199): a, c, t, g, unknown or other
  misc_feature (199)..(199): n is a, c, g, or t
  modified_base (287)..(287): a, c, t, g, unknown or other
  misc_feature (287)..(287): n is a, c, g, or t
tcagagcactgtagcacgaccggtgctcgatttagctcgatataggttgggtttgggggccagtctcagtcaggacacagcatggacatgagggtccccgctcagctcctggggctcctgctactctggctccgagatgccagatgtgacacccagatcgacccagtctccatcctccctgtcctgcatcgtgtggganacagagtcatcacttctcgttcggccggacaagtcagtagttgttagttatttatttaaagttggtatcagttacaaaccgaggaacnccctaagtctctgtatcgtatgctgctactctagtttaacgaaggttcgggtaccagtacgtaagtacgttacgtacggtcggtacgtagtaggtaagtcggtaggaccgtagtacgttttacctacttaccgtccgtaaccaacgttaccgtaagtttaaccggtacttaaaccgtaaccgttacggtaaagtttacgttttacgaacctttaaaccgtttacgttaacgttccggtaactaaacgtacggttaacgttacccgtaccctacccgtccgtccttaccgttaccgttacggggaccgtacgggaccgttagggtacgtaacgtaacgtaacgtaaaccggtacgtacggttacgctcggacctaccgtattccttaccg

SEQ ID NO: 286156 - DNA, 736 bp, Homo sapiens
  misc_feature: GYAE6OF02HNGY4.4.57.F02.1.454.CMB.1.raw
  modified_base (100)..(100): a, c, t, g, unknown or other
  misc_feature (100)..(100): n is a, c, g, or t
  modified_base (190)..(190): a, c, t, g, unknown or other
  misc_feature (190)..(190): n is a, c, g, or t
  modified_base (379)..(379): a, c, t, g, unknown or other
  misc_feature (379)..(379): n is a, c, g, or t
  modified_base (614)..(614): a, c, t, g, unknown or other
  misc_feature (614)..(614): n is a, c, g, or t
tcagagcactgtagcacgaccggtgctcgatttagctcgatatagttgggtttggggagccagtctcagtcaggacacagcatggacatgagggtccccnctcagctcctgggctcctgctactctggtctccgagatcgccagatgtgaccacccagattcgacccagtcctccacgtccctccccttnttccgtgactactcgtggtagggaacgaccaggtacgttacatcacttccttcgtacggaccggacaacgtcgaggtagttagtttacgttaattttaagtttaagttaggttactacgtacgttaaccgaaaaccgtaacggggtaacctacccgtaagtccttacgtagtacgttacttagcgtacncgtactacgttctaacgttacgtaacgggtcggtaccctagtaataacggttctcgagttcggaacgtaggtagacgttaggaccggtatacgtttaactacgtcctaacgtccctaatagtacctaacggtactaccgtaacctaacggttattaaacgttacgtttactaacccgtttaagttacgttaacgtccgttaaacgaagttaacgggtaaccttcccgttaacccncccggtttaccctctaacttccggtaacgggcgtaaccggtacggttaacgggtcggttaacctacggtaaccggtaacctagggttacgccggattaccccggatttaccgtcgttaccgg

SEQ ID NO: 286157 - DNA, 718 bp, Homo sapiens
  misc_feature: GYAE6OF02GKPPB.4.57.F02.1.454.CMB.1.raw
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
tcagagcactgtagcacgaccggtgctcgatttagctcgatatagttgggtttgggagccagtctcagtcaggacacagcatggacatgagggtccccgctcagctcctggggctcctgctactctggctccgagatcgccagatgtgaccacccgagatcgacccagtcctccatccctcctgtctgctatcgtggtaggganacagngtcaatcatcttctcggaccggacaagtcagtgttagttaagttatttattaagttgttactntagtacaaacgaaggtaacctacccgtaatcctactgtaacttctncgtntcgactactaccttaagtaacgtaacggttcggtacccataacgaacgttcgttacgaggttcgacgttaagggtcgtaacgttcggtacgggtaacttaacgtttacgtttccctaacgttcccttaaccgaacccgttatttcggtaacgttaccgtaccgttaaaccgtaacccgtaggttaaacgtttacgtttaccgtaacttaacccgtttcttaacggtacctaactaacgaacgttaaccgttacccgtaaccttaccccgtactcccgtacgttaccggttacgggaccggttaacgaccggtaacggtcggtaacgtaaccgtaaacgtaaaccgggtaacttcgggtaccgttacggtaccgacccgtttacgaccgttttaccg

SEQ ID NO: 286158 - DNA, 729 bp, Homo sapiens
  misc_feature: GYAE6OF02GACUY.4.57.F02.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
tcagagcactgtagcacgaccggtgctcgatttagctcgatatagttgggtttgggggccagtctcagtcaggacacagcatggacatgaggtccccgctcagctcctggggctcctgctactctggctccgagatgccagatgtgacacccagatcgacccagtctccatccctcctgtctgcatcgtggtgganacagagtcatcatctcttgccgganagtcagtagtgttagttatttatttaagtgtatctagttacaacgaggaacaccctaagctcctgactctatgctgctactacctagttaacgtaacggttccgggtaccctagtaccgtaacgtacgttacgaggtacggtacgtaggttacggtacgttacggtacgggtaactaggttaccttttaccgtaaccgtttccgtaaccctaccgtacttaccgtaaggtttaaccgtaccttaaacccgaaccgtttacggtaaacgtttacgttttaacgaacccttaaaccgtttaaccgttaccgttacgttaaccaaacgttaacgttaaccgttaaacccgtacccttaacccccgtcccgttaacccgttacccgttaccggtttaccgggaacccgggttaacggtacccgtaaaggggtcggtaaacggtaactaacccggtaaacgtacgttacgggtacggtacgtaccgaaccgtaccgttacgtaccgtttaccg

SEQ ID NO: 286159 - DNA, 619 bp, Homo sapiens
  misc_feature: GYAE6OF02I0YLV.4.57.F02.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
tcagagcactgtagcacgaccggtgctcgatttagctcgatatagttgggtttggggagccagtctcagtcaggacacagcatggacatgagggtccccgctcagcctcctggggctcctgctactctggctccgagatgccagatgtgacacccagatgacccagtctccatcctccctgtctgcatctgtggganacagagtcatcatctcttgccgggacaagtcagagttgttagtattttaatttaaattggtatcagttcaaacgagggaaacnccctaagcctcctagatctangctagtcaatccagtttaacaaaggtacgggtccagtanaagattacagtggacagtggactgagganagtnttacactctacaccgtatacgaagttagtacgtaaccaacgtaacgaagttaagtttttcgtaactaacctttaacgttaaccttaacgtaccgaaaacaacgttaagttaaccgtaaccttaacccccgtaccgttaccctactaacgttttaccgggaccgggacgggaaaccgtacgggtaaggacgtaagtaacccgaaaaggtaaccgtaggttcggacttacggacctacgtacttaccg

SEQ ID NO: 286160 - DNA, 905 bp, Homo sapiens
  misc_feature: GYAE6OF02GX1AM.4.57.F02.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccactcctcctgtctgcatctggtcgganacagtagtcatcatctcttggccggnaagtcagtagttagttagtttattttaatttaaagttggttactacgtacgtttaacaaaccggtaacgggtaaacgtacccccgttaaagtcccgttacccgttagtaacgtttccgttaacgttccgtaccgttacggaccttaacgtttacccgtttaaacggtttaaaccggtaaaccgggttaccggggttacccctaagtaccggttaaacgttaacgttaccggttaacggttacgggtacgtaacgggttacgggttaacgtttccggggtaacgggtaaccgtaacgggttttaaacccttttccggttaaccctttacccgttacccggttaaacccctaacgtttaccggtaaacggtttaaccgttaacccgtaaaccgttaaaccgttaacgggttaaaacggttttacgtttttaccgaaaccgttttaaaccctttaaccgttaaccgtttaacggttaaaccctaaaccgggttaacggttaccgtttaaacccggtaaccccgttaacccccgttaccgttacccgttaccggttaaccgggttacccgggtaccggggtaacgggtaaaccggtaacggggttaacgggaaaccgttaacgaaccggttaaaaccgtagggttacgttcggtacccgttaacggacccgttataccgttaccg

SEQ ID NO: 286161 - DNA, 764 bp, Homo sapiens
  misc_feature: GYAE6OF02H7QOH.4.57.F02.1.454.CMB.1.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (224)..(224): a, c, t, g, unknown or other
  misc_feature (224)..(224): n is a, c, g, or t
  modified_base (484)..(484): a, c, t, g, unknown or other
  misc_feature (484)..(484): n is a, c, g, or t
  modified_base (564)..(564): a, c, t, g, unknown or other
  misc_feature (564)..(564): n is a, c, g, or t
  modified_base (757)..(757): a, c, t, g, unknown or other
  misc_feature (757)..(757): n is a, c, g, or t
tcagagcactgtagcacgaccggtgctcgatttagctcgatatagttggggtttggggagccagtctcagtcaggacacagcatggacatgagggtccccgctcagctccgtggggcctcctgctactctggctccgagatcggccagatgtagaccacccagatcgacccagtcctccactcctccctgtcngcatcgtggtggganacgagtacgtacactntacttcgtcgttacggcccggggataacggtcgagtaggtttaggtttaacttaatttttaaatttaaggttaggttattaccgtaagttaaccgaaaccggaacgggtaaacccacccgtaacgtccttaccgtagtactacgtaagtcgctcgtaccaacttacgttaacggttaacggaacgggttccggtaccctaacgtaacgtaactgtttacggaacggtttggacttagggtcggtacgtaagtcgggtaanaacgtttcttaccgacttacctaccaacgttcgaacgttacggtaacctaaccgtaacgtaacgttaagttaaccgtttnttaaccgtacttaaaccgtttatacggttaactaacgtaaaccgtaggttaccttaaacccggtccctaccccgtcttaccgttaccgttacgggttccgggaacgggacgggaacccggttaagggacgggaacctaacgttaaaccgaacggttacggtggtacccggtagttaccccgaaagtttcccgngtttacc

SEQ ID NO: 286162 - DNA, 641 bp, Homo sapiens
  misc_feature: GYAE6OF02FZTR5.4.57.F02.1.454.CMB.1.raw
  modified_base (199)..(199): a, c, t, g, unknown or other
  misc_feature (199)..(199): n is a, c, g, or t
  modified_base (310)..(310): a, c, t, g, unknown or other
  misc_feature (310)..(310): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtagacacccagatgacccagtctccatcctccctgtcctgcatcgtgtggganacgagagtcatccatctcgttgccggacaagtcagagtgttagttatttaatttaatggtatcgtacgttacaaacgagggaaactccctaagcctacctgtactctatcnctcgactacttacctaagtttaacgaaacggttcgggtacctacgtacaacgtattcgaggttcgcgtagtagngtcgtaggganaagttcttacacttctaccaactagtacgattagtactaacctaacgtagtaacgttagtttacctaaccgtaacctttacgttacttaggtaacccaattaacggtacgttaaaccgtcccgttaccccttaccgttcctaacgttacccggttaccgggacgtacccgggtacggtaacggtgggaacctactaaccggaaacgtacggtaggtaccggtcgtaccgactaccgtagttacccg

SEQ ID NO: 286163 - DNA, 656 bp, Homo sapiens
  misc_feature: GYAE6OF02I15C2.4.57.F02.1.454.CMB.1.raw
  modified_base (156)..(156): a, c, t, g, unknown or other
  misc_feature (156)..(156): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (228)..(228): a, c, t, g, unknown or other
  misc_feature (228)..(228): n is a, c, g, or t
  modified_base (412)..(412): a, c, t, g, unknown or other
  misc_feature (412)..(412): n is a, c, g, or t
  modified_base (420)..(420): a, c, t, g, unknown or other
  misc_feature (420)..(420): n is a, c, g, or t
  modified_base (513)..(513): a, c, t, g, unknown or other
  misc_feature (513)..(513): n is a, c, g, or t
  modified_base (619)..(619): a, c, t, g, unknown or other
  misc_feature (619)..(619): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagntgacccagtctccatcctaccctgtctgacatcgtgnggganacagacgtnatcattctcttcggccggtanaacgtcagtacgtagttaagttattttacgttaaagttcggttaatcgtaacgttaccaaacggtacgggaaaccgtcccctaagtaccctccgtagtacgtactacgtgtaccgtcgactaccgtaccgtaagtttaaccgtaaacgggtcccgggtacctaacttacgaaagtctttaacgnggtacggntaacggtagactacggtacggaacgtacgtactttacaccgtacctacaccgtataccgtacgttacgtacctaacgaccttagtaaccgttnttaacgacgttaactaaccgctttacgacctaacgacgttacgtaccgtacctacccgtactacgtctaaccggttggaccggttagacgtagacgtctaacgtanaacgtacgttggactgaccttagaccttagtcttacg

SEQ ID NO: 286164 - DNA, 777 bp, Homo sapiens
  misc_feature: GYAE6OF02HWEYL.4.57.F02.1.454.CMB.1.raw
  modified_base (198)..(198): a, c, t, g, unknown or other
  misc_feature (198)..(198): n is a, c, g, or t
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
tcagagcactgtagcacgaccggtgctcgatttagctcgatatagttgggtttggggagccagtctcagtcaggacacagcatggacatgagggtccccgctcagctccgtggggctccctgctactctggctccgagatgccagatgtgacacccagatcgacccagtctccatcctcctgtctgcatctggtgganacagacgtcatcattcctcgttgccgggcaagtcagagttgttagttatttaattaattgtatntagtacaacaggaacaccctaagctcngtatctatgctgactactcgtagttaacgaaggtcgggtaccctagacgtaacgtattaccgtagtacggacgtaggtacggtacgttacggtacgggtactacggttaactttaccgtaaccgttaccctaccgtaaacccgtaacgttaccgtaacggttaaccgttaccgtaaaccggtttaaaccgttaggttaaaaccgtttacgtttttaacccgtaaacgtttaaccctttaaacttaccgttaacggttaaacgaaaccgttaaacggttacccgtttaaccgttaacccgttaacccccgttaccccgttccgttaaccccgtttaaccgggtttcccgggtaaccgggtaacccggggttaaccggttaaacggggtaaccgggtaaaccggttaaacgttaaacccggtaaaaccggttaaccgttacgggttaccggttaccgtaaccggttaaccctacgttaccctttaaccgg

SEQ ID NO: 286165 - DNA, 830 bp, Homo sapiens
  misc_feature: GYAE6OF02HOD54.4.57.F02.1.454.CMB.1.raw
  modified_base (210)..(210): a, c, t, g, unknown or other
  misc_feature (210)..(210): n is a, c, g, or t
  modified_base (240)..(240): a, c, t, g, unknown or other
  misc_feature (240)..(240): n is a, c, g, or t
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtgaccacccagtatcgacccagtcctaccactccctccctgtcctgccattcgtaggtggganacagacgtcatcattctcgtcggccggganaagtcagtagttagtttaagttattttaaagtttaaagttcggtaacttacgtaagtttaaccgaaaaccggtaagggaaaacccgtcccctaagtccttaccgtaggtacttacgtatacggctagtacctattaccgttaagttaacgtaacgggtcggtaccctaagtaccgtaaaggtcttacgtaacggtcggaacttagggtacgtacgtttacggtaaccgggaaccttaaggtttaccctttacctaacgtttccctaaacccgtaaaccggtactttaaccggtaaacggtttaaccctaacccgtttaaaacccgttaaccggtttaaggttaaaccgttttacgttttttaacccgggaaactttaaaacccgttttacgttaaccgttacggtaaaacccttaaacgggtaaacgtttaaccggtttaaccgtaacccctaccccgttaccggttccttaacccgttacgggtttaccgggaaccggtaagggttaacccgggtaaggtacggtaacgacgttaaacccggaacgtaacgtcgggtacgtcgttacccggacttaccggtattcccgg

SEQ ID NO: 286166 - DNA, 650 bp, Homo sapiens
  misc_feature: GYAE6OF02F1CTZ.4.57.F02.1.454.CMB.1.raw
  modified_base (222)..(222): a, c, t, g, unknown or other
  misc_feature (222)..(222): n is a, c, g, or t
  modified_base (391)..(391): a, c, t, g, unknown or other
  misc_feature (391)..(391): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtcctccatcctccctgtctgcatctggtggagacagagtcatcatctcttgccgganaagtcgagagtgttagtatttaatttaaagttcggttatctagttaccaaaccgtagggaaacgtccctaaggctccgtgactctatcgctgcactcctagtttaacgaaggttcgggtaccagtactaagtattacgaggtcgacgtaggtaggtagtcgtacggganaacgtacgttactacctactaccgacctatacgtaagttacgtacgtaacctaacgtgtaaagttactttacgacttaaaccttacgtactacggtaactaacgtaacgtacgtttaaccgaccctttaccccgacgttacctaccgtttaaccgttccgggaccggtacgggtaacccgtaagggtcggaacgtaaccgtaaccggtaaacgttacgtacggtacggtaccgttacggacccttaccgtacttaccgg

SEQ ID NO: 286167 - DNA, 853 bp, Homo sapiens
  misc_feature: GYAE6OF02JTUHG.4.57.F02.1.454.CMB.1.raw
  modified_base (163)..(163): a, c, t, g, unknown or other
  misc_feature (163)..(163): n is a, c, g, or t
tcagagcactgtagcacgaccggtgctcgatttagctcgatatagttgggtttggggagccgagtctcagtcaggacacagcatggacatgagggtccccgctcagctcctcgggctcctgctactctggctccgagatgccaggatcgtgaccacccgaagntcggacccagtctccatccctcctgtctgctatcgtggtgggacaacgagtacgtactactcgtaacttcttaccgttacggcccgggacgtaaagaccgtaacggtagttggttttaacgttatttttaaacgtttaagttttaacggttactaacttacggttaaactaaaaaccggaggggtaaaaccgttaccccgtaaacgtcccgttaacgttacggtaattaccggttaacggtctaccggttacgtacccttaccgttaacccggttaagtttaaaacgggaaacccggggttttccgggtaaccctaacgtttaaccgaaaggtttaccgttaaccggaccgggtttagtaccggtaaggggtttaaccgtacgttacccggttacgggggtaaaaccttagggttaactttaccccggtaccttaacccgttaccaaaccggtaacctcgttaacggtaccgttaaacgtaccttaaccggtaataaccgttagtttaacgtactaacgtttaacgtcttaacgtacaaacgtacgttacgtaacgtaccttacccgtaactccttaccgtacgttacccggttacgggaccggttaggtaaccggtagggtaaccgttaaccggtaacgtaaaccggtacgttacggttcggaaacctcgtaacgtaccacgttcccgg

SEQ ID NO: 286168 - DNA, 762 bp, Homo sapiens
  misc_feature: GYAE6OF02JXPJX.4.57.F02.1.454.CMB.1.raw
  modified_base (138)..(138): a, c, t, g, unknown or other
  misc_feature (138)..(138): n is a, c, g, or t
  modified_base (148)..(148): a, c, t, g, unknown or other
  misc_feature (148)..(148): n is a, c, g, or t
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (343)..(343): a, c, t, g, unknown or other
  misc_feature (343)..(343): n is a, c, g, or t
tcagagcactgtagcacgaccggtgctcgatttagctcgatatagtttgggtttggggagccagtctcagtcaggacacagcatggacatgagggtccccgctcagctcctggggctcctgctactctggctccgagntgccagatgngacacccagatgacccgagtcctccatcctccctgtctgcatctggtagganacagatcatnactctctggaccgggacagtacagtagttagttaagttatttaaagttttaagttaggttacgtactaacgttaaccgaaacgggaacggtaacccgtaccgtaaccgttaccgtctacgtaacttacgttanccgtgaacctacttaattaccgttaaaggttacggtaaaccgggtcggtacctagtaacgtaacgtacgtttacgagttcggagtaggtacgttactagggtacggtaacagttttacccgtagtaccttaccctacctaaacgtaccgtaagttaaccggtacgtttaacctaaccgtaagtaaacgttagttaacggtttaactaaaccggtttaacctttaaacgtaccttaacggtaacccgtaaagttacggttacccgttaaacctcccgttaacccgttaccgttacccttacggtttaccgggttaaccgggacccgggtaacgggttaaccggaacgggtacgggtaactaacgtaacggtaaaccggtacgttaccgggtgttacccgagtaacgtacgtccgttaacg

SEQ ID NO: 286169 - DNA, 741 bp, Homo sapiens
  misc_feature: GYAE6OF02GQCM6.4.57.F02.1.454.CMB.1.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (410)..(410): a, c, t, g, unknown or other
  misc_feature (410)..(410): n is a, c, g, or t
tcagagcactgtagcacgaccggtgctcgatttagctcgatatagttgggtttgggggccagtctcagtcaggacacagcatggacatgagggtccccgctcagctccgtggggctcctgctactctggctccgagatgaccagatgtcgaccacccagatcgacccagtcctccactcccttcctgtctgctagttctggtaggacgacagagtacatctatcctcgtcggccgganacgtcgagtagttnttagttaatttaatttaagttgtactactactaccgaaagacggaacgtaccctaagacctctagtactctaacgtcgtctcgtacacttaaccgttaacgttaaacggtaacggttaccgggtacccaagtaactaacgtacgttacgtagtacggngtaaggtacggtattaccgggtggtaacgttgttaacctttcctaacgttccgtaccctaaccgtacgtttaacggtacttaaccgttaactaaccgtaacgtaagttaccgtttattaaccgtaaccctttaacttaaccgttacttacgaaaccgttaagtaacggtaaccttaccgttaacccctacccgttccgtaccgtttaacgttcccggttacggggaacccggtacgggtaaccggttagggtaaccggtaaacggttaacgtaacgaacccggttaagtccggtacgacccggttacaccttacccgtggttcttaaccgg

SEQ ID NO: 286170 - DNA, 676 bp, Homo sapiens
  misc_feature: GYAE6OF02G3DN1.4.57.F02.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatccctcctgtctgcatcgtgtggganacagngtcatcatctcgttggccgggactaagtcagagttgttagttattttaattaaagttggtatctagttaccaaacgagggaaactccctaagcctaccgtagtactcgtatacggtctgacctactaccgttaagtttacgaacggttcgggtacccagtacgaagtctcgtaaggtcgcgtaggtagtacgtcgtagggaactagttacgttaccgacttacctacctaacgtactacgtaacgtacgtacctaacgtaacctagtaacgtttgtttacaaccttaacgttaccttaacgtacgtaacgaaaccgtagtaaccgtaaccgtaacccgttaccccgtaccgtacgttaccgtaaccggtttccggggacgggtaaccgggtaccgtaaggtacgggtaacggtaacccttaaacgaaaccggtcgttaggtccggttacgacgtacccgtacctaagttccgg

SEQ ID NO: 286171 - DNA, 737 bp, Homo sapiens
  misc_feature: GYAE6OF02FIEGX.4.57.F02.1.454.CMB.1.raw
  modified_base (729)..(729): a, c, t, g, unknown or other
  misc_feature (729)..(729): n is a, c, g, or t
tcagagcactgtagcacgaccggtgctcgatttagctcgatatagttgggtttgggggccagtctcagtcaggacacagcatggacatgaggtccccgctcagctcctgggctcctgctactctggctccgagatgccagatgtagaccacccagatcgacccagtcctccactccctccctgtactgccattctggtgggacacgagtacgtcactacctctcctcgtttcggacccgggtacaacggtctaggtagttacggttaacgttaatttttaattttaaaacgtttggtaactttaccgtacggtttaaacccgaaaacccggaacggggaaaccctaccccctaaggttcccttaccggtataacttaccgtaagttcgtaccgtcgtacctactaacccgttaacggtttaacgaaaacgggttccgggtacccctaattacccgaaagtctttacgaggttacggcgtaagtcggtaactcggtacgggacttacgtactttaccacttacccgtacacctacgactaacggtactaccgtaaccctaacgtacgtaattacgttttacgaacctttaacgttaacctcttacggtaaccaaacgtaccgtaacgtttaccgaaccttccccgtacgtccttacgtacggttcggacggacggtacgaggtactaacgtaccaacgtaaccgtgtacggtcgtacgtaccgcaccttntccttacg

SEQ ID NO: 286172 - DNA, 725 bp, Homo sapiens
  misc_feature: GYAE6OF02IXUNG.4.57.F02.1.454.CMB.1.raw
  modified_base (200)..(200): a, c, t, g, unknown or other
  misc_feature (200)..(200): n is a, c, g, or t
tcagagcactgtagcacgaccggtgctcgatttagctcgatatagttggggtttgggggccagtctcagtcaggacacagcatggacatgagggtccccgctcagctcctggggctcctgctactctggctccgagatgccagatgtcgacacccagatgacccagtcctccactcctccctgtctgcatcgtgtggganacagatcatcatcctcttggccggacaagtcagtagttagtttattaattttaattaagttggtactactagttaaccaaaccgtaggaacctccctaagtcttctgtactctatcgtactcgactacgtacccttaagtttaaccgaagggttccgggtaccagtacgtaagtacgttacgtacggtacgtacggtaggtcggtacgttacgtacgggaacgttacgtttacctttaccgacgttccctaacctaacgacgttaccgtaacggttacgtacctaaccctaacggttaaggtaacgtttctttaaccgaacgtttaacccgttaactacgttccgaacctaaagggttacgttaaccggttaacctacccttaacccgtcgttacccgttaacgtaaccgggtttcccgggaacggttaccggtaacgtaacgggttacggaacttaaccggtaaccgtaaacggaggtttaccggacggtacctacgtaacccacggttccttacgttaacccg

SEQ ID NO: 286173 - DNA, 730 bp, Homo sapiens
  misc_feature: GYAE6OF02F405E.4.57.F02.1.454.CMB.1.raw
tcagagcactgtagcacgaccggtgctcgatttagctcgatatagttgggtttgggggccagtctcagtcaggacacagcatggacatgagggtccccgctcagctcctgggctcctgctactctggctccgagatgccagatgtgacacccagatcgacccagtctccatccctccctgtctgcagtctggtgggagacagtagtcatcatctcgttcggccggcaagtcagtagttgttagtattttaattaaattggtatactagttacaaaccgagggaacgcccctaagctcctgtactactatgtctgctataccgtaagtttacgaaaggttcgggtacctaatacgaaagtacttacgagtcgggactaggttaggactcggtaggggtaactaacggttactttccgtaaccttctaccgtaaccaacttacgtaacgttaacgtactaaaccctaaacccgttagtaaacgtttacgttttaacgaccttaaacgttaccttaacgttaccgtacctaaacgtaacggttaacgtttaaccgaaccccgttaccccgtaccgttaccttaaccgttaccgggttaaccggggaaccgggttaaacgggtacccgtaacggggtaagggaaccgtaaacggtaaacccgtaaaacggttaacgtccgggttaacggtcccgtaaccggtacccgtaaccgttaacgttcccggtttaaccg

SEQ ID NO: 286174 - DNA, 808 bp, Homo sapiens
  misc_feature: GYAE6OF02G93IV.4.57.F02.1.454.CMB.1.raw
  modified_base (149)..(149): a, c, t, g, unknown or other
  misc_feature (149)..(149): n is a, c, g, or t
  modified_base (419)..(419): a, c, t, g, unknown or other
  misc_feature (419)..(419): n is a, c, g, or t
tcagagcactgtagcacgaccggtgctcgatttagctcgatataggttggggtttggggccagtctcagtcaggacacagcatggacatgacgggtcccgctcagctcctggggctcctgtctactcgtggctccgagatgccagatgngaccaccagtactcgacccagttcctacctacttcccctcccgttggttcctagtactacttcgtacgggttaggggaacgacgtaaggtaccgttactacttactactttaccgttccgttccgggaccgggtactaaggtaccgaaggtacggttttagttaaggttttaactttttaacggtttaaagttgttaacgttacgtaacgttaaccgaaaaccggaacggtaaccgtacccgtaacgtcctacgttagtacttacgttancggtctcgtactacgttacgttaaacgttacggaaggtccggtaacctagtaacgtacgtattaccggaggtcgtaacgcggttacggtacgtagtaacggacttacgtttacttaccgtaccgtccttacgaaaccgttacttaccggtaaacgttacgtaaccttaaacgacgtttaaaggtacttacgttaaccgtactttaacgtactacgtactacgaacgttaggtacccttaacggtacccgtcctaaccgttcgttccggtttacggaccgggtaacgggtacgggtaccggtaggtaccgggtaaattacccggttaaacgaaccgtttacgggttaggaccccgtaggttcccactaacgttcggtttaacttcccggg

SEQ ID NO: 286175 - DNA, 676 bp, Homo sapiens
  misc_feature: GYAE6OF02GSP9F.4.57.F02.1.454.CMB.1.raw
  modified_base (267)..(267): a, c, t, g, unknown or other
  misc_feature (267)..(267): n is a, c, g, or t
tcagagcactgtagcacgaccggtgctcgatttagctcgatatagttggggtttgggggagccagtctcagtcaggacacagcatggacatgagggtccccgctcagctcctggggctcctgctactctggctccgagatgccagatgtgacacccagatgacccagtctccatcctcctgtctgcatctggtgggagacgagagtcatcatctcgttcggccgggcaagtcagtagtggttaagttatttaatttaaattggtatntagtacaaacgaaggaacgacccgtaagacctctagactactagtgctgctactacgtaagttaacggtaaacggttcgggtaccctaataacgtaaagtacttacgaggtcggtacgaggttaggtaatacgggtacgggtaaccgtaagtttacttccgtaacttcctaaccgaacgtacgttaacgtaaacggttaacgtaccttaaaccgtaaaccgttaaggttaaacgttaacttttcggaaactttaacttaaccgtacgtttactaacgtaaactaggtaaacgttcccgtaacttaccccgtacgtccttacgtacgttacggggacggtacgggtacctaaggggtcggaagtaacgtaacgaaacgacgtaggtacggactacgacctacgtagttcg

SEQ ID NO: 286176 - DNA, 725 bp, Homo sapiens
  misc_feature: GYAE6OF02JT6Q9.4.57.F02.1.454.CMB.1.raw
  modified_base (176)..(176): a, c, t, g, unknown or other
  misc_feature (176)..(176): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
tcagagcactgtagcacgaccggtgctcgatttagctcgatataggttggggtttgggggccagtctcagtcaggacacagcatggacagtgacgggtccccgctcagctcctggggctcctgctactcgtggctccgagatgccagatgtagaccacccgagatcgacccagtcnccatccctcctagtcngcatcgtgtggacanagctacagtcatccttcgtacggcccgganaagtctaaggtacgtttagttagttaacttttaagttaaagttcggtatccgtaagttaaccgaaacccggtaagggaacctaccccgtaggtaccctacggtagaccgttactagtacggactcggtaaccttaacgttaacccgttaagttttaacgacgggtacccggtaccaaatacgtagtaaccggtttcgacgggttacgtacgagggttacgttagccgggttaacggaactcggtttaactcccgtctaacctccgtaacctagtaaccgtacgttaaccgtacgttaaccgaacgttacgtaatttacgttacgttaaccttaaccgtaccttagtacctaacgtactaacgttacgtacctaacccgtaccctcgttccctagttaccgtcggtacgggaacctagggtcggtaacgagtaaccgtaggtaaacctgttaccgtcggacaccggtacaccggttacgtcgttaaccg

SEQ ID NO: 286177 - DNA, 584 bp, Homo sapiens
  misc_feature: GYAE6OF02I08IT.4.57.F02.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (273)..(273): a, c, t, g, unknown or other
  misc_feature (273)..(273): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatcgacccagtctccatcctccctgtctgcatctgtggganacagngtcatcatctcttgccggcaaggtcagngtgttagtatttattaattggtatctagttacaaacgaggaacnccctaagctctgatcatgctgcatcctagttacaaaggtcgggtccatcaaagtacttacgagtcggacaggtgagtgtggactagtactttcacgttcctacacctatacgtagtacgtacctaacaacctagaagttatttacgaccttaactttaactactagtaactaacgaagttaacgttaaccgaccttacccgtccgtacttccgtacgtttccggacggtaacgggacgtaagggtacggtaagtaacgaacgtaaacggtaacttgggtacggtcctacgacctaacctacgttcttacgg

SEQ ID NO: 286178 - DNA, 595 bp, Homo sapiens
  misc_feature: GYAE6OF02IOYM5.4.57.F02.1.454.CMB.1.raw
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (404)..(404): a, c, t, g, unknown or other
  misc_feature (404)..(404): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccactcctcctgtctgcatctggtgggananagtatcatcattctcgtcggccgganaagtcagagttgttaagttattttaatttaagttgtatctagttacaacgaggaacaccctagctcgtnactntagtcgctcgactacttccgtaagtttacgaaacggttcgggtaccctaagtacaagtacttacgaggtcgagtagtaggtatacggtagggactagttacttacncctctaccacatacgtagttacgtactaacaacctagaatttcgtttacaccttaaccttcgtactacgtacaagacgttagttacctacctacccgtcgtactcgttaccgtcgggacgacgggtacgtaacggtgaacgtacgtaacgaacggtaacttgggtacgtacgtaccgccgtacgtcttacg

SEQ ID NO: 286179 - DNA, 667 bp, Homo sapiens
  misc_feature: GYAE6OF02HW4RQ.4.57.F02.1.454.CMB.1.raw
  modified_base (183)..(183): a, c, t, g, unknown or other
  misc_feature (183)..(183): n is a, c, g, or t
  modified_base (197)..(197): a, c, t, g, unknown or other
  misc_feature (197)..(197): n is a, c, g, or t
  modified_base (482)..(482): a, c, t, g, unknown or other
  misc_feature (482)..(482): n is a, c, g, or t
  modified_base (524)..(524): a, c, t, g, unknown or other
  misc_feature (524)..(524): n is a, c, g, or t
tcagagcactgtagcacgaccggtgctcgatttagctcgatatagttggggtttggggggccagtctcagtcaggacacagcatggacatgagggtccccgctcagctcctggggctcctgctactctggctcgagatgccagatgtgacacccagatgacccagtctccatccctcctgtcngcatcgtgtggganacagagtcatctatctcgtcggaccggataagtctaaggagttaggtttaagttaattttaaacgtttaaagttggttaaatacgtaacgttaacccgaaaaccgtaacggggaaaaccgtaccccgttaaaagtcccgttaccgttagtaacgtcgttaagtcgtcgtacgtactacgtaccttaaggtttaacgtaaacggtccggggtacctaagttacgtaagtacttaccgaggtacgacgtaggtacggacttcggaggtactaatacgtttccaactntacccgactaagtcgtagttacaacctaagacgtagtaagtnttacgacttaacttacgtataccggtataacgtacgtactaccgtacctacccgccgtacttaccgcgttacggacgaacgggtactagggtcgaagtacaaacgtaacgtacgtgcgtacgcgtaccaaccttgtacttacg

SEQ ID NO: 286180 - DNA, 619 bp, Homo sapiens
  misc_feature: GYAE6OF02HM6YX.4.57.F02.1.454.CMB.1.raw
  modified_base (197)..(197): a, c, t, g, unknown or other
  misc_feature (197)..(197): n is a, c, g, or t
  modified_base (271)..(271): a, c, t, g, unknown or other
  misc_feature (271)..(271): n is a, c, g, or t
  modified_base (277)..(277): a, c, t, g, unknown or other
  misc_feature (277)..(277): n is a, c, g, or t
  modified_base (414)..(414): a, c, t, g, unknown or other
  misc_feature (414)..(414): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccatcctccctgtctgcatctgtggganacagagtcatcatctcgtgccggcagtcagtagtgttagttatttaatttaatgtatcatacaacgaggaaacnccctancctctgtatctatgctgactactactaagttaaccgaaggtacgggtaccctaagtacaaagtactacgtacgtacggtcgtaaggtcggacttacggtagggtactacgttactttactacttaccgtactacctntactacgtacgtacttaacgaaccgtagtaacgttagttttacgacttaaaccttaccttacttactacgtaaataccggtacgttaccgtacccttaccctccgaccttacttacggtttcgggaccggtacgggtacgtaacgggtcgaacgtacgtaacgtaaacggtcgtacgtcggaccgttcgtaactcgtacgttacc

SEQ ID NO: 286181 - DNA, 723 bp, Homo sapiens
  misc_feature: GYAE6OF02HOTQ1.4.57.F02.1.454.CMB.1.raw
  modified_base (103)..(103): a, c, t, g, unknown or other
  misc_feature (103)..(103): n is a, c, g, or t
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (264)..(264): a, c, t, g, unknown or other
  misc_feature (264)..(264): n is a, c, g, or t
  modified_base (278)..(278): a, c, t, g, unknown or other
  misc_feature (278)..(278): n is a, c, g, or t
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
  modified_base (490)..(490): a, c, t, g, unknown or other
  misc_feature (490)..(490): n is a, c, g, or t
  modified_base (622)..(622): a, c, t, g, unknown or other
  misc_feature (622)..(622): n is a, c, g, or t
  modified_base (699)..(699): a, c, t, g, unknown or other
  misc_feature (699)..(699): n is a, c, g, or t
tcagagcactgtagcacgaccggtgctcgatttagctcgatatagttgggtttgggggccagtctcagtcaggacacagcatggacatgacgggtcccgctcngctcctggggctcctgctactcgtggctaccgagatgccagatgtcgacaccagatcgaccacgtctaccctatcccgttccctgttctcgaaccngttctggggagganaccgaagtacggtctacgtactcgtctttccgcggacccgggataaccgtnaagggttaaggttntttaaggtttatttttaagtttaaagtttcggtaattacgtactttaaccgaaaacgtaacgggaaaccgtacccgtaagcccttaccngtactactgtntccgactctaacgtaccttagttaacggtaacggttcgggtcctagaactagtactttgacggttagaccgaagtcggttacgtacgtgggaacctcggttaactttacccncgtactacctaacgtactacgtacgttacgtacgtaaccgtacgttaacggttaactttacgttacgtaaccttaaccgttaaccgtacgtacgaaataacggtaagttaaccgttacccgacccttacccnccgttaccgtacgttaccgggtacggacggtaaccggtaacggtacggtagaacgtaacgttaacgtaaccgtcggngcggtactccgacacgtctgttcg

SEQ ID NO: 286182 - DNA, 747 bp, Homo sapiens
  misc_feature: GYAE6OF02ICW09.4.57.F02.1.454.CMB.1.raw
  modified_base (285)..(285): a, c, t, g, unknown or other
  misc_feature (285)..(285): n is a, c, g, or t
  modified_base (462)..(462): a, c, t, g, unknown or other
  misc_feature (462)..(462): n is a, c, g, or t
  modified_base (738)..(738): a, c, t, g, unknown or other
  misc_feature (738)..(738): n is a, c, g, or t
tcagagcactgtagcacgaccggtgctcgatttagctcgatataggttggggtttggggagccagtctcagtcaggacacagcatggacatggacgggtccccgctcagtcctccgtgggggcctccgtgacctactcgtggcctccgagagtcgacctagagtcgcaccacccagtactccgacctagtcctccacttccctcctacgtctcgactacgtcgtgggtagggacaagaggtactacctactcgtaacttcgtccggtcggaccgggtagaacgtnaaggttcggttaagttaagtttaagttttaaagttaaacgttgtaacttacgtaagtaaaccaaaccggaacggtaaccctacctaggtctaccgagttacctagtagtcgctagtacctataccgttaagtaaccgagggttacccgtacaaacgtgtaaacgtacgtacgacggngtaacgtaggtcggtaatcggtacggtaaactcgttttccttactaacgttcccgttaccaaaacgttcgtacggtaaagtttacccgaaaccttaaacgtaacgtagttaaagtttacttacccgaatttaaccgttaaactgaaccgtacttaaaggaccgttactaaccgacctcccgatcttaccggagggttccggaaggtaccggaaggtacgaaggactaaccgggtaattacccggtagtacgggttccgacttaccctacgttaccngttaacccg

SEQ ID NO: 286183 - DNA, 792 bp, Homo sapiens
  misc_feature: GYAE6OF02I7M9P.4.57.F02.1.454.CMB.1.raw
  modified_base (147)..(147): a, c, t, g, unknown or other
  misc_feature (147)..(147): n is a, c, g, or t
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgngacacccagatcgacccagtctccatccctccctgtctgcatcgtggnggagacngagtcatcatctcgtcgcggacaagtcagagttgttattatttaatttaagttgtatacgtagttacaaaccgtaaggaacgtaccctaagccttacctagtactactatcgtctcgactactacgtaagtttaacgaaacggttcgggtaccctaagtacctaaagtacttcgtaaggtcggtataggtaacgacgtttcggaacggggtaactacggtaactttaccgaacccgttactaccctaacgtacggttaacgtaacggtttaaccgtaaaccgttaccgtaaaacccgtaggttaaaactttacgtttttaaaccgtaacccggtttaaaccctttaaccggttaacgtttacccttaaaacggtaaacccgttaaaagtaccggttttaaaccccgttaacccttaaccccccggttacgttaccccgttaaaccgtttccggttaaacccgggggttcgggaaaaccggggttaaccggtaaacgggaaccggggtttaagaaaccggttaaacccgaaaaccggttagttacgggtaacggttaccgttcggtaaccgtaccgttaaccgtttacccg

SEQ ID NO: 286184 - DNA, 658 bp, Homo sapiens
  misc_feature: GYAE6OF02GPA4U.4.57.F02.1.454.CMB.1.raw
  modified_base (263)..(263): a, c, t, g, unknown or other
  misc_feature (263)..(263): n is a, c, g, or t
  modified_base (288)..(288): a, c, t, g, unknown or other
  misc_feature (288)..(288): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgaaccagtctccatccctccctgtctgcctatcgtggtgggagacagagtcatcatctcgtggccggacaagtcagagttgttaagttaatttattaagtggtatnagtacaaacgtaggaacacccgtanctctagatctatcgactgactagttactaagttacgaacggtcggacctatacaagtctcgaggtcgacaggtcgagtacgcgggactagtactttctactctacgacctacgtacttacgtaacgtactaaccgtaactacggtaaattactttacgtaactaaccgtttactaacgtacgtaaactaacggttaacgtaacgtttacccgaacccttacccccgtacgttacccttaacggttaccggttaacggggaccggggtaaccggtaccgggtaagggttacggaaacgttaacgaacccggtaaaccggtagttaccgggtaccggccttaccggaacccttaccgtacgttcgttacccg

SEQ ID NO: 286185 - DNA, 660 bp, Homo sapiens
  misc_feature: GYAE6OF02IAPF0.4.57.F02.1.454.CMB.1.raw
  modified_base (127)..(127): a, c, t, g, unknown or other
  misc_feature (127)..(127): n is a, c, g, or t
  modified_base (246)..(246): a, c, t, g, unknown or other
  misc_feature (246)..(246): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
tcagagcactgtagcacgaccggtgctcgatttagctcgatatagttggggtttggggccagtctcagtcaggacacagcatggacatggacgggtccccgctcagctcctggggctcctgctactntggctccgagatgccagtatgtacgaccacccgagatcgaccctagtcctccactccctccctgtctgcctatcgtaggtgggaacacgagacgtccatctattctcgtcggccggtanagtcaggtagtagttagttatttaagtttaatacggtatcgtacgttaacgaaacgtaggaacctaccccgtaancctccgtatactactagtnctagtacctacgtcttaacgttaagaacggtcggtacctagactagtatacgaggtcgcgtagtcggctcgtaggatacgtacttactacctacacctactacgtacgtaagtaccgttactaacgtaacgtagtaagtttattacgtactaacttactcgtaacgacacgtagtaacgtacctacccgtaccccgtcgttacctaccgttccggtaacgggccgggtaacggtaccgagggtacgaacggtaaccgttaacgaaccggttaaccgtcgggtacgtacggtccgtaaccgtacgttaccgtacctttacg

SEQ ID NO: 286186 - DNA, 796 bp, Homo sapiens
  misc_feature: GYAE6OF02I1TYB.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagtatcgccagatggtgaccacccagactcgaccctagtcctacctactccctcccttgtactgacctagttcgtggtagggacaacgtagtagtacaagtactacgttccgtacgttccgggacccgggtaactaacggttaccaaggtttaaggtttacggtttaaagtttaacgttttttaaatttttaaaagtttcgggttaaattacccgttaacgtttaaaccccgaaaaaccggtaacgggtaaacccgtaacccccgttaaggtaccccgtttaccgtagtaccttacgttaacgttcgtaccgtacgtacccgttaacttaccggtttaacggtttaaacggtaaccggggttcccggtaacccaacgttaaccgtaacgttacttacggtaggttacggacgtaaggtcgtagtaccgacggtatacgttacttacactccactaactctacgtagttacttaccgaactaacgtagtaagttcttacgaacttactacgtactacgtacaaagttacgtacgtaaccttacccgtaccgcgtaccttacgttaccgggtaccggaacggtaccgggtaacgtaaggggtactaacgtaaactaacggaaccttagggtaccgtccggagtaccacgttacctaggttaccc

SEQ ID NO: 286187 - DNA, 751 bp, Homo sapiens
  misc_feature: GYAE6OF02FTBGX.4.57.F02.1.454.CMB.1.raw
  modified_base (117)..(117): a, c, t, g, unknown or other
  misc_feature (117)..(117): n is a, c, g, or t
  modified_base (688)..(688): a, c, t, g, unknown or other
  misc_feature (688)..(688): n is a, c, g, or t
tcagagcactgtagcacgaccggtgctcgatttagctcgatatagttgggtttgggggccagtctcagtcaggacacagcatggacatgagggtccccgctcagctcctgggctccngctactcgtggctccgagatgccagatgtacgacacccagatcgacctagtttcccactcccttacctgtctcgcactcgtggtacgggacacgagtagtcaactcacgttccgtcgttcggacccgggactaagtacgaaggtgttacgtttaattaacgtttaatttaaagttggttaactacgttacgtaaccgaaacgaacggggtaacctaccccttaacgtccttccgtaacggtcttactacggtacgtctacggtacaacgtttactaaccggtttaacgaaacgggttcccggtacctaagtactaaacggtacttaccggtaaggtccgtacggttagtacgtaaccgttagggaacggtctaaacggtacctttaaccgaccttacgtaaccctaacgtcggttaaacgtcgttacgtttaaccgtaaccctaggttaaccgtaagtttaccgtttaaacgtaacctttaacttacctaacgttaccgtactaaacgtacgttaacgtaccgttaactaccccgtcgtaccttacggtaccgtcggacgtaccggtacgngtacgagtacaaaccgtactaacgtcgtaaccgcgtacgaccttacggaccttggtccttacg

SEQ ID NO: 286188 - DNA, 734 bp, Homo sapiens
  misc_feature: GYAE6OF02H3KDC.4.57.F02.1.454.CMB.1.raw
  modified_base (200)..(200): a, c, t, g, unknown or other
  misc_feature (200)..(200): n is a, c, g, or t
tcagagcactgtagcacgaccggtgctcgatttagctcgatatagttgggtttggggagccagtctcagtcaggacacagcatggacatgagggtccccgcttagctcctggggctcctgctactctggctccgagatgccagatgtgacacccagatgacccagtctccagtcctccctgtctgctatcgtggtggganacagtacgtcatcatctcgttcggccggactagtcagtagttgttattattttaatttaaagttggttaactcgtaagttaccaaaccggtaacgggaaacctaccccgtaagtccctactacggtacttactagtcggtactgacctacttaccgttaagttaaacgaacgggttcggtacctactacgaagtacttagacgttcggagtacggtagtacgtacggtagggacttacgtaactttcgtaccttaccgtaccctaacgtagtaccgtaagttaccgttacctaaaccgtaaaccgtaacggttagttaacctttacgtaaccgttaaaccgttacttacgttacgtaaccgaaacgttacgtaacggtttaaccctaccgttaaccccgtcgtaaccccttagtttacccggtacgggtaccgggtaacgggtacctaggggtaaccgtaaggtaaccgtaaacgaaaccggttacgttaggtccggttacgtaaccggtaccgtaccttccgtagttacccgg

SEQ ID NO: 286189 - DNA, 814 bp, Homo sapiens
  misc_feature: GYAE6OF02HS7N5.4.57.F02.1.454.CMB.1.raw
  modified_base (174)..(174): a, c, t, g, unknown or other
  misc_feature (174)..(174): n is a, c, g, or t
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
tcagagcactgtagcacgaccggtgctcgatttagctcgatatagtttggggtttgggggccagtctcagtcaggacacagcatggacatgacgggtccccgctcagctccgtggggctcctgctactcgtggctccgagatcgccagatgtacgaccacccagatcgaacccngtcctccactccctccctgtctcgcatcgtggtaggganacgagngtacatcatctcgtcggccgggactaagtcgagtagttaggtttaagttattttaaagtttaaagttggttactcgtaagttaaccgaaaaccggagggaaacctcccctaagtccctcgtaagtctaccttagtccgtcgtacgtacctaacgttaccgttaaacggtttaaacggaaaccggggttccggaccttaactaaacgtaaagttcgtacggtacggtggtaacgaggttacgggtattccgggagggtaaccttagttaacttttccgaaccgttacctaaccgtaaccgttacgtaaccgttaaggttaacccgttaacctaaacccggttaaaccttaaggttaaggtttaaccgtttaactaaccgttaaacttttaacctacggttaagtaacctaaaacggttacgttaaaccgttaacccgtacccttaaccccggtccgttaccgttacccgtacgggttcccggggttaacggggaacgggttaacccggtaaggggtaccggaaacgttaccggtaaacgtaaacggttaacgtcgggtacgtaccgtacggtaacccgtacgtacgttcgttaccg

SEQ ID NO: 286190 - DNA, 796 bp, Homo sapiens
  misc_feature: GYAE6OF02GN5F8.4.57.F02.1.454.CMB.1.raw
  modified_base (239)..(239): a, c, t, g, unknown or other
  misc_feature (239)..(239): n is a, c, g, or t
tcagagcactgtagcacgaccggtgctcgatttagctcgatatagttgggtttgggggccagtctcagtcaggacacagcatggacatggagggtccccgctcagcctccgtggggcctcctgctactctggctcgagatgccagatgtgaccaccagatcgaccagtctccactccctcctgtcctgctatcgtggtgggacacgagtagtcagtctactccttctcgggacccgganaacggttcgaggttaggttagtttaagttaatttttaagtttaagttggttaacttactaacgttaaccgaaaccggtaaggggaaaccgtccccgtaagtcccttccgtagttactcttaacggtctacgtacgtactaacgttaccgttaaggttttaaaccggaacggtttcccgggtaacctaacgttacggtaaacgttaccgtttacggacggttaggtacgtacgggttaggttaacggtaacggtacggggtaactaacggtttacctttaccaccttcccgaacccttaaccgtacgttacctacggttaaccgttacttaaacccgtaacggttaccgtaagtttaccgtttaacgtaccttaaaccgttaccgttcgtaacgtttacctaacggttaactaagtttccgaaaccgtttcccctaacccgttcgttacctacgtaaccgggttccggaacgggtaccgtacggtaacggtggtaaacctacggtaaaccgttaacgtccggttaggtaccgacgtacgtaacccgtatttccgtccg

SEQ ID NO: 286191 - DNA, 824 bp, Homo sapiens
  misc_feature: GYAE6OF02HWLUA.4.57.F02.1.454.CMB.1.raw
  modified_base (314)..(314): a, c, t, g, unknown or other
  misc_feature (314)..(314): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtcctaccatccctccctgtctcgactatcgtggtgggacgacaggacgtcattccattccgtcgttcggccggactaacgtcgagtagttagtttagttaattttaatttaaagtttggattacaagttacaaaccgagggtaaaccncccttaagcctacctagacttctacgtagtcctacgtctaacgttacctaacgtttaacgaaacggggtcggtaccctaacgtacgtaaacgactttcgaggttcggacgtacggtagggtactaggtacgggtaacgtacggttaacttttcctaaccgttcctaaccgtaccttaacgtaccttaaacggttacgttaaacccgttaacctaaaccggtttaaggtaaacgtttaaaccgtttttacgaaacccgtttaaaccctttaaaccgttaacgtttaaccggttaaccgtaaaacggttaacggttaaacccggtttaacccgtaacccttaacccccggttacccgttaccgttaccgttaacccgggtttttaccggggacccggggttaaccgggtaaccgggtaaaggggtccgggaaacgttaacccgttaaacggaaacgttaaccggtacgttaccgggtacggtttccgaaacccgttaccgtaggttaccccg

SEQ ID NO: 286192 - DNA, 827 bp, Homo sapiens
  misc_feature: GYAE6OF02HUFOU.4.57.F02.1.454.CMB.1.raw
  modified_base (201)..(201): a, c, t, g, unknown or other
  misc_feature (201)..(201): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatcgccagatgtgaccacccagatcgaccctagtcctaccatccctcctgtcgtgcctagtctggngggtacgacaggtagtcaatctacttcctacgttcgaccgggtactaagtacaggtagttacgtttaagttattttaaatttaaacggttggttaactcgttaaaccgtttacccgaaaaacggtaacggggtaaaccctacccccgttaacgaccgttacccgtagtaacgttacgtacgtaacggttcgtaccgtacctaaggtttacccctttaaaggtttaaaccgtaaaaccggggttccggggtaaaccccttagtaaaccgaaagtttacctagtagggtacgaggtaacggggtaggcgtttaccggtaagggtacgttaaggtactttaccgccttacctaaccgtaaccctagttacctaacggtaacgttaacctaaccgaaccgttacgggtaaagtttacgttaaccggttaaccttaaccgtttaccgtaacttaagaacgtaaccgtaaggttaaactaacccgtaaccctaccccgtaaccgtccttaaccggtaaccggttaccggacgggtaaccggtaacgtagggtaaccggagtaaactaccggaaaccgttaacgtcgggtaaccgtcgtaaccggtactaacccggttagttacccgttaacg

SEQ ID NO: 286193 - DNA, 826 bp, Homo sapiens
  misc_feature: GYAE6OF02I3ABP.4.57.F02.1.454.CMB.1.raw
tcagagcactgtagcacgaccggtgctcgatttagctcgatatagttgggtttggggagccagtctcagtcaggacacagcatggacatgagggtccccgctcagctccgtggggctcctgctactctggctccgagatgccagatgtagaccacccagactcgacccagtcctaccatccctcccgtgtcctgctacttcgtgggtagggactaacgagtacgtctatctattccttcgttccggccgggactaagtcgaggtagttgtttaagttattttaattttaaacgttggttatactagttacaaaaccgacgggaaacgtcccctaagtccttaccgtgacttactagtcgtactcgactacttaccgtaagttttaaccgaaagggttccgggtaccctacgttaacgtaaacgttacgttacgtaggtcggtacgtaggtaggtagttacggacgggtaaccgtaaggttaacctttcgtacccgtttctaccctaaacgttcggtaaccgttacgttaaaccggttaacccttaaccgtaaacccgttagtaaacgttttaccgttttagtaacccttaaaccgtttaacccgttaacgttcgtaaaccgtaaaacggttaccgggttaacgtttaaaccccgttaaccgttccccccgttaccgtttaaaccgttacccggtttaacggttacccgggggtacgggaacggttaaccgggtaaaggggttacggaaacggtaccgtaaaccggttaaaccgttacggttacgggtacggttaccccgtggtaaccctaccggttagtttacccg

SEQ ID NO: 286194 - DNA, 748 bp, Homo sapiens
  misc_feature: GYAE6OF02JWEDN.4.57.F02.1.454.CMB.1.raw
  modified_base (167)..(167): a, c, t, g, unknown or other
  misc_feature (167)..(167): n is a, c, g, or t
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
tcagagcactgtagcacgaccggtgctcgatttagctcgatatagttggggtttgggggccagtctcagtcaggacacagcatggacatgacgggtcccgctcagctcctggggctcctgctactcgtggctccgagatcgccagatgtgaccacccagatcgaccngtcctccactcctcctgtctgcatcgtggtaggganaccagatcactctatcgtcgttggaccggnagtacagtagttnttagtaatttattaagttgtatactagtaacaacggaggtaacaccgtacgtctcctagtactagtactcgtctacgtctaacgttccttaaaggttaacggtaacggttaccggggtacctaacgtaacgttaaacggtacttacggtaagggtcgtaacggtaggttacggtaagtcgtagggtaaactacgttacctttacgtaccgttactacccgtacgtaacgtacggtacgtttaacgtaccgtaaaccttaacggtagttaaacggttcgttttaaagtaccctttaaaaccttacgttaaccgtaccgttaacgtaaaccggtaagttaaccgtttaaccctaccccggttaaaccccgtccgttaacccgttagtttaccccgggtaacgggtaacggggaacccgttaagtaccgggtacggtaacggtaacgttacgaaacgtttaggccggtttacgcggtaaccgtcctaaccgtacgtttcgtaccg

SEQ ID NO: 286195 - DNA, 836 bp, Homo sapiens
  misc_feature: GYAE6OF02H8L88.4.57.F02.1.454.CMB.1.raw
  modified_base (550)..(550): a, c, t, g, unknown or other
  misc_feature (550)..(550): n is a, c, g, or t
tcagagcactgtagcacgaccggtgctcgatttagctcgatatagttggggtttggggagccagtctcagtcaggacacgagcatggacatggagggtccccgctcagctccgtggggcctcctgctactctggctccgagatgccagatgtcgaccacccgagatcgaccctagtcctcctactccctccttggtctcgacctagttccgtaggtagggaacgtaacgaacggtacggtactacgttctaacttccgttccgggtttacgggccggggtaactaaaccgggttcaaacgggttaggtttacggttttaaagttttaaagtttttaaacgttttaaaaggttttacggtaacgttaccttaaacggtttaaccgaaaacccggtaacgggggtaaaacctaaccccggtaaccgggtacccttaccggttaacggtacttacctaaagttcgtccggtttatacccgttaacttaacccgttaaaggtttaccgaaccgggggttccggtaccctaagtaaccgttacgtagtttaccgnggtaaacgtcgaaggttcgttagacgtagggactagtttcggtctaccgtactaccgaacctataccgtaattaccgtacgttaaccgtaacgttacgtaacgttacgtttacaacgttacgttaacctagtacgttaacgtacgttaacggtaccgttaaccgtaccttacccctaccgttcgtaccgtaccgttacggggaccgtaacgggttaccgtacgggtaagaaccgttaataaacgtaccgaaggtcggtacgtccgtagtaacctccgtaagttccg

SEQ ID NO: 286196 - DNA, 618 bp, Homo sapiens
  misc_feature: GYAE6OF02FJXR3.4.57.F02.1.454.CMB.1.raw
  modified_base (197)..(197): a, c, t, g, unknown or other
  misc_feature (197)..(197): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
tcagagcactgtagcacgaccggtgctcgatttagctcgatatagttgggtttgggggccagtctcagtcaggacacagcatggacatgaggtccccgctcagctcctgggctcctgctactctggctccgagatgccagatgtgacacccagatgacccagtcctccatccctccctgtctgcatcgtggtggganacagagtcatcatctcgttcggccggganaagtcgagtgttagttagttatttaatttaaagttgtatctagttaccaaacgaggaacnccctaagctctgatctangctnctatccgtaagttaacaaggtcggtccatacaagtctcgaggtggctagtcgatcggaggtactagtattaccnctaccgtacaccgtatacgtacgtacgtaccgtaactacgtagtaacgttattcgacttaacttactactagtaaccagtaacgtacgttaaccgaccgttacccctacgttcctaccggtttaccgttacggggacccggttaggaccgtagggtaacggtaacgaccgttaaaccggaacggttaccgttggtaccggtctaaccgtaccgtaaccttaccgtacgtttacccg

SEQ ID NO: 286197 - DNA, 758 bp, Homo sapiens
  misc_feature: GYAE6OF02HY8Q8.4.57.F02.1.454.CMB.1.raw
  modified_base (179)..(179): a, c, t, g, unknown or other
  misc_feature (179)..(179): n is a, c, g, or t
tcagagcactgtagcacgaccggtgctcgatttagctcgatatagttgggtttggggagccagtctcagtcaggacacagcatggacatgagggtccccgctcagctctggggctcctgctatctggctccgagatgccagatgtgaccacccagatgacccagtctccatcctccctntctgctatcgtggtcggagtacagaagtctattcattcctcgttcggccggactaaggttcaagtacgttagtttagttaattttaagtttaaagttgttattacgtaagttaaccgaaaccggaaggtaaaccgccccgttaagtacccgtaccttaggaacttccgtaacggtctaccgtacgcctaacttaccgttaacggttaaacgtaacggtttcgggtaccctagtaccaagttacttacgtacggtcgacgttaaggtacggtaacgtttcgggacggtaacgtagttaccgtttacaccgttcctactaaccgtaactaccgttaagttaccgttaacctaaccgttaaccggttacgttaaacgttacgttttacgaaaccttttaacgttaacccgtacgttaccggttaactaaacgttacggttaaaccgttaccctaaaccgtcccctttacccgtaccttccggttaccgtttcgggaaccgggtaccggtaaccggtaagggtacggtaacgaagtaacgtaaccgtaggttcggtactaccggtaccgtacttacgcttacg

SEQ ID NO: 286198 - DNA, 742 bp, Homo sapiens
  misc_feature: GYAE6OF02GS0VQ.4.57.F02.1.454.CMB.1.raw
  modified_base (196)..(196): a, c, t, g, unknown or other
  misc_feature (196)..(196): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatgacccagtctccatccctcctgtctgcatctggtgganacgagagtcatcattcctcgttcggccgganaacgtcgaggtagttgtttagttaagttttaatttaaagttggtatactagttaccaaaaccgagggtaaaccncccgtaagcctaccgtgactctatcgctgactacttaccgttaagttaacgaaacggttccgggtaccctaacgtacgtaaagtacttacgaacggttcggacgtagggtaggtacgttcggtacgggtaacgtagttaacctttacgtaaccttaccgtacctaaaccgtgtaaccgttacggttacgttaacctaaaccgtaaccgttaaggttaaacgtttaacgttttaaccgaacctttaaacccgtttaaccgttaacgtttaccgtaaactaaaccgtaacggttaaccgtttaacccgtaacccgttaccccgttaccgttacccttaccgttaccggttaccgggtacgggacggtaacccgtagggtacggaacgtaaccgaacgtaaaccggtacgtacggtcggtaccgtcgaccgtactacgttaccg

SEQ ID NO: 286199 - DNA, 699 bp, Homo sapiens
  misc_feature: GYAE6OF02JUO1G.4.57.F02.1.454.CMB.1.raw
  modified_base (204)..(204): a, c, t, g, unknown or other
  misc_feature (204)..(204): n is a, c, g, or t
  modified_base (218)..(218): a, c, t, g, unknown or other
  misc_feature (218)..(218): n is a, c, g, or t
  modified_base (236)..(236): a, c, t, g, unknown or other
  misc_feature (236)..(236): n is a, c, g, or t
  modified_base (319)..(319): a, c, t, g, unknown or other
  misc_feature (319)..(319): n is a, c, g, or t
  modified_base (328)..(328): a, c, t, g, unknown or other
  misc_feature (328)..(328): n is a, c, g, or t
tcagagcactgtagcacgaccggtgctcgatttagctcgatatagttggggtttggggagccagtctcagtcaggacacagcatggacatgagggtccccgctcagctccgtggggctcctgctactctggcctccggagatcgccagatgtgaccacccagactcgacccagtcctccactccctcctgtctgctatcgtggngggagacagacgtnactcatctcgtgccgganagtcagtagtgttagttatttaagttaattgtattacagtacaaacgtaaggaacgaccctaacgtcgtctacgtactagtcngtctcgtanacttacgtaacgtttaacgtaacggtccgggtaccaagttaacgaacgttagttacgtaggtaggtacaggttacgtagtcggtacgtaggtaacttacgtcctacgtacccgactactaccgtacgtaagtccgtttaacaaccgtaacgtaagtacgttacgttttaaccgactttaaccttaacgttacttaccgtaaccgtaagtacgttaaccgtaccgtaacccgttcccgtccgtaaccttaccgttacgggttaccggggaaacccgggtacggtaaccgggttagggaacggttaacccggtaagaaccggttaacggaacggttcgtaacgggttccgagtacccgttacgtacttcccgg

SEQ ID NO: 286200 - DNA, 804 bp, Homo sapiens
  misc_feature: GYAE6OF02JNCGG.4.57.F02.1.454.CMB.1.raw
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtcgacaccagatcgaccagtctccactcctccgtgtctcgacatcgtggtacggacgacaagacgttcattacgaacgttccttacgttcggacccgggtactaaacggtcgaggtaacggtttagtttaagtttaacttttaagttttaaagtttggttaacttactacggttaacctaaaaccggacgggtaaaccgtacccgtaagtccttacgttacgtacttaccgtaattcgccgtacgtactacccgtttaacgttaaccggtttaacgtaaaaccggggttcgggttacccctaagtaaccgtaaacggtttagttaccggtaagggtcggtacgggttaacgttaacgggaacgttcggttaacgggaacttaacggtttaacctttaccgtaccgttaaccgtaccgtaaaccttacggtaacttaacggttaaccgttaaaccttaaccgtaacggttaacgttaagtttacgtttaaacgtaaccgtttaaccgtttaactacggtacgtaacctaaacggtacgttaactaccgtacccttaaccccgttcctacgttaccgcgttaccggacgggtacggaacgtggtacgaactaacgaacgtaccgtagttaccggtgacttcgaacccttactcgttaacg

SEQ ID NO: 286201 - DNA, 604 bp, Homo sapiens
  misc_feature: GYAE6OF02I97N3.4.57.F02.1.454.CMB.1.raw
  modified_base (179)..(179): a, c, t, g, unknown or other
  misc_feature (179)..(179): n is a, c, g, or t
tcagagcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgaccagtctccatcctcctntctgcatctggtggagacagagtcatcatctctgccggacagtcagatgttagtatttattaaattgtatcagttacaaacgaggaacgacccctaagcctctgatcgtatgctgacatcctacgtttaacaagggttacgggtaccctatacgaactaacgttacgtaagtggacctagggtacgattcgtaggggacttaagtactttacacgtacctacgaccaacgtactagttagaccttaaacaaccgtagaagtttatttacgtaacttaaacgttacttactacgtacaaacgagtaataacgtacctaccctacctaccgtactaccgttacgggaccggtacggacgtaagggtggaaacggtaataaaccgtaaacgtaccgtacggtcggtacctggaaccacctacgttccg

SEQ ID NO: 286202 - DNA, 821 bp, Homo sapiens
  misc_feature: GYAE6OF02IFQ4H.4.57.F02.1.454.CMB.1.raw
  modified_base (203)..(203): a, c, t, g, unknown or other
  misc_feature (203)..(203): n is a, c, g, or t
tcagagcactgtagcacgaccggtgctcgatttagctcgatatagttgggtttgggggccagtctcagtcaggacacagcatggacatgagggtccccgctcagctcctggggctcctgcctactctggctccgagatgccagatgtgaccaccagatgacccagtcctcactcctccctgtctgacctatcgtggtaggganacagacgtacatcattctcgttcggaccggactaagtcaaggtagttggtttaagttaacttttaagtttaaaacgtttggttaacttacgtacgtttaaccgaaaaccgaaggggtaaacgtcccccgttaaaaggtcccttacccgttaggtaactttacgtaagttcggtacctagtaccgtaacgttacccgttaaaggttttaaaccgaaagggggtttcccgggttaacccctagttaacccgaaaggtcttttaaccggaggttacggacgtaaggtacggtactacggtaagggaacgtagttactttaccgaccttcgtacctaaccgttaagtacgtaaggttactacgttaaacctaaccgtagttaaacgttggtttacaacttaacgtttacctaacgttacgtaaactaacgtacggttaaccgttaaccgtaacccttacccgttaccgtactttaacccgtaccgggttttacggaacccgggttaacggtacccggtaaggggttaccgaaaggttaacccgtaaaccggttaaaaccggtaccgttaagggtaccgggtacttacccggaacccgtacttaccggtttcgtttaacccgg

SEQ ID NO: 286203 - DNA, 819 bp, Homo sapiens
  misc_feature: GYAE6OF02FOROD.4.57.F02.1.454.CMB.1.raw
  modified_base (203)..(203): a, c, t, g, unknown or other
  misc_feature (203)..(203): n is a, c, g, or t
  modified_base (812)..(812): a, c, t, g, unknown or other
  misc_feature (812)..(812): n is a, c, g, or t
tcagagcactgtagcacgaccggtgctcgatttagctcgatataggttgggtttggggagccagtctcagtcaggacacagcatggacatgaggtccccgctcagctcctggggctcctgctactctggctccgagatgccagatgtgacacccagatgacccagtctccactccctccctgtctagctatcgtggtgggaanacgagacgtcagtctattcgtacgttcggaccggactagtacgagtaggttgtttaagtttaattttaaacgttttaaaagttcgggtttaacttaccgttaagtttaaccccaaaaaccgggtaaggggtaaaaacccgtcccccgtaaaagggttcccttaccctaggtaaccttacgttacggtacgcgttaccggacttaaccttaccgttaagttttaaccgaaaacggggttccgggtacccaagttaccaaaggttacgttcggtaaggtaggtaacgtaaggttacggagttccggtaagggaaactcgtttaaacgttcccaaacgtttccgtaccgaaccgttagtacggtaacgttaaccggttaccctaaaccggtacttaaggtaaacgtttaggtttactaaaccttaaaccgttaccttaacgtacgttaaaccaaacgtaacggttacgttaaaccggtccccttaacccgggtacctaaccgttacctaaccggggtttacggaaccgggttacgggaacccgttaagggtacggtaacctaacgtaaaccgaacggttacctagggtacgtaccgttacgaccttaccgtnttacccg

SEQ ID NO: 286204 - DNA, 650 bp, Homo sapiens
  misc_feature: GYAE6OF02IV1CB.4.57.F02.1.454.CMB.1.raw
  modified_base (347)..(347): a, c, t, g, unknown or other
  misc_feature (347)..(347): n is a, c, g, or t
  modified_base (386)..(386): a, c, t, g, unknown or other
  misc_feature (386)..(386): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgacacccagatgacccagtctccatcctccctgtctgcatctggtgggagacagatcatcatctcttcgccggacaagtcagagtgttagtatttaatttaaattggtatctagttacaaacgaaggaactaccctaagctctgatctatgctgtcactctaagttaacgtaaggtgggtaccatacaagtattcgagtgngtaacgtggatacgtaggactagtacttcgtactcctanacctaagtctaagtacgtactaacaacgtagtaagttattacgactaacgttaactacgtagttaccaaactacgtaacgttacgaaccttaccccgtaccgtaacgttccgttaaccggtttccgggaacgggtacgggtaacccggtaaacgggttacggggtaaaacttaaccggaaaccgttaaaaaaccggtaaccggtttcggtaaacgggtcctaaccgggtaacctaaacccggttacgtaccggttttaacccgg

SEQ ID NO: 286205 - DNA, 1001 bp, Homo sapiens
  misc_feature: GYAE6OF02G4XDQ.4.57.F02.1.454.CMB.1.raw
  modified_base (209)..(209): a, c, t, g, unknown or other
  misc_feature (209)..(209): n is a, c, g, or t
tcagagcactgtagcacgaccggtgctcgatttagctcgatatagttgggtttgggggccagtctcagtcaggacacagcatggacatgagggtccccgctcagctcctggggctcctgctactcgtggcctccgagatgccagatgtgaccacccagatcgacccagtcctaccactccctaccctgtctcgctactcgtggtggganacgagacgtcactactacttcgttaccgtcgggcccggagtaacgtacgtaaggttagtttaggttttaagtttaaatttttaaaagtttaaagtttggttaacctcgttaacgtaacccgaaaacccgggaacggggtaaaccccgtaacccccgttaaggtcccctttaccgtacgtttacgttaccgttaccgtaggtccgttacaaccgtacctttaaccggtttaaaccgttttaaccgggaaaccggggttccccgggttaaaccctacgttaaacggttaacgttacgttcgggtaacgggttacgtcggtaacggtcggtacgttacggttaaacggacgttacggtttacctttaccggacctttaaccgtacccgtaaacctacggttaacgtaacggttaaacgtaacccttaaaccggtaaacgttaacgttaaacgttttaccgtttaaaccgttaccttaaaacccgtttacgttaaacccggtaacgttaaccgttaaacccggttaaaacgttaaacccggtttacccttaaaccccggtttacccccttaaccgggtttaaccccttttcccggggttaaaccgtttacccccggggggtaaaaccgggtaaaccccgggggtttaccgggaaacgggtttacccggtaaaaacggggtaccctttaaaaacccgggtaaaacccgggttacgggtttaaccggggtaaccgttaccccgttaaaccgggggttaaccccttaaccggtttacccggttttaccttaaccccggg

SEQ ID NO: 286206 - DNA, 791 bp, Homo sapiens
  misc_feature: GYAE6OF02F2WGX.4.57.F02.1.454.CMB.1.raw
  modified_base (180)..(180): a, c, t, g, unknown or other
  misc_feature (180)..(180): n is a, c, g, or t
  modified_base (196)..(196): a, c, t, g, unknown or other
  misc_feature (196)..(196): n is a, c, g, or t
  modified_base (763)..(763): a, c, t, g, unknown or other
  misc_feature (763)..(763): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccaccagatcgaccagtctcatcctcctgtcngcatcgtgtggagacngatcatacactctcgtcgccggacaagctagagttagttattaatttaagtttaaagttaggtacttacgtaacgttaaccaaaaccggtagggtaaaccaccccgtaagtccttaccgtacgtacgttaccgttaacgtgtacctaggtaccctaacgtaccgtttaagttaaaccggtaacggttaccggggttaacccaaacggttaccgtaaaggtaacgttttacccggaggggttaccgggtaacggttaacggttagggaacgtttacccgggtaaggggtaaacccgttaagtttaaccgtttaccgtaaaccttaccccgttaacgtaaccctaaacggtttaccgaaagggttttaaccggtaccctaaaacccgttaaaccgtaaggttaaacggtttaacttttaaccggaactttaaacctttaacccggttaaaccttcggtttaaaccgtaaacttaaggtaacgttaacccgtaaccttaccccgtacgttactaccgtaccggttcggaacgggaccggtacgtaagtcggaataccgtaacggtaaccngttacgtgacgtaccgactcgattgtac

SEQ ID NO: 286207 - DNA, 613 bp, Homo sapiens
  misc_feature: GYAE6OF02IEWDS.4.57.F02.1.454.CMB.1.raw
  modified_base (204)..(204): a, c, t, g, unknown or other
  misc_feature (204)..(204): n is a, c, g, or t
  modified_base (298)..(298): a, c, t, g, unknown or other
  misc_feature (298)..(298): n is a, c, g, or t
  modified_base (303)..(303): a, c, t, g, unknown or other
  misc_feature (303)..(303): n is a, c, g, or t
  modified_base (394)..(394): a, c, t, g, unknown or other
  misc_feature (394)..(394): n is a, c, g, or t
  modified_base (543)..(543): a, c, t, g, unknown or other
  misc_feature (543)..(543): n is a, c, g, or t
  modified_base (555)..(555): a, c, t, g, unknown or other
  misc_feature (555)..(555): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacaccagatgacccagtcctcactcctccgtagtctgcatcgtgtggagacaaggngtcagtcatctcttggccgggactaagtcagagtgttatatttattaaattgtatacagttacaaacgaggaaacgcctaagctctgatctatngtacncacgtcctaagttttaacaaaacgggtcggtacccaatcctaaaggtattacctaggttacggacgagttaccgggaattcgtacgggaangtttaacttctaacgttcactacgatacagtacgtacttacgaactaggtaacgtattttacgactaaacttactacgtgtacaaacgtaagacgttaacgtacttaccccacgttcctacgttacgttcggtaacggacggtaaccgnggttaaaggganaaccggtaacgtaaaccgtaaagtcgggtacgtactaccggtaccacctattaaccgg

SEQ ID NO: 286208 - DNA, 828 bp, Homo sapiens
  misc_feature: GYAE6OF02FK4R0.4.57.F02.1.454.CMB.1.raw
  modified_base (103)..(103): a, c, t, g, unknown or other
  misc_feature (103)..(103): n is a, c, g, or t
tcagagcactgtagcacgaccggtgctcgatttagctcgatatagttgggtttgggggccagtctcagtcaggacacagcatggacatgacgggtcccgctcngctcctgggctcctgctactctcggctccgagatgccagtatagtcgaccacccagactcgacccagtcctccacttcccctcccttcgtcctcgctacttcgtggtcgggaacgtaccgacggtatctaatccacttccttccgttacggcccggggtaactaacgtacgtaacggtaaggtttactttaacgtttaagtttttaaacgtttttaaaacgttttcgggtaacttaccgtaacgtttaacccggaaaaccggtaaacggggtaaacccgtaccccgtaacgtccccgttctaacgttacctacgttagtccgtacttcggaacctactaccgtttaacggtttaaccggaaccggttccggtacccgtaagttaacgaacgttacgttacgtcggtaggtaacgaggttcggtacgtcgggtacggtaactcgttaaacctttcctactaccgttacccaacttataccgttacgttactaccgtaacctaacgtaagttcgttttaacgttaccaacctttaacccgttaacgtacgttaagtaacccgtaacgttaaaccggttaaccttacccgaacccccgttacccgttcccaaccgttacctaaccgggttcgggaccggttaaccgacgggtaacggtgaaaccgtaacgtaacccgggtaaagtccggtacgttacgacgttaccgaccaccgtttacaggtttccc

SEQ ID NO: 286209 - DNA, 715 bp, Homo sapiens
  misc_feature: GYAE6OF02H552V.4.57.F02.1.454.CMB.1.raw
  modified_base (217)..(217): a, c, t, g, unknown or other
  misc_feature (217)..(217): n is a, c, g, or t
  modified_base (437)..(437): a, c, t, g, unknown or other
  misc_feature (437)..(437): n is a, c, g, or t
  modified_base (480)..(480): a, c, t, g, unknown or other
  misc_feature (480)..(480): n is a, c, g, or t
tcagagcactgtagcacgaccggtgctcgatttagctcgatatagttgggtttggggccagtctcagtcaggacacagcatggacatggacgggtccccgctcagctcctggggctcctgctactctggctccgagatcgaccgagtattgtcgaaccacccagatcgaccctagtcctcactccctccctagtctgctacttcgtagggtgggaanaccaaggacgtcaacttctacttcctacgttcgggccggactaaggtcaggtagttgtttagttatttttaattaagttgttaacgtctaaacgtacgtaaaaccggacgggtaaaccgtaccccttaagccttaccgtgttacttactacgtcgcgtcgacctacgttaccaagtttaaccgaacggggtcggtaacctatacgtaaagtcttggacgnggtagtacggtagtactggtacgggtactaacgttctttaccncctacgtaccaccgtactcgtaacgtacgttaacctaccgtaaaccgtagtaacgttagtttaccgtaacgttacctaacttacgtacaagtacgtaagtacgttaaccgtacctacccgaccgttccgttaccgtcggttacgacgggtaaccgtacggtaacggtacgtagtaacccgtaacgtaaccgtacgtacggtacgtacgtacgaacccgtactacgttccgttccg

SEQ ID NO: 286210 - DNA, 716 bp, Homo sapiens
  misc_feature: GYAE6OF02GKA8B.4.57.F02.1.454.CMB.1.raw
  modified_base (204)..(204): a, c, t, g, unknown or other
  misc_feature (204)..(204): n is a, c, g, or t
tcagagcactgtagcacgaccggtgctcgatttagctcgatatagttgggtttgggggccagtctcagtcaggacacagcatggacatgagggtccccgctcagctcctggggctcctgctactctggctccgagatgccagatgtgaccacccgagatcgacccagtcctccactccctccctgtctgctatcgtggtggganacagtacgtcatcactctcgttcggccggataagtcagtagttgttagttattttaatttaagttggtactactacgttaccgaaacgagggaacctaccctaagtctaccgtgtactacgtagtcgctcgactactaccttagttaacgaacggtcggtaccactactaacgtattcgagtggtactaggtgtacgtcgtacggtaactagttacttactactacctaccactactactacggttactacctaaccgaaccgttagtaacgtttcgttacctaacgttaaccttacgttaactacggtaactacgtacgttaaccgttaccgtaccccttaccccgttaccgtaccgttcccgttacccgggttaccgggaaccgggggtaaccggtacccggtaagggttaccggtaacggtaaccgttaaccgtaaaacccgggttacgttacgggttacccggtaccggtaacggtacccctaaccgggtttacctcccggtttaccg

SEQ ID NO: 286211 - DNA, 939 bp, Homo sapiens
  misc_feature: GYAE6OF02H6VNB.4.57.F02.1.454.CMB.1.raw
  modified_base (99)..(99): a, c, t, g, unknown or other
  misc_feature (99)..(99): n is a, c, g, or t
  modified_base (122)..(122): a, c, t, g, unknown or other
  misc_feature (122)..(122): n is a, c, g, or t
  modified_base (381)..(381): a, c, t, g, unknown or other
  misc_feature (381)..(381): n is a, c, g, or t
tcagagcactgtagcacgaccggtgctcgatttagctcgatatagttgggtttggggccagtctcagtcaggacacagcatggacatgagggtccccgntcagctcctgggctcctgctacnctggctccggagatcgaccagactgtcgaccacccgtagatcgaccctaagtcctccgacttaccctcccttgtctcgctacttcgtggtagggacaacgagtagtccgattacactcctttcggtaccggccggacgaactccgtaaggtaggttacgtttaaggtttaatttttaaaggttttaaaattcgggttaacgttacgtaaacgtttaaccgaaaaccggtaacggggtaaaaccgtacccccgttaaacnccctttaccgtacggtaagttcctacgttcgtccgtacgtacttaaccgttaacgttaaccggtttaaacggtaaacggtccggggttaacctaacggttaaccgtaaacgttaccgttacggtaacgggtacgggtcggtaacggttaacgggttaaccgttacggtaacggtaacggttaaacgttccgtttttaacccttaacccggttacctaacccgtaaccctaaccgttaccgtaaacggtttaacccttaacggtaacccgtaaaccgttaacggttaacggttttaacctttaacggtaaccctttaaaccgtttaaccgtaacccttaccgtaaaaaccgtaaccgtaaacgggttttaaccggttaacccccggtacccctttacccctaccggtttaacccgttaccgttaaaccgggttaccccgggtaacggtaaccgggtaaccggtggggtaaacggttaacggtaaccaaaaccggtaacccgtttacggttaacggtccgttaacgcccgttaaccgtccgtaccgttttacgtacccgg

SEQ ID NO: 286212 - DNA, 832 bp, Homo sapiens
  misc_feature: GYAE6OF02FH82T.4.57.F02.1.454.CMB.1.raw
  modified_base (166)..(166): a, c, t, g, unknown or other
  misc_feature (166)..(166): n is a, c, g, or t
tcagagcactgtagcacgaccggtgctcgatttagctcgatatagttgggtttgggggccagtctcagtcaggacacagcatggacatgaggtccccgctcagctcctgggctcctgctactctggctccgagatgccagatgtgacacccagatgacccagtccnccatccctccctgtctgcatcgtggtgggagacaggagtcatcagtccttgttcggaccgggctaacggtacaggaggttcgttaaggttaattttaacgttttaaaagtttggtaattacgtaagtttaaccaaaacccggaaggggtaaaccgtacccccgtaaagtcccttacccgtacggtaacttacctaacgtcggtacttcgacctaacttaccgtaagtttaaaccgtaaacggttcgggtaccctaagtaccgtaaagtaacctttacgacggttacggaccgtaaggttacggaacttcggtaaggggtaacctaggttaaaccttttcgaacgttccctaacgaaccgtacttaccgtaagttaccgtaaccctaacgtaccgtaaaggtaacgtttagtttacctaccgtaaacttttacgtaccgttaacggttaaacctaaacgttaacgttaccggttaaacccgtacccttaaccccccgtttaccgtccgttaaaccgtttaccgggttttacccgggaacgggggttacccggtaaccgtaacgggtaccgggtaacgtaaaccggtaaactaaacccgggttaacgtttacggtacccggttaccgttaacccggactaacccccggttagttttaccggtaacccg

SEQ ID NO: 286213 - DNA, 600 bp, Homo sapiens
  misc_feature: GYAE6OF02F682R.4.57.F02.1.454.CMB.1.raw
  modified_base (202)..(202): a, c, t, g, unknown or other
  misc_feature (202)..(202): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (438)..(438): a, c, t, g, unknown or other
  misc_feature (438)..(438): n is a, c, g, or t
tcagagcactgtagcacgaccggtgctcgatttagctcgatatagttgggtttggggagccagtctcagtcaggacacagcatggacatgagggtccccgctcagctcctggggctcctgctactctggctccgagatgccagatgtgacacccagatcgacccagtctccactccctccctgtctcgcactctggtggganacgagagtcatcatctcgttcggccgggtcaacgtcgaggtagtgttagttatttaatttaagttggtatctacgttacaaaccgtaggaaccncccgtaaagcctctgatctatgtctncactacctaagttacgaaggtcggtacctatacaagtacttacgaggtcgagtaaggtggtactgtagggactaagtctttacnctctacactntactagtactacaactacgtanagttatctacttaattactctagtactacaacgttataacttacgtacgacttcctacgtaccggttacgcgggtacgtacggaacgggttgtaaacgtaccgttaacgaaaccgtggttacggtcggtaccgtactaacccggttaccctaaggtttcccg

SEQ ID NO: 286214 - DNA, 720 bp, Homo sapiens
  misc_feature: GYAE6OF02I7PAT.4.57.F02.1.454.CMB.1.raw
  modified_base (139)..(139): a, c, t, g, unknown or other
  misc_feature (139)..(139): n is a, c, g, or t
  modified_base (214)..(214): a, c, t, g, unknown or other
  misc_feature (214)..(214): n is a, c, g, or t
  modified_base (674)..(674): a, c, t, g, unknown or other
  misc_feature (674)..(674): n is a, c, g, or t
  modified_base (688)..(688): a, c, t, g, unknown or other
  misc_feature (688)..(688): n is a, c, g, or t
  modified_base (692)..(692): a, c, t, g, unknown or other
  misc_feature (692)..(692): n is a, c, g, or t
  modified_base (699)..(699): a, c, t, g, unknown or other
  misc_feature (699)..(699): n is a, c, g, or t
  modified_base (713)..(713): a, c, t, g, unknown or other
  misc_feature (713)..(713): n is a, c, g, or t
tcagagcactgtagcacgaccggtgctcgatttagctcgatatagttggggtttggggagccagtctcagtcaggacacagcatggacatgagggtccccgctcagtctcctggggctcctgctactctggctccgagntcgccagatgagaccacccgagatcgacccgagtcctccactccctcccgttgtctcgctagtcgtgggtcgganacagtacgtcatctactccttacgtcggaccggataacgcaggtaagttgttaagtttaatttaaagttttaagtggttactacgtaacgttaaccgaaaaccgggtaacgggaaaccgtaccccgtaagtccttaaccgtggtaacttacgttacgtcggtactactcgtaccgttaacgttaacggttttaaccggtaaacgggttccgggttaaccctaattaaccgtaaaggtttacttcggtaaacggggttcggtaacttacgggtaaggttcgtacggtacggtaaaccggtactttacgttaccgtactacctacgttacacgtacgtaagtctaactacgtaacgtatacgttacttacaacgttaacttacgtctaacgtacgtaatacgtaccttccgtaacctaccctcgtacctaggttaccgtggaccgagtaacgtaggcgtaancctaaacgtaacgnggtntaccggngttcccactacgtnttaccgg

SEQ ID NO: 286215 - DNA, 732 bp, Homo sapiens
  misc_feature: GYAE6OF02IAVLW.4.57.F02.1.454.CMB.1.raw
  modified_base (215)..(215): a, c, t, g, unknown or other
  misc_feature (215)..(215): n is a, c, g, or t
tcagagcactgtagcacgaccggtgctcgatttagctcgatatagttggggtttggggccagtctcagtcaggacacagcatggacatgagggtccccgctcagctcctggggctcctgctactctggctaccgagatcgccaagatggtacgaaccacccagtataccgaccctacgtcctccaactcccctcctgtctagcctattccgtggngggacgacgaagtagtcactctatccttcgtacggccggactaagtacgagtacgttagtttaagttattttaagtttaaagttggttatactaacgttaaccgaaaccgtaacggtaacctaccccgtaagtcccttacgtagtactacctagtcgatcgactactaccgtaagtttaacgaacggtcggtacctataagagttatcgtagtaccgtgtaggtacgtacgtacgtaggtaccgtaagttactttcccgaacttccgtacctacctacgtaacgtaacgttaccttaaacccgttaaaccgtaaaccgttagtaaaatttaccgtttaaagaaccctttaaatttaccccttaagtagtaaacctaacgtaagtttaccgtacccgtaacccttaccccgttacgtctacccgttaccggtaacggaccgggtaacgacggttaaggtggtaacccaggtttaacgaacgtccgtgtaccggtctacgacccttactaggtccttcg

SEQ ID NO: 286216 - DNA, 613 bp, Homo sapiens
  misc_feature: GYAE6OF02JNO0A.4.57.F02.1.454.CMB.1.raw
  modified_base (104)..(104): a, c, t, g, unknown or other
  misc_feature (104)..(104): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
  modified_base (209)..(209): a, c, t, g, unknown or other
  misc_feature (209)..(209): n is a, c, g, or t
  modified_base (211)..(212): a, c, t, g, unknown or other
  misc_feature (211)..(212): n is a, c, g, or t
  modified_base (217)..(217): a, c, t, g, unknown or other
  misc_feature (217)..(217): n is a, c, g, or t
  modified_base (294)..(294): a, c, t, g, unknown or other
  misc_feature (294)..(294): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
  modified_base (362)..(362): a, c, t, g, unknown or other
  misc_feature (362)..(362): n is a, c, g, or t
  modified_base (573)..(573): a, c, t, g, unknown or other
  misc_feature (573)..(573): n is a, c, g, or t
tcagagcactgtagcacgaccggtgctcgatttagctcgatatagttggggtttggggagccagtctcagtcaggacacagcatggacatgacgggtccccgcncagctcctggggctcctgctactctggctcgagatgccagatgtgaccacccagatcgaccctagtcctccactccctcctgtctgcatcnggtggagacagntnannatctntcggccgacagtcagagtgttagttatttaattaattggtatacgtataccaaacggtagggaacctacccgtaacncttaccgtgactacgtntcgtacgtncgtacttacctaaggtttaaccgaaaggttccgggtaacctntaacgtaacggtaacttcggaacgtggacttaggtcgttacgcgtagggacgtagttactccgtctactaccactagtcaacgttactactaccgaactagtacgtttacttcgtaacttacttaactacgtctaacctagtagttaccgacttacccgtcccgaccgttacctacttcccggtggtacgggacgtacggaacgtggtaancgtaagaaccgtagttcggtacgtccgcgtccacgtcgtc

SEQ ID NO: 286217 - DNA, 801 bp, Homo sapiens
  misc_feature: GYAE6OF02J0UJL.4.57.F02.1.454.CMB.1.raw
  modified_base (59)..(59): a, c, t, g, unknown or other
  misc_feature (59)..(59): n is a, c, g, or t
  modified_base (220)..(220): a, c, t, g, unknown or other
  misc_feature (220)..(220): n is a, c, g, or t
tcagagcactgtagcacgaccggtgctcgatttagctcgatatagttgggtttgggganccagtctcagtcaggacacagcagtggacagtgacgggtccccgctcagctccgtggggctctgcctactcgtggcctccgagatcgcagagtgtacgaccacccagactcgaaccctatcctccaccttccctcctcgtcacgctacgtctggagggtanacgtagtactacgtactctacgtccttcgtccggaccgggtacaagtacaggtacgttagtttaacgttatttaagtttagtgtactacgttaagtaaccgaaacggtaaccgggtacctaacccgatcccgtactgtactaacgtcgcgttacagtctacctaacggttacgtaaacggtccggtcgtaacagtaactacgtactggtacgacggtaagtacgggtatttacgggacgtaacggtacttacgttccttaacctcgtaccgtaacacgttaccgtaaccgttaagtaccgtaccttaaacgaccgtttaaagtaccgtttataccgtaacttaaccttacggttaactaccggtaaactacgtttaacggtaaacccttaccccgtttaaacccttcgggcccctttaaaaccttacccggtacccggggtttaaacgacccggggtaacgggttaaccggttaacgggaaccggtttaaccccgaaaggtttaaacccccggtaacgggaccggttttaaccgggtaccgtaccggtaaactttaccccgtaaccgtttacccgttaacg

SEQ ID NO: 286218 - DNA, 680 bp, Homo sapiens
  misc_feature: GYAE6OF02FJEH7.4.57.F02.1.454.CMB.1.raw
  modified_base (199)..(199): a, c, t, g, unknown or other
  misc_feature (199)..(199): n is a, c, g, or t
tcagagcactgtagcacgaccggtgctcgatttagctcgatataggttgggtttgggggccagtctcagtcaggacacagcatggacatgagggtccccgctcagctccgtgggctcctgctactctggctccgagatgccagatgtgaccacccagatcgaccagtcctccactcctcctgtctgcatcgtggagganacgagagtacatctatctcgtcggccggactagtcgagtagttgttagttaattttaagtttaaagttcggtaattacgtacgttacgaaaaccggtaacgggtaaccgaccccttaagcctaccgtgtactacgtctgccgtgacctactaccttaaggttacgtaacgggtcggtaccagttaccgtagtacttcgaggttggacgtacggtcggagttacgaggtactacgtacgtttacacttaccgtacctacgtacgtacgtaacgtacgttacctaaaccgtacgtaagttacgttagtttacgaaccctttaacttacgtacttacgtaacctaacgtaacgttaacttacccggtaaccttaccccggtctaccgtttacctcgggttacgggaaccggtcggaacggtaggtcgtaaacgcgtaacgtaacggtactcggacgtacgtacgaccgtccgtataccggtacc

SEQ ID NO: 286219 - DNA, 725 bp, Homo sapiens
  misc_feature: GYAE6OF02IENR6.4.57.F02.1.454.CMB.1.raw
  modified_base (144)..(144): a, c, t, g, unknown or other
  misc_feature (144)..(144): n is a, c, g, or t
  modified_base (195)..(195): a, c, t, g, unknown or other
  misc_feature (195)..(195): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (476)..(476): a, c, t, g, unknown or other
  misc_feature (476)..(476): n is a, c, g, or t
tcagagcactgtagcacgaccggtgctcgatttagctcgatatagttgggtttggggccagtctcagtcaggacacagcatggacatgagggtccccgctcagctcctgggctcctgctactctggctcgagatgccagatgtnaccacccagatgacccagtcctccaactccctccctgtcgtgcatcctggnggagacagtagtcatcgacttcgtacgtcggccggaactacgtacagtagttagttaagttaattttaaatttaaatgggtattcgtacgttaacgaaaccgaggtaaaccgcccctaagtctcctagtacgttntacgcgttcngtaccttataccgttaagtttaaacgtaacgggtcccgggtaccaagtaaccgtagtatacgtaggtcgtacgtaggttccggaagttacggtaggtaaaccgttagttactttcccacgtcctaacaacccggtntttaacgggtacctacgtttaaccaccgtaacgttagtaaacgtttcttaaccggttaccttaactttacccttaggtaaacctacaaaccggttaagttaccgtaacccgtaccccggttaacccctacgtaccgttaaccgttcccggttaagggaacccgtacggggtaccgaaggttaacggaacttaaccggaacgaacgtttacgtggaacttcggaccgaacgtaacgttcttacgggttac

SEQ ID NO: 286220 - DNA, 967 bp, Homo sapiens
  misc_feature: GYAE6OF02G2LFG.4.57.F02.1.454.CMB.1.raw
tcagagcactgtagcacgaccggtgctcgatttagctcgatatagttgggtttgggggccagtctcagtcaggacacagcatggacatgagggtcccgctcagctcctggggctcctgctactctggctccgagatgccagatgtgacacccagactgacccagtctccattccctcctgtctgcattctggtggagacagtacgtcatactactccgttcgttacggccgggactaacggtcgaggtagttcgtttaagttaattttaacgtttaaagttggttactacgtacggtttaaccaaaaccggtaggggtaaccgtacccgttaacggtcctaccgttaggaactttcgttaaatcggtctacgtaccgttaaccgttaccgttaacgtttttaaaaccggaacgggggttccggggttacccctaagttaaaccgtaacggttaacgtttcgtacggggttacggtaacgtaacgggtttaggaacgtttaccgggtacggggtaaaccttacggttttaaccttttacccgttaacgtttacccttaaacccgtcccgtttaaacgttcccgggttaaaaacggtttaccccggttaaaccgttaaacccggttaacccgtaagggtttaaacgtttaacggtttttaaccccggaaaccttttaaaccggttttaaccctaaacggtttccgtaaaaccgttaaccgggttaaaacggtttacccgtttaaaccccggtttaaccccttccccggtttaaaccccgtcgttttaaccccgggttaccggttttaacccggggggaacccggggttaaacgggaacccggtttacgggggtaaaccggaccggttaaacccgttaaacccgggttaaaccgggttccgttaaaccgggtttccgggtaacccgttcgtaacccggtttaacccgttacgttccggttttaaccccgg

SEQ ID NO: 286221 - DNA, 798 bp, Homo sapiens
  misc_feature: GYAE6OF02GVG9I.4.57.F02.1.454.CMB.1.raw
  modified_base (793)..(793): a, c, t, g, unknown or other
  misc_feature (793)..(793): n is a, c, g, or t
tcagagcactgtagcacgaccggtgctcgatttagctcgatatagttgggtttgggggccagtctcagtcaggacacagcatgggacaatgacgggtccccgctcagcctcctggggctcctgctactctggctccgagatcgccagatgtcgaccacccagatcgacccagtctccactccctccctgtctgctatctgggtaggagcagtacgtcaagtctactcttcgtacggccgggtactaaggtcgaaggtcgttacgtttaagtttaagtttttaaatttaaaggttgtaactaccgtaacggttaacccgaaaaccggaacggggtaaaccgtaccccgttaacgtccctaccggttgtacttacgtacgttcgtaccgtacgtacctaaccgttacccgtttaaaggttttaaaccgggtaaaccggggtttcccggggtaacccctaaaggttaaccggtaaacgggttaaccgtttaaccgggtacgggtttacgggtaccggtagggtacggtaacggttaccgggtaggtacgttacggttacttttaccggacccttacctaccgtaacctacgtacgtaacgtaaccgtacctaacgtaacgtacgtagttacgttaccgacttaaccttaccgtaacttacgaacctaacgtaacgtacgtttaacccgtacccttcccgtaccgtacctcgttaccggtacggccggtacgtacgtacggtacgacgtaacgtacgtaaacgtcggtagaccggttgaaccgtacctacgttagtntaccg

SEQ ID NO: 286222 - DNA, 267 bp, Homo sapiens
  misc_feature: GYAE6OF01EJS7I.51.12.B01.1.454.CMB.1.raw
tcagcgatcgtatacacgaccggtgctcgatttagtagtgtagattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccaccctcctctcgtagcactctgagcgggctggcaaggcgcatag

SEQ ID NO: 286223 - DNA, 157 bp, Homo sapiens
  misc_feature: GYAE6OF01B7782.51.12.B01.1.454.CMB.1.raw
  modified_base (157)..(157): a, c, t, g, unknown or other
  misc_feature (157)..(157): n is a, c, g, or t
tcagcgatcgtatacacgaccggtgctcgatttagtagtgtagattccgcgggcacgaccggtgctcgatttagagtgctacgaagggaaagggcagcgtcactctgttcccgccctcctctcgtagcactctgagcgggctggcaaggcgcatagn

SEQ ID NO: 286224 - DNA, 564 bp, Homo sapiens
  misc_feature: GYAE6OF01BX4BR.51.12.B01.1.454.CMB.1.raw
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (348)..(348): a, c, t, g, unknown or other
  misc_feature (348)..(348): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (365)..(366): a, c, t, g, unknown or other
  misc_feature (365)..(366): n is a, c, g, or t
  modified_base (368)..(369): a, c, t, g, unknown or other
  misc_feature (368)..(369): n is a, c, g, or t
  modified_base (374)..(374): a, c, t, g, unknown or other
  misc_feature (374)..(374): n is a, c, g, or t
  modified_base (405)..(406): a, c, t, g, unknown or other
  misc_feature (405)..(406): n is a, c, g, or t
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (447)..(447): a, c, t, g, unknown or other
  misc_feature (447)..(447): n is a, c, g, or t
tcagcgatcgtatacacgaccggtgctcgatttagtagtgtagattcgtcttggggcgtcccagggtcgagggacaaacggtcacgattggccaactcaggtcggaggtccacggccagtacggacccgacggcctcgacctattattcgtccaaagtcaacaggacgaccctattggtacttatgtcttcggaactgccgaccaggtcaccgtcctgggtccaggcccaaggcccaaccccacgtgtccacctctcgttcccgcccgtcctctcgtagctactcctaggagtcgggctggtctaagggccacgactaggagcggcacgcctgngtgnangtanagcngngagcgcncgngcgcnngnntctcncgcgcgacgcgacgacgacgacacagtcgcnngngngngcgngngagagagagcntatatatntacactacanacactactacgtagtagtattacgttacgtacgtacgtacgtacgtacgtacgtaccgtaccgtcgtacggtccgaccgacccgacccgacccacccgtaccgtacgtcgtcgtccg

SEQ ID NO: 286225 - DNA, 291 bp, Homo sapiens
  misc_feature: GYAE6OF01DDVJB.51.12.B01.1.454.CMB.1.raw
  modified_base (270)..(291): a, c, t, g, unknown or other
  misc_feature (270)..(291): n is a, c, g, or t
tcagcgatcgtatacacgaccggtgctcgatttagtagtgtagattctcgtgggctccaggtcagggacaacggtcacagttggccatcagtggagtccaggcagaggacgaggctgactattattgtcaatcaacagacaccattcggtacttatgtcttcggaactgcgaccaaggtcaccgtctgggtcagcccaaggccaaccccatgtcactctcgttcccacctcctctcgtagcactctgagcgggctggcaaggctcatagnnnnnnnnnnnnnnnnnnnnnn

SEQ ID NO: 286226 - DNA, 343 bp, Homo sapiens
  misc_feature: GYAE6OF01AS07I.51.12.B01.1.454.CMB.1.raw
  modified_base (281)..(283): a, c, t, g, unknown or other
  misc_feature (281)..(283): n is a, c, g, or t
  modified_base (287)..(287): a, c, t, g, unknown or other
  misc_feature (287)..(287): n is a, c, g, or t
  modified_base (289)..(343): a, c, t, g, unknown or other
  misc_feature (289)..(343): n is a, c, g, or t
tcagcgatcgtatacacgaccggtgctcgatttagtagtgtagattacgtctggctccaggtcagggacaacggtcacattggccatcagtgggacgtcccaggcagaggacggaggcctgactattattgtcaatcaacagacaccattggtacttatgtcttcggaactcgcgaccaaggtcacccgtcctgggtcagcccaaggccaaccccatgtcactctgttcccaccctcctcttcgtacgcactctgagcggctggactaaggtcgcgatagnnncgancnnnnnnnnnnnnnnnnnnnnnnnnnnnnnnnnnnnnnnnnnnnnnnnnnnnnnnn

SEQ ID NO: 286227 - DNA, 108 bp, Homo sapiens
  misc_feature: GYAE6OF01EPLQU.51.12.B01.1.454.CMB.1.raw
  modified_base (106)..(108): a, c, t, g, unknown or other
  misc_feature (106)..(108): n is a, c, g, or t
tcagcgatcgtatacacgaccggtgctcgatttagtagtgtagatttgggctacgtggacgacacgcagtcgtgtctgatctgagcgggctggcaaggcgcatagnnn

SEQ ID NO: 286228 - DNA, 547 bp, Homo sapiens
  misc_feature: GYAE6OF01BTPYV.51.12.B01.1.454.CMB.1.raw
  modified_base (376)..(376): a, c, t, g, unknown or other
  misc_feature (376)..(376): n is a, c, g, or t
tcagcgatcgtatacacgaccggtgctcgatttagtagtgtagattccggtcgggggagcattcacccagcaaccacatctgtcctctaggagaaccccctagagtagccccgctcctctaccatggactggaccttggacggatcctcttcttggtggctagcaggtccacgagagccactcccaaggtgacaggtggtgcagtcctggggctgaggttgaagaacgtccccggggcctcagtgaaacggtctacctgcaagacctcgtggcgtacaaccgttcagtggcaacaacgtccactgggtgcgccaggcccctggacaagggcttgagtggatgggatggttagtctgagaactggtgccgcaaattntgcacaggagtttcggggcagggtcatcatgaccgggacacgtcatcgcacaacttacatgaactgacagtctgactatttgacgacacggccgtctattactgtgcgacagaagcggcggacgaggtcggttcgcgttacgtcggttcgaggcctccgtccccgtaacgg

SEQ ID NO: 286229 - DNA, 156 bp, Homo sapiens
  misc_feature: GYAE6OF01CSZG6.51.12.B01.1.454.CMB.1.raw
  modified_base (155)..(156): a, c, t, g, unknown or other
  misc_feature (155)..(156): n is a, c, g, or t
tcagcgatcgtatacacgaccggtgctcgatttagtagtgtagattccgcgggcacgaccggtgctcgatttagctgtgcgtcgaagggaaggcagcgtcactctgttcccacctcctctcgtagcactctgagcgggctggcaaggcgcatagnn

SEQ ID NO: 286230 - DNA, 557 bp, Homo sapiens
  misc_feature: GYAE6OF01D8S2Z.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcagacctctggctacaccttcagtggcaacaacgtccactgggtgcgccaggcccctggacaagggcttggagtggatgggatggtttagtctgagaactggtgccgactaaattatgacaacgtagggtagtttccgggggctaggggtcagtcgagtcggaccggggactacgtccatccgaccacaactacatggaactgacctagtctgactatttcgacgacgaccgggtccgtctacttactgtgcgacgagaaggccggacggacaggtacggttcgcgttacgtggttcgaggcctccgtccccgtaagg

SEQ ID NO: 286231 - DNA, 532 bp, Homo sapiens
  misc_feature: GYAE6OF01DB6J0.51.12.B01.1.454.CMB.1.raw
  modified_base (487)..(487): a, c, t, g, unknown or other
  misc_feature (487)..(487): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtgcgccaggcccctggacagggcttgagtggatgggatgggttagtctgagaactggtgccgcaaattatgcacgaggtagtttcgggggcaggggtcatcagtggaccgggacacgtccactcgccacaactacatggaactcgacagtctgactatttagacgtacacggtccgtctattactgtgcgacagaagcgggcgganaggtggttcgtcttacgtcggttacgaggctccgtccccgtacgg

SEQ ID NO: 286232 - DNA, 157 bp, Homo sapiens
  misc_feature: GYAE6OF01A70KV.51.12.B01.1.454.CMB.1.raw
  modified_base (157)..(157): a, c, t, g, unknown or other
  misc_feature (157)..(157): n is a, c, g, or t
tcagcgatcgtatacacgaccggtgctcgatttagtagtgtagattccgcgggcacgaccggtgctcgatttagctgtgcgtcgaagggaagggcagcgtcactctgttcccgccctcctctcgtagcactctgagcgggctggcaaggcgcatagn

SEQ ID NO: 286233 - DNA, 553 bp, Homo sapiens
  misc_feature: GYAE6OF01AJTUV.51.12.B01.1.454.CMB.1.raw
  modified_base (358)..(358): a, c, t, g, unknown or other
  misc_feature (358)..(358): n is a, c, g, or t
  modified_base (482)..(482): a, c, t, g, unknown or other
  misc_feature (482)..(482): n is a, c, g, or t
tcagcgatcgtatacacgaccggtgctcgatttagtagtgtagattaccggacgggggagcatcacccagcaacccaccatctgtcctctagagaacccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacagggcttgagtggatgggatggtttagtcgtgagaactggtgccgacgaaattntgcacgaggtagtttcggggcaggggtcagtcagtcggaccgggacacgtccagtcgccgacaacttacatggaactgaccagtctgacctatttcgaacgaccgacggccgttactatttacngtcgacgacgagagcggcggacaggaggttccgtcgttacgtcggttacgaggtcctccgtccccgtaagg

SEQ ID NO: 286234 - DNA, 519 bp, Homo sapiens
  misc_feature: GYAE6OF01EIZT4.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttggagtggatgggatggtttagctgagaactggtgccgacaaattatgcacaggagtttcggggcagggtcatcatgaccgggacacgtcatcgccacaactacatggaactgaccagtctgacatttgacgacacggccgtctattactgtgcgacgagaagcggcggacgagaggtcgcttacgtggttcgaggctcgtccccgtacgg

SEQ ID NO: 286235 - DNA, 545 bp, Homo sapiens
  misc_feature: GYAE6OF01D9JZM.51.12.B01.1.454.CMB.1.raw
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctctggctacaccttcagtggcaacaacgtccactgggtgcgccaggcccctggacaaggggcttgagtggatgggatggtttagctgagactggtncgcaaattntgacacaggagtttcggggnagggtcatcgagtgaccgggacacgtcatcgaccacactacatagaactgacagtctgactatttgacgactacggccgtacttattactgtcgcgacgaggaaggcggcggaacgaggtacgggttcgtacgtttacgttgggttacggaggtccttcccgtcccccgtaacggg

SEQ ID NO: 286236 - DNA, 610 bp, Homo sapiens
  misc_feature: GYAE6OF01AWY35.51.12.B01.1.454.CMB.1.raw
  modified_base (246)..(246): a, c, t, g, unknown or other
  misc_feature (246)..(246): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctgaggtgaagagcccggggctcagtgaaggtctcctgcaagcctnggctacaccttcagtggcaacaacgtccagtggtcgcgccacggcccctggacagggcttggagtggatgggattggttagcgtgagacgtggtcgccgtactaaagttgtgacgacgtagggtacggttttccggggactaaggggtcacgttcgagtcggaccgggactaccgtaccgtacgtaccgacctaactaaccttacgacgtacggaactcgaccgtacgtctagtactacgtttacgaacgtaccgaccggtccgttacttacgttacgtgtacgacgaacgaggaacggcgggacggacgacggtacggttccgtacgttacgtcggttacgacggtcctccgtccccgtacgg

SEQ ID NO: 286237 - DNA, 605 bp, Homo sapiens
  misc_feature: GYAE6OF01DAMEN.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctgaggtgaagagcccggggcctcagtgaaggtctcctgcaagacctctggctacaccttcagtggcaacaacgtccacgtgggtcgccgccgacggccccctaggaaccgaaggggtcttggaggtgggaagtggggattgggtttagtcgtaggagtaacgtgggtacgccgactaaaagttagtgacaacgagggtaggtttcggggcgtagggtcagtcgagtcggaccggggacacgtcacgtcgaccaactaacttacagtacggaactcgaaccagtctgactattcgaacgacgaccggtccgttactattacgtgtcgacgacgaggaaggcgggcgacgaggtacgggttcgcgtttaccgtgggtttccgaggtccttcccgtccccgtacggg

SEQ ID NO: 286238 - DNA, 157 bp, Homo sapiens; identical to SEQ ID NO: 286223
  misc_feature: GYAE6OF01DEFYJ.51.12.B01.1.454.CMB.1.raw
  modified_base (157)..(157): a, c, t, g, unknown or other
  misc_feature (157)..(157): n is a, c, g, or t

SEQ ID NO: 286239 - DNA, 593 bp, Homo sapiens
  misc_feature: GYAE6OF01DIPIH.51.12.B01.1.454.CMB.1.raw
  modified_base (247)..(247): a, c, t, g, unknown or other
  misc_feature (247)..(247): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctntggctacaccttcagtggacaacaacgtccacgtgggtgccgccacggccccctggaccaagggcttggagtggatgggattggttagtctgagaacgtggtgccgactaaattgtgcacgaggtagtttcggggacagggtcagtcagtcggaccgggacacgtcagtccgacaacaacttacaacgtggaactcgaacctagtcgtagacgtagtttcgaaccgacgaccggtcccgtacttagttacgtgtcgacgtacgacgaaggtccggacggacgaggtcggttaccgtaccgtttacggttcgggttacgaaggtcccttcccgtcccccgtaacggg

SEQ ID NO: 286240 - DNA, 555 bp, Homo sapiens
  misc_feature: GYAE6OF01BJDPQ.51.12.B01.1.454.CMB.1.raw
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccactgggtgcgccaggcccctggacaagggcttgaggtggatgggattggtttagtctggagaactggtgccgacaaattntgacaacgagggtaggtttcgggggcgagggtcagtcagtcggaccggggacacgtccatccgaccaacaacttacagtacggaactgaccgtagtctagactagttcgacgacgacggtccgttactacttacgtgtgcgacagacggcggcggacaggtcggttcgcgttacgtcggttcgagtcctccgtccccgagg

SEQ ID NO: 286241 - DNA, 580 bp, Homo sapiens
  misc_feature: GYAE6OF01BWBV1.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggagggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtcgcgccaggcccctggacaagggcttgagtggatgggatggtttagtctgagaactggtgccgctaaattatgcacgaggtaggtttcggggcagggtcatcgagtggaccgggacgacgtccactcgaccgacaacttacatagaactcgacctagtctgactattagacgaacgaccgggtcccgtacttattaaccgtggttacgacgtaccgaagaagggccggcggacgaaggtacggttcgtaccgttacgttacgggttacggaggtcccgtccgttcccccgtaacgg

SEQ ID NO: 286242 - DNA, 158 bp, Homo sapiens
  misc_feature: GYAE6OF01D53GT.51.12.B01.1.454.CMB.1.raw
  modified_base (157)..(158): a, c, t, g, unknown or other
  misc_feature (157)..(158): n is a, c, g, or t
tcagcgatcgtatacacgaccggtgctcgatttagtagtgtagattccgcgggcacgaccggtgctcgatttagagtgctacgaagggaaagggcagcgtcactctgttcccgccctcctctcgtagcactctgagcgggctggcaaggcgcatagnn

SEQ ID NO: 286243 - DNA, 585 bp, Homo sapiens
  misc_feature: GYAE6OF01BJO2A.51.12.B01.1.454.CMB.1.raw
  modified_base (349)..(349): a, c, t, g, unknown or other
  misc_feature (349)..(349): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtgcgccaggcccctggacaagggcttggagtggatgggatggtttagtctagagaacgtggtgccganaaattatgcacgagggtacgtttcggggacagggtcagtcagtcggaccggggactacgtcactcgaccactaacttacgataggaactcgaccagtctgacctagtttacgacgtaccgaccggtccgttacttattacgtcgtacgcgaacgagtaaggcgggacggacgaacggtcgggttacgaccgtttacgttcgggttaccggagggtcctcccgtcccccgtaacggg

SEQ ID NO: 286244 - DNA, 581 bp, Homo sapiens
  misc_feature: GYAE6OF01DR42B.51.12.B01.1.454.CMB.1.raw
  modified_base (262)..(262): a, c, t, g, unknown or other
  misc_feature (262)..(262): n is a, c, g, or t
tcagcgatcgtatacacgaccggtgctcgatttagtagtgtagattccgcgggggaggcatccgacccagcaacctacatctgtcctacgtaaggagaacccctgagagcccccgcttccctccacccatggactggaccctggaggatccgtcttcgttggtggcagcagccacaagagcccactcccaggtgcaggtggtgcagtctggggctgaggtgaagaagcccggggcctcagtgaaggtctcctgcaagacctntggctacaccttcagtggcaacaacgtccactggtgcgccaggcccctggacaagggcttgagtgatgggatggttagtctgagtaactggtgccgactaaattatgcacgaggtaggtttcggggacaggggtcagtcgagtcggaccggggactaccgtacatccgccaacgaacttacatcgaactgaccagtctgactagtttacgacgacgacggtccgttatacgtttacgtgttcgccgtacaggaacgcggacggaacgaggtcggttcgtacgttacgtcggttacgaggtcctcccgtccccgtaacgg

SEQ ID NO: 286245 - DNA, 577 bp, Homo sapiens
  misc_feature: GYAE6OF01BYOLG.51.12.B01.1.454.CMB.1.raw
  modified_base (366)..(366): a, c, t, g, unknown or other
  misc_feature (366)..(366): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgcgccacggcccctggacaagggcttggagtggagtgggattgggtttagtctaggagaacgtgggtcgccgactaaattntgcaacgaggtaggtttcggggctagggtcagtcgagtcggaccgggacgacgtccagtcgaccacaacttacagtaggaactcgaccagtctcgactagttcgacgacgaccggtccgttacttacttacgtgtcgacgacgagaacggcgggacggacgaggtacggttcgacgtttacgtggttacggacggcctccgtccccgtacg

SEQ ID NO: 286246 - DNA, 594 bp, Homo sapiens
  misc_feature: GYAE6OF01DGL4V.51.12.B01.1.454.CMB.1.raw
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (367)..(367): a, c, t, g, unknown or other
  misc_feature (367)..(367): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccggggctcagtgaggtctcctgcaagacctntggctcaccttnagtggacaacaacgtccagtgggtcgcgccgacggccccctagggacgaaggggcttggagtggatggggattgggtttagctggaagaacgtgggtcgccgactaaaattntggacacggtagggtacggtttcggggcgtagggtcagtcgagtggaccggggacaccgtcacgtcgaccaactaacttacagtaggaactcgaacctacgtctagtactagtttacgacgtacgaccggtccgtacttattacgtgtcgacgacgaggaagcggacggacgaggtacggttcgtacgttacggttcggttacggacggtcctcccgtcccgtacgg

SEQ ID NO: 286247 - DNA, 778 bp, Homo sapiens
  misc_feature: GYAE6OF01B9A8S.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcgaggtggtgcagtcgtggggctgaggtgaagaaggcccggggctcgagtgaaggtctccgtgcaagacctcgtggctacaccttcagtggacaacaacgtccacgtgggtcgccgccgacggcccccgtggaccgaagggcttggaggtggagtgggagttgggtttagtcgtgaacgtacgtgggtcgccgaactaaattagtcgacgtaacgagggttaacgggtttccgggggacgtaggggttacaagtaccgaaggttacgggaacccggggaaccgtaccgtacccgtaacgttacccggaacccgtaaccgtaaaacccgtttaacgaacgttaacgggtaaaccgttacggaacccgtaacgttaccgttacggtaaccgttaacggttttaaccggaaccggtaaccgtaacccggggtacccgtttaaccgttaacgttttaaccgtcggttaccggtaacggaaccggaaacgggtaacgggaccgggtaccgggtaaccggaagggttacgggtttacccggttacgttttaaccgtttcgggttaccggtaccgggtcccgttccccgttcccccggtaacggg

SEQ ID NO: 286248 - DNA, 158 bp, Homo sapiens
  misc_feature: GYAE6OF01D1RZS.51.12.B01.1.454.CMB.1.raw
  modified_base (158)..(158): a, c, t, g, unknown or other
  misc_feature (158)..(158): n is a, c, g, or t
tcagcgatcgtatacacgaccggtgctcgatttagtagtgtagattccgcgggcacgaccggtgctcgatttagagtgctacgaagggaaagggcagcgtcactctgttcccaccctcctctcgtagcactctgaggcgggctggcaaggcgcatagn

SEQ ID NO: 286249 - DNA, 615 bp, Homo sapiens
  misc_feature: GYAE6OF01ECA1F.51.12.B01.1.454.CMB.1.raw
  modified_base (387)..(387): a, c, t, g, unknown or other
  misc_feature (387)..(387): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctggaggtgaagaaggcccggggcctcagtgaaggtctcctgcaagacctctggctacaccttcagtggcaacaccgtccacgtgggtcgccgccgacgggcccccgtagggaccgaaggggtccttaggaggtgggagtggggtattgggtttagtcgtaggagaacgtgggtcgccgataaattgngcaacgagggtaggtttcggggagtagggtcagtcgagtcggaccgggacaccgtccacgtccgaccaactaacttacagtacggaactcgaccgagtctagtactagttacgacgaccgaccggtccgttacttacgttacgtgtcgacgacgacggaacggcgggacggagaggtacggttccgtacgttacggtcggttacggacggtccgtccgtccccgtagg

SEQ ID NO: 286250 - DNA, 534 bp, Homo sapiens
  misc_feature: GYAE6OF01BMG50.51.12.B01.1.454.CMB.1.raw
  modified_base (373)..(373): a, c, t, g, unknown or other
  misc_feature (373)..(373): n is a, c, g, or t
  modified_base (491)..(491): a, c, t, g, unknown or other
  misc_feature (491)..(491): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccggcaaattatgcacgaggagtttcggggnaggggtcatcagtggaccgggacacgtccactcgccacaacttacataggaactgaccagtctgacatttagacgacaccggccgttactacttactgtgcgacaggaagcggcgganaggtgttcgtcttacgtggttcgaggtcctccgtccccgtagg

SEQ ID NO: 286251 - DNA, 531 bp, Homo sapiens
  misc_feature: GYAE6OF01CQ0Y3.51.12.B01.1.454.CMB.1.raw
  modified_base (345)..(345): a, c, t, g, unknown or other
  misc_feature (345)..(345): n is a, c, g, or t
  modified_base (481)..(481): a, c, t, g, unknown or other
  misc_feature (481)..(481): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtgcgccaggcccctggacaagggcttgagtggatgggatggtttagctgagaactggtgccganaaattatgcacgaggtagtttcggggcaggggtcagtcatgaccgggacacgtcatcgccacaacttacatggaactgaccagtctgacatttgacgacacggccgtctattactgtgcgacagaagcggacgganaggacggttcggctttacgtggttacggaggtcctccgtccccgtaacgg

SEQ ID NO: 286252 - DNA, 629 bp, Homo sapiens
  misc_feature: GYAE6OF01E0V0X.51.12.B01.1.454.CMB.1.raw
  modified_base (379)..(379): a, c, t, g, unknown or other
  misc_feature (379)..(379): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacacctttcagtggcaacgaacgtccactggggtcgcgcccgacggcccctgggaccaaggggccttggaggtggagtggggtattgggtttagtcgtaggagtaacgtggtcgccgactaaagttntaggcacgtaggtacggtttcggggacgtagggtcaagtcgagtacgggacccggggacaccgtaccacgtccgaccgaactaacgttacacgtaggtaactcgaccgagtctagtactagtttacgacgtaccgaccggtaccgttacttaacttacgtacgtgaccgacgaaggaacggccggacggacgaggtacggttccgtacgtttacgtcgggttacggacggtcctcccgtcccccgtacgg

SEQ ID NO: 286253 - DNA, 615 bp, Homo sapiens
  misc_feature: GYAE6OF01CFJLG.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaggcccggggctcagtgaaggtctcctgcaagacctgtggctacaccttcagtggacaacaaccgtccacgtgggtcgcgccacggccccgtggacgaagggcttgaggtggagtgggagttggtttagtcgtaggagtaacgtggtcgccgactaaagttagtgacgacgtaggtaggtttcggggacgtagggtcagtcagtacggaccggggacaccgtaccacgtaccgaccaactaacttacagtacggaactacgacctagtcgtagaacgtagttacgaaccggtaccaccgggtcctacttaacgttacgtgtcgacgaacgaggtaacggcggacggagaggtacggttccgtacgttacggtacggttacgacggtccctcccgtccccgtaagg

SEQ ID NO: 286254 - DNA, 522 bp, Homo sapiens
  misc_feature: GYAE6OF01BNB9S.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccactgggtgcgccaggcccctggacaagggcttgagtggatgggatggtttagtctgagaactggtgccgcaaattatgcacgaggagtttcggggcagggtcagtcagtcgacgggacacgtcatcgcacaactacatgaactgaccagtctgactattgacgacgacggtccgttctattactgtgcgacagaagcggcggacaggaggttcgcgttacgtggttcgaggcctccgtccccgtacgg

SEQ ID NO: 286255 - DNA, 632 bp, Homo sapiens
  misc_feature: GYAE6OF01BGDFN.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggacaacaacgtccacgtgggtcgccgccgaggccccctgggaccaagggcttggaggtggagtgggattgggtttagtcgtaggagtaacgtgggtcgccgtactaaattagtcggacgaacgtagggtacgggttttcgggggactaggggtcagtcgagtcggaccggggacaccgtccacgtccgaccaactaacttacagtacggaactgacctagtctacgactagttacgacgaccgtaccggtccgttacttacgttacgtcgtacggaccggtaacgaaggaacggccgggaccggaacgagggtacggttccgtacgtttacgtcgggttaccggacggtcccttcccgtccccgtaacgg

SEQ ID NO: 286256 - DNA, 773 bp, Homo sapiens
  misc_feature: GYAE6OF01B9LUE.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcagggtggtgcaggtcgtggggctggaggtgaaggaacggccccggggcctcgaggtggaacgggtcctcccgtggacaacggaccctcgtcgggaccttaaccaccctttcaggtcggaccaaacgaaccgtccacgtggggtgccggcccacgggcccccgtggaaccgaacggggtccttaggaggtcgggagtggggtagtttgggtttagtcgtaggaagtaaccgttgggtcgaccggtactaaaagttctggacgaacgtagggtacgggtttaccgggggacgtaggggtacagtcgtaagtacgggaacccgggggtacaccggtacccgtacgtacccgaccctaacgtaaaccttaaccgacgtaacgggtaaccttaccggaacccgtacggttaccgtacgaacgttacgttttacggaaccggtaccgtacccgggtccgttacctttaacgtttaccgtacggttacggaccgtaacgaacgggtaacgggccgggacgggaacgtaacgggtaccgggttaccgtaccgtttacggttcgggttaccggaggtcccttccccgtcccccgtaaggg

SEQ ID NO: 286257 - DNA, 554 bp, Homo sapiens
  misc_feature: GYAE6OF01CC2S6.51.12.B01.1.454.CMB.1.raw
  modified_base (350)..(350): a, c, t, g, unknown or other
  misc_feature (350)..(350): n is a, c, g, or t
  modified_base (356)..(356): a, c, t, g, unknown or other
  misc_feature (356)..(356): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctctggctacaccttcagtggcaacaacgtccactgggtgcgccaggcccctggacaagggcttggagtggatgggatgggtttagtcgtgagacgtggtgccganaaattngcacgaggtaggtttcggggactagggtcagtcgagtcggaccggggacacgtccacgtccgccacaacttacagtagaactgaccagtctgactattgacgacgacggtccgtctattacgtgtgcgacagaaggcggcggacgaggtaggttccgcgttacgtcgggttacgacggtccttcccgtccccgtaagg

SEQ ID NO: 286258 - DNA, 553 bp, Homo sapiens
  misc_feature: GYAE6OF01CTKP5.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgcgccacggcccctggacagggcttgagtggatgggattggtttagtctgagaacgtggtcgccgacaaattatgacacgaggtaggtttcggggatagggtcatcagtacggaccgggacacgtccagtccgccaactaactacagtcgaactacgactagtctgactagttcgaacgacgacggtccgtacttacttactgtcgcgacgagacgcggcgagaggtcggttcgtcgttacgtcggttacgagtcctccgtccccgtag

SEQ ID NO: 286259 - DNA, 648 bp, Homo sapiens
  misc_feature: GYAE6OF01CVBFS.51.12.B01.1.454.CMB.1.raw
  modified_base (264)..(264): a, c, t, g, unknown or other
  misc_feature (264)..(264): n is a, c, g, or t
  modified_base (292)..(292): a, c, t, g, unknown or other
  misc_feature (292)..(292): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcagggtggtgcagtcgtggggctgaggtgaagaaggcccggggcctcagtgaaggtctcctgcaagcctctggctactaccttnagtggacaacgaacgtccacgtgggtcnccgccacggcccctggacaagggcttggagtggagtgggattgggtttagtcgtaggacgtaacgttggtgaccgtataaaagtttgtgacaacggagggtacggtttccgggggactaacggggttctaagtcgtaagtcgggtaaccggggacgtaccggtaccacgtccgacctaactaaaccgttacgtacgtacggtaactacgacctagtcgtacgactagtttacgaccgtacgtaccggtccgttactacttacgtcgtcgacgacgacggacggcgggaccggacgacggtacgggttcgtacgtttacgtcgggttacggtacggtccgtcccgtccccgtaacgg

SEQ ID NO: 286260 - DNA, 610 bp, Homo sapiens
  misc_feature: GYAE6OF01DSG5E.51.12.B01.1.454.CMB.1.raw
  modified_base (223)..(223): a, c, t, g, unknown or other
  misc_feature (223)..(223): n is a, c, g, or t
  modified_base (246)..(246): a, c, t, g, unknown or other
  misc_feature (246)..(246): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtctggggctgaggtgaagaagccggggcctnagtgaggtctcctgcaagacctntggctacaccttcagtggacaacaacgtccacgtgggtgcgccgacggcccctgggaacaaggggtcttggaggtggagtgggattgggtttagtcgtaggaagtaacgtggtcgaccgactaaaattagtgacaacgagggtacgggtttcggggacgtagggtcagttcgagtacgggaccgggacacgtcacgtcgaccaactaacttacagtacggaactcgacctagtctagactagttcgaaccgacgaccggtccgttacttattacgtgtacgcgtacgaaggtaggtcgggcggagtaggtcggttaccgtacgtttacggtcgggttacgacggtcctaccgtccccgtaacgg

SEQ ID NO: 286261 - DNA, 537 bp, Homo sapiens
  misc_feature: GYAE6OF01A3U3F.51.12.B01.1.454.CMB.1.raw
  modified_base (350)..(350): a, c, t, g, unknown or other
  misc_feature (350)..(350): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacacccttcagtggcaacaacgtccactgggtgcgccaggcccctggacagggcttgagtggatgggatggttagtctgagactggtgccgcaaattntgcacgaggtagtttcggggcagggtcatcagtgaccgggacacgtccatcgccacacttacatcggaactgaccagtctgactatttgacgacgacggtccgtctacttactgtgcgacagaacggcggcggacgaggtacggttcgtcgttacgtcgggttacgaggtcctccgtccccgtacgg

SEQ ID NO: 286262 - DNA, 628 bp, Homo sapiens
  misc_feature: GYAE6OF01A6954.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccacgtgggtgccgccaggcccctaggacaaggggcttggagtggagtgggattgggtttagtctaggagtaacgtggtacgccgactaaatgtagcaacgtagggtagtttcgggggacgtaggggtctagtccgaagtacggaccggggtaccaccggtaccacgtcgacccaacgtaaccttaacgagtacggaacctcgaaccgtaggtacctagtaacctagtttcggaaccgtaccgaccggtaccgttacttacgtttacgtcgtcggaccgacgaacggtaacggcgggtaccggacgaggtacggttcgcgtttacgtcgggttcgacggtcctccgtccccgtagg

SEQ ID NO: 286263 - DNA, 552 bp, Homo sapiens
  misc_feature: GYAE6OF01B0DHC.51.12.B01.1.454.CMB.1.raw
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
  modified_base (489)..(489): a, c, t, g, unknown or other
  misc_feature (489)..(489): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccgaggcccctggacaagggcttgngtggatgggatggttagtctgagactggtgccgacaaattntgcacgaggtggtttcgggcagggtcatcagtcggaccgggacgacgtccgacgtcgaccactaacttacataggaactcgaccagtctagtacctatttgacgtaccgacggtccgtcttattacgtgtgtcganagtagcggcggacgaggtgggtcgtacgttacgtcggttacgaggtcctccgtccccgtacgg

SEQ ID NO: 286264 - DNA, 824 bp, Homo sapiens
  misc_feature: GYAE6OF01CGN0E.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccacgtgggtgccgccaggccccctggacaagggcttgagtggatgggattgggtttagtctggagtaacgtgggtcgaccggactaaaagtttctagacctaacggtaggggtaacggttttcgggggaccgtaaggggttccaagttaccgaacgttcggggaaccccggggggtaacctaaccgggtacccgtaacgttaccccggaccctaaaccgtaaaaccgtttaaccgtaacgttaacgggtaaaccgtaacggaaccccgtaacggttacccgtacggtaaacctaacgttttaaccggaaacccggtaacccggtaaccccggggttaccccggtttaccgtttaaacgttttaacccggttacgggttacggacccgggtaaaccggtaaagggtaaaaccggggtacccgggggtaacccggggtaaacccggtaaggggttaccggggttttacccggtaccggttttaaaccggttccgggggttttaaccgggaaccgggttccccgttacccccggttaccccccggtaaacggg

SEQ ID NO: 286265 - DNA, 789 bp, Homo sapiens
  misc_feature: GYAE6OF01DUDXR.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtgcagtcgtggggctggaggtgaaggaacggcccggggcctcgaggtgaacggttcctccgtgacaacgaccttcgtcggaccttaacctacctttcgacggttcggaaccaaaaccgtaaccggttaccaacggttggggtacgcccggccggaccgggcccccgtaggaaccgaaggggtcgttaggaggtgggagtggggtagtttagggttttacgtcgtaggagtaacggttgggtaccgaccgaacttaaaagttcgtaggacctaacgggtaagggttacgggtttccggggacgtaacggggttcaacggttcgaacggtacgggaacccgggactaccggtacctacgtaccgacctaacgtaaaccgttacgaacgttacggaaaccgttacggaacccgtagttacgtacggttacttacgtttaccgaaccgtaccggaccgggttacccgttacgtttacttacggtcggtacggtaaccgtaacggtaacgggaacgggccgggtaaccggtaagtacgggttacggttacccggtacgtttacggttcgggttacggaccggtcccttcccgttccccgtaacggg

SEQ ID NO: 286266 - DNA, 621 bp, Homo sapiens
  misc_feature: GYAE6OF01BRQYI.51.12.B01.1.454.CMB.1.raw
  modified_base (246)..(246): a, c, t, g, unknown or other
  misc_feature (246)..(246): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctntggcctacaccttcagtggcaacaacgtccactgggtgcgccaggcccctggacaagggcttggagtggatgggatggtttagtctgagtaacgtggtacgccgactaaaagttcgtagctaccgaaggggtacggttttcgggggacagggggttcagtccgagtacggaccggggactacggtaccacgtcgaccactaacttacgagtacggaacgtacgaccgtagtcgtacgactagtttacgacgacgaccggtaccgtacttagttacgtacgtcgacgactaggaacggtcgggaccggaacgaggtacggttaccggtacgtttacgtcggggttaccgacgggtccttccctcccccggtaacgg

SEQ ID NO: 286267 - DNA, 619 bp, Homo sapiens
  misc_feature: GYAE6OF01DL0KU.51.12.B01.1.454.CMB.1.raw
  modified_base (247)..(247): a, c, t, g, unknown or other
  misc_feature (247)..(247): n is a, c, g, or t
  modified_base (351)..(351): a, c, t, g, unknown or other
  misc_feature (351)..(351): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagcctntggctacaccttcagtggcaacaacgtccacgtgggtgcgccaggcccctggacaagggcttgagtggagtgggattggtttagtctagagtactggtgccganaaattatgacacgaggtaggtttcggggctagggtcagtcgagtcggaccgggacaccgtccacgtccgaccaaccgtaaacttacagtaggaaccgtcgaccgtagtcgtacgactagtttacgaaccgtaccgaccgggtaccgttacgttaactttacgtggtacgtaccgaacgaaggaacggtcgggaccggaagacgggtacgggttccgtaccgtttacgttcgggttacggacgggtcccttcccgtcccccgtaacggg

SEQ ID NO: 286268 - DNA, 573 bp, Homo sapiens
  misc_feature: GYAE6OF01D8NYS.51.12.B01.1.454.CMB.1.raw
  modified_base (284)..(284): a, c, t, g, unknown or other
  misc_feature (284)..(284): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtncgccacggcccctggacaagggcttggagtggatgggatggtttanctgagacgtggtgccganaaattngcaacgnggtacgtttcggggntagggtcagtcagtggacccgggacacgtccatccgccaactaacttacattaggaactcgaccagtctagactagtttacgaccgaacgaccgggtccgttactacttacgtcgtgacgtaacaggaacggcgggacggtagaggtacggttcgtcgtttacgtcggttacggacgtcctcccgtccccgtaacgg

SEQ ID NO: 286269 - DNA, 677 bp, Homo sapiens
  misc_feature: GYAE6OF01EXJYN.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacacgtccacgtgggtcgcgccaggcccctggacaagggctgagtggagtgggatggtttagtcgtagagtaacgtggtcgaccggtactaaagtttagtcgactaacgaggggtacggttttcgggggacgtaggggtcaacgtcgtagttacgggaacccggggtaaccaccggtacccgtaacgtacccgacccgtaactaaccgttaacgaacgttacggaaacgtacgaaccgacgttactacgtacgtacgtttacggaaccgaaccgacgggtacccgttacttacgtttaccgtggttacgacgaacgacggaacgggccgggtaccgggaagacgggtacgggttcccgtacgttaccggttgggttaccgtacgggtcccttcccgtcccccgtaacggg

SEQ ID NO: 286270 - DNA, 585 bp, Homo sapiens
  misc_feature: GYAE6OF01DNAVE.51.12.B01.1.454.CMB.1.raw
  modified_base (377)..(377): a, c, t, g, unknown or other
  misc_feature (377)..(377): n is a, c, g, or t
  modified_base (426)..(426): a, c, t, g, unknown or other
  misc_feature (426)..(426): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctggaggtgaagaaggcccggggctcgagtgaaggtctcctgacagacctctggctacaccttcagtggaccaacaaccgtccacgtgggtcgccgccacggccccgtggacgaagggtcttggaggtggagtgggtagttgggtttagtctaggagtacgtggtcgccgataaattntgacacgaggtaggtttcgggcgtaggtcagtcgagtcgggaccggganaccgtcacgtcgaccaactaacttacgagtaggaactcgacctagtctagactagttcgacgacgtacggtcctcttattcgtgtgaccgagaggaacgcgggacgacaggttacggtcgtacgttacggtcggttacgacgtcctcccgtcccgtagg

SEQ ID NO: 286271 - DNA, 586 bp, Homo sapiens
  misc_feature: GYAE6OF01BCJPN.51.12.B01.1.454.CMB.1.raw
  modified_base (433)..(433): a, c, t, g, unknown or other
  misc_feature (433)..(433): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtgcgccaggccccgtggacaagggcttgagtggacgtgggatgggtttagtctgagaacgtggtgccgcgaaattatgcacaggagtttcgggctagggtcatcatggaccgggacacgtcatcgccactaacttacatggaactgaaccngtctgactattcgaacgtacgaccgggtccgtacttattaacgtgtcgaccgtacgaaacggtaaggccgggtacggacgagggtacggttaccgggtacctttacggttcggtttaccgggaaggtcccttcccgtccccccggtaaacggg

SEQ ID NO: 286272 - DNA, 692 bp, Homo sapiens
  misc_feature: GYAE6OF01CTPTP.51.12.B01.1.454.CMB.1.raw
tcagcgatcgtatacacgaccggtgctcgatttagtagtgtagattccgcgggggagcatcacccagcaaccacatctgtccctctagacgaaccccctgagacgcccccgctcctcaccatggactggacctggaggatcctcttcttggtggcagcagccaacaagacgcccactcccaggtgcgagggtggtgcagtcgtggggctggaggtgaagaacggcccggggcctcgagtgaaggtctcctgacaacgacctcgtcggctacctaccttcaggtggaccaaacgtaaccgtccacgtgggtcgccgcccgacgggcccccgtaggaaccgaaggggtcctttggaaggttcgggagtggggaatttagggtttacgtcgtaggaacgtaacgttgggtcgacccgtaacgtaaaattagtcgacgaagtagggttacggtttcggggacgtagggtcagtcgagtacggaaccggggacgaccgttaccgacgtcccgaccaactaacgttacagtacgtaactacgaacctagtcgtacgtaactagtttacgaaccgtaccgtaccggtccgttacgttaacttacgtgtcgaccgtaacgaggtaacggcgggacggacgtacgggttacgttccgttacgttacggttcgggtacgcgttaccctcccgtaccgtacgg

SEQ ID NO: 286273 - DNA, 568 bp, Homo sapiens
  misc_feature: GYAE6OF01DROGD.51.12.B01.1.454.CMB.1.raw
  modified_base (173)..(173): a, c, t, g, unknown or other
  misc_feature (173)..(173): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
  modified_base (543)..(543): a, c, t, g, unknown or other
  misc_feature (543)..(543): n is a, c, g, or t
tcagcgatcgtatacacgaccggtgctcgatttagtagtgtagattcggcgggggtgggtccaggaggcagaactctgggtgtctcaccatggcctggatccctctacttctccccctctcactctctgcacaggctctgaggcctctatgagctgacacagccacctcggtntcagtcgtccccgaggacacgacggccaggactccacctgctcgtggagatgcattcgaccaaacgntatgctttagttcggtacagcagacgccggcacggccctgtgttggtnatagtataaagcagtgacgtagccctgacggactccgtaggacgcgtattcgtcgtcgctccgaggtcgaggacaacggcacgtagtcgacgatcgaggtggcgtacgacggtacgaaggnggaacggaggcgtagaacttgttattcgatactacaancgtaacacgtagttcgtaacttatcgttacgtacgatcgacgtaccgagtccacccggtcgtggtaccaccgacccgtacggacccctaaaccccngttacgacctcgtcgtttaccccgg

SEQ ID NO: 286274 - DNA, 539 bp, Homo sapiens
  misc_feature: GYAE6OF01EM68M.51.12.B01.1.454.CMB.1.raw
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggctgagtggatgggatggtttagtctgagaactggtgccgnaaattngcacgaggtagtttcggggntagggtcatcagtgaccggggacacgtcagtcgccacaactacataggactgaccagtctagactattgacgacgacggtccgtactattactgtgcgtacgaggaacgcgggacggacgaggtacggttcgcgttacgtgggttacgaggtcctccgtccccgtagg

SEQ ID NO: 286275 - DNA, 767 bp, Homo sapiens
  misc_feature: GYAE6OF01CEBTR.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgagggtggtgcgagtcgtggggctggaggtgaagacggcccggggctcgagtgaaggtctccgtgacaagacctcgtcggactacctaccttcgagtcggacaaacgaaccgtccacgtggggtcgccggccgacggccccgtaggacgagggtcttggaggtggagtggggtagttgggtttacgtcgtaggacgtaacggttggggtacgccgtaaactaaaagttgtacggacgtaacggtaggggttaacggggtttccggggacgtaggggttacctaacggttaccgtaagggtaccggggaacccggggtaccgtaacccggtacccgtacgttaccccggaaccctaaccgtaaaccgttacgacgtacggtaaccgtacgaccgtagtcgtagtaacgtagttacggaccgtaacgtacccgggtaccttacgttaactttaccggtacggtacggaaccggtaacggtaacgggaaccggccgggggaccggtaaacggacgggttacgggttacccggtacgtttaacgggttcgggttaccggaccggttcccttcccggttccccgtaacggg

SEQ ID NO: 286276 - DNA, 850 bp, Homo sapiens
  misc_feature: GYAE6OF01B5WF5.51.12.B01.1.454.CMB.1.raw
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagagcccgggctgagtgaaggtcnctgacaagcctgtggctactaccttnaggtcggacaacgaaccgtccaacgtggggtcgccggaccgacgggcccccgtgggaaccgaaggggtcctttaggaggttgggagttggggatttgggttaagtctaggaagtaacgtgggtcgaccgtaactaaagtttcgaggccaacggtagggttacggggttttccgggggaccgtaaggggttcctaacgttaccggaaggttaccggggaacccgggggaacctacccgggttacccgacgttaccccggaccctaaaccgtaaacctttaaccgtaacggttaccggtaaaccgttaccggaacccgtaacggttacccgttaaggtaaccgtttaacgttttaccgggaacccggtaaccggtaacccggggttaccccgtttaacgtttaaccgtttaccggtacggtaccggtaccggtaaaccgaacgggtaaaccggggacccggggtaaccgggtaaaccggtacggggttaaccggggtttacccggttaacccggttttaaaccgggtttccggggtttacccggggaaccggtttcccccggttacccccggttaccccccgggtaaacggg

SEQ ID NO: 286277 - DNA, 637 bp, Homo sapiens
  misc_feature: GYAE6OF01CA6LC.51.12.B01.1.454.CMB.1.raw
  modified_base (257)..(257): a, c, t, g, unknown or other
  misc_feature (257)..(257): n is a, c, g, or t
  modified_base (581)..(581): a, c, t, g, unknown or other
  misc_feature (581)..(581): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagacgccggggcctcgagtgaaggtctccgtgcaagacctctggctacnccttcagtggacaacaacgtccacgtgggtcgcgccacggcccccgtaggaccgaagggtcttggaggtggagtgggtattgggttatcgtggaagtaacgtgggtcgcccgtaataaagttgtcgacgaacgtagggttacgggtttcggggacgtagggttcaagtcgtaggtacgggaccggggtacaccggtccacgtcccgaccaacgtaacttacacgtacggaactcgactagtcctagacctagttacgaccgacgaccggtcccttacgttacttaccgtggtacgtacgaacgtacggaacggcgggaccgganagggtacggttccgtccgttagtcgggttacgacggttcctcccgtcccgtaacgg

SEQ ID NO: 286278 - DNA, 738 bp, Homo sapiens
  misc_feature: GYAE6OF01C1RTI.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaacgcccggggcctcgagtgaaggtctccgtgacaagacctgtcggctacaccttcgagtggacaacaacgtccacgtgggtcgcgccgacggccccgtaggacgaagggtcttggaggtggagttgggaagttgggtttagtctaggtaacgtaacgttggtcgccgtaacgtaaaagttacgttgacctaacggagggttaacgggttttccggggacgtaagggggttacctaagttaccggtaacggttaccgggaaccccgggggtaacgtaaccccggttacccgaacgttccccgggaaaccctaaaccgtaaacgtttaacgaacgttacgggtaaaccttacgaaccgtacgttaccgtagtaaccgttagtttaaccggacggtaaccgtacccgggtaccgttacttaacgttccgttaggtacgtacgtaacgacggtaacgcgggtaccgggagtagggtacggtttcgtaccgtttacggtcggtaccggtaggtccctcccgtcccgtaacgg

SEQ ID NO: 286279 - DNA, 707 bp, Homo sapiens
  misc_feature: GYAE6OF01E2KM4.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaagcccggggcctcagtgaaggtctcctgcaagacctcgtggcctacaccttcagtggcaacaaccgtccacgtgggtgccgccacggcccctgggacaaggggcttggaggtggagtgggtattgggtttagtcgtaggagtaacgtgggtacgccggactaaaagtttagtggaccaacgtagggtagggttttccggggggactagggggtcaacgttcgaagttacgggaacccggggtacgtaccggtaccgaacgttcccggacccaaccgtaaaccttaaccaacgtacgggaaccgttacgaacccgtagttccgtacggtaactacgtttacgaaccggaccgaccgggtaccgttcttacgttactggtacgcgtacgaacggtaacggaccgggtaccgggaaggtacggtacgggtttccggtaccgtttaccgggttacgggttaccgggtaaccgggtcccttcccgtcccccccggtaacgg

SEQ ID NO: 286280 - DNA, 661 bp, Homo sapiens
  misc_feature: GYAE6OF01EGQ38.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaggtctcctgcaagacctctggctacaccttcagtggcaacaacgtcactgggtgcgccaggcccctggacaagggctgagtggatgggatggtttagcgtcgaagaaccgttgggtacgtccgactaaaagttagtggactacgagggtaggggttttccggggacgtacggggtacacgtacgattcgggaacccggggaacgtaccgtacccgtacgttccgacccgaacgtaaccgttaaaccagtaacggaacgttacgaaccgtacgtcgtacgaactacgttttacggaaccgacgtaccgggtacccgttaccttaatttaccgtagtacggcgaacgtaaggaaacggcgggtacggtacgaacggttacgggttcggtacgttacgttacgggttacgaacggtccttcccgtacccccgtaacgg

SEQ ID NO: 286281 - DNA, 161 bp, Homo sapiens
  misc_feature: GYAE6OF01BIUDB.51.12.B01.1.454.CMB.1.raw
  modified_base (156)..(161): a, c, t, g, unknown or other
  misc_feature (156)..(161): n is a, c, g, or t
tcagcgatcgtatacacgaccggtgctcgatttagtagtgtagattccgcgggcacgaccggtgctcgatttagctgtgcgtcgaagggaaaggcagcgtcactctgttcccgcctcctctcgtagcactctgagcgggctggcaaggcgcatagnnnnnn

SEQ ID NO: 286282 - DNA, 756 bp, Homo sapiens
  misc_feature: GYAE6OF01BQMW6.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtcgtggggctgaggtgaagagcccgggctcagtgaaggtctcctgcaagacctctggctacaccttcagtcggacaacaacgtccagtgggtcgccgccgacggcccccgtggacgaaggggtcttggaggtggagtagggattggtttagtctggagtacgtgggtcgaccggtactaaaattcgtacgacctaacggtaagggttacgggtttaccggggggcgtaacggggtcctaaggttccggtaacggttccggggaaccccgggggtaacctaaccccgggtttcccgaaacggttccccggaaccctaaaccgttaaacccgtttaaccgaacggttaccggggtaaaccgttaccggtaacccgtaacggtttaccgttacggtaaccgtttacgttttaaccgggaaccgtaacccggtaccgggtacccgtttacgttacgtttaccgtacggttacgaccggaaaccgtagggaacggccgggacgaacgacgggttacggttccgtacgtttacggtgggttaccgacgggtcccttcccgccccgtaagg

SEQ ID NO: 286283 - DNA, 577 bp, Homo sapiens
  misc_feature: GYAE6OF01DN4LG.51.12.B01.1.454.CMB.1.raw
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (351)..(351): a, c, t, g, unknown or other
  misc_feature (351)..(351): n is a, c, g, or t
  modified_base (470)..(470): a, c, t, g, unknown or other
  misc_feature (470)..(470): n is a, c, g, or t
  modified_base (531)..(531): a, c, t, g, unknown or other
  misc_feature (531)..(531): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgagaagcccggggctcagtgaggtctctgcaagactcngctacaccttnagtgacaacaacgtccatgggtgccgccaggcccctggacgaagggcttgaggtggatgggattggttagtctagagacgtggtcgccgataaattngacaacgagggtaggtttcggggctaggggtactacgtcgagtacgggaacccgggaccgtaccgtccaacgtccgaccaactaaacttacataggactacgacctagtctagtacctnttacgaccgtaccgaccggtccttctaagttacgtgtacgacgagaggaaggcggacgganaggtagttcgtacttacgtggttacggagtcctccgtcccgtaagg

SEQ ID NO: 286284 - DNA, 649 bp, Homo sapiens
  misc_feature: GYAE6OF01BB6JN.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggctcgagtgaaggtctcctgcaagacctctggctacaccttcagtggcaacaacgtccacgtgggtgcgccacggcccctggacaagggcttgagtggagtgggatgggtttagtcgtgagtaacgtggtcgccgataaattatggacacgtagggtaggtttcgggggactaggggtcagtcagtcggaccgggacacgtcatccgaccacaacttacagtacggaactgacctagtcgtacgactagtttacggaacgtaccgtaccgggtcccgttacttaacgttacgttcggtacggaccggtaacgaacggtaaaccgggaccggggaccgggtaacggaacgggtacgggtttaccgtaccggtttacggttacggggtttaccggaaccgggttccgttacccccgtccccccggtaacggg

SEQ ID NO: 286285 - DNA, 614 bp, Homo sapiens
  misc_feature: GYAE6OF01BL2HY.51.12.B01.1.454.CMB.1.raw
  modified_base (373)..(373): a, c, t, g, unknown or other
  misc_feature (373)..(373): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagaacggcccggggcctcgagtgaaggtctcctgcaagacctctggctacaccttcagtggacaacaacgtccagtgggtcgccgccgacggcccctggacaagggtcttggagtggagtgggattgggtttagtctagagtacgtgggcgccgataaattgngacaacgtagggtacggtttcggggactagggtcagtcgagtacgggacgggacacgtccgagtccgacctaactaacgttacagtacggtaactgacctagtctagacttagttcggaaccgacggtaccggtcgttacttacgttacgtggtacgacgaacgtaacgaacgggcggtacggagtaacgggttcgttaccgtcgtttacgtgggtacgacgtccctcccgtacccgtagg

SEQ ID NO: 286286 - DNA, 662 bp, Homo sapiens
  misc_feature: GYAE6OF01DABZN.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcagggtggtgcagtcgtggggctggaggtgaagacggccccggggcctcagtgaaggtctcctgacaagacctcgtcggactaacctaccttcgaggtcggaccaaaccgaaccgtccacgtgggtcgccgccgacggccccgtaggaaccgagggtcttggaggtgggagtgggtagttgggtttagtcgtaggaacgtaacgtggtcgccgtaataaattgtcgacgtaacgtagggttacggttcggggacgtaggggtcacgtcgagtaccgggaccgggtacaccgtccacgtcccgacaacctaacttacagtacggaactcgacctagtctacgtactacgttacgaaccgtaccgaccggttccgtacttacgttacgtgtccgacggtaacgacggacggaccggacggagtaggtacggttccgtacgtttacggttcggttacggacggtccctcccgtccccgtaacgg

SEQ ID NO: 286287 - DNA, 624 bp, Homo sapiens
  misc_feature: GYAE6OF01BFJV0.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctgaggtgaagacgcccggggctcagtgaaggtctcctgcaagacctcgtggctacaccttcagtggacaacaacgtccacgtgggtcgccgccacggcccctaggacgaagggcttgagtggatgggattggtttagtcgtaggagtaacgtggtacgaccgataaagttacgtgacgaacgtagggtacggtttcggggactaggggtcagtcgtagtcggaccggggacacgtccagtccgacaactaacttacagtacggaactacgacctagtctagtactagttcgaacgacgtaccggtaccgttacttaacttacgtgtcgacgacgtaaggaacggccgggacggacgtaggtacgggttaccgtacgttacggttcgggttacggtacggtcccgttcccgtcccccgtaacgg

SEQ ID NO: 286288 - DNA, 582 bp, Homo sapiens
  misc_feature: GYAE6OF01CWSC3.51.12.B01.1.454.CMB.1.raw
  modified_base (293)..(293): a, c, t, g, unknown or other
  misc_feature (293)..(293): n is a, c, g, or t
  modified_base (362)..(362): a, c, t, g, unknown or other
  misc_feature (362)..(362): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaagaacggcccggggcctcgagtgaaggtctcctgacaagacctctggctacaccttcagtggacaacaacgtccacgtgggtnccgccacggcccctggacagggctgagtggatgggattggttagctagagacgtggtgccgataaattntgacacgaggtcggtttcggggatagggtcagtcgagtcggaccgggacacgtccagtccgacctaactaacttacagtacggtaactcgacctagtctagactagtttacgacgtacgacggtccgttacttagttacgtgacgtacgaacgagtacggcgggacgacgaggtcgttccgtacttacggtcggttacgacgtcctcccgtcccgtaagg

SEQ ID NO: 286289 - DNA, 546 bp, Homo sapiens
  misc_feature: GYAE6OF01ANOM4.51.12.B01.1.454.CMB.1.raw
  modified_base (373)..(373): a, c, t, g, unknown or other
  misc_feature (373)..(373): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacagggcttgagtggatgggatggtttagtctgagaactggtgccgataaattatgcacgaggaggtttcggggntagggtcatcgagtcggaccgggacacgtccagtcgaccacaacttacagtagaactcgactagtctgactagtttgaccgacgaccgggtccgtacttacttacgtgtcgacgacagaacggcggcgacgaggtcggtcgcttacgtggtacgaggtctccgtccccgtagg

SEQ ID NO: 286290 - DNA, 694 bp, Homo sapiens
  misc_feature: GYAE6OF01C5LN3.51.12.B01.1.454.CMB.1.raw
  modified_base (260)..(260): a, c, t, g, unknown or other
  misc_feature (260)..(260): n is a, c, g, or t
  modified_base (373)..(373): a, c, t, g, unknown or other
  misc_feature (373)..(373): n is a, c, g, or t
  modified_base (400)..(400): a, c, t, g, unknown or other
  misc_feature (400)..(400): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttnaggtggaccaacacgtccacgtgggtgccgccacggcccctggaacgagggtcttggagtgggatgggattgggtttagcgtaggagaacgtggtcgaccgtactaaaagttncgacacggtaggtaggtttccgggggntaggggtcagtcaggtacggaccggggactaccgtccacgtacccgacctaaccgtaaacttacgacgtacggtaacgtcgaacccgtagttacgtacgtaacgtttacgtttacggaaccgtaacggtacccgggtcccgttaccgtttaacgtttaccgtcggtaccgaccggtaacgaacgggtaaccggaccggggtaaccgggaacgttacggggtaccggtttacccggtacgttttaccggttacgggttaccggacggttccccttcccggtacccccgtaacggg

SEQ ID NO: 286291 - DNA, 599 bp, Homo sapiens
  misc_feature: GYAE6OF01CWVHS.51.12.B01.1.454.CMB.1.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (392)..(392): a, c, t, g, unknown or other
  misc_feature (392)..(392): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcaggtggtgcagtctggggctgaggtgaagacggcccggggctcagtgaggtctcctgacaagcctctggctacnccttcagtgacaacaacgtccagtgggcnccgccgacggccccgtggaacagggcttggaggtggagtgggtattcgggtttagcgtagacgagtggtcgaccgataaattgtcgactagagggttcgttcggggntagggtcagtcgagtacggaccgggacacgtccagtccgacgaactaactacagtacgactacgactagtacgtagtactagttacgaccgtacgaccggtccgttacttacgttacgtcggtacgacgtaacgaggaacggccggacggacgacggtacggttcgtacgttacgttcggttacgacgtcctcccgtccccgtaagg

SEQ ID NO: 286292 - DNA, 729 bp, Homo sapiens
  misc_feature: GYAE6OF01C1GEN.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaagaacggcccggggcctcgagtgaaggtctcctgcaacgacctcgtggctacgaccttcagtggacaaccaacgtccagtgggtagccgaccgacggccccgttggaaccgaacgggtcttacggaaggtgggagtcggggaatttgggtttagtcgtaggagtaacgtggtcgaccgactaaagttgtgacgtaacgtaggggtacggtttccgggggacgtacggggtacctagttaccgtagtacgggaacccggggacctaaccggtaccaacgttcccgacccgtaactaaacccgttacgtaacggtacgtaaccgtaccgtaacgtacgttacgtacgacttagtttaacgaaccggtacccgtacgggtacccgttacgttacgtttaacgttcgtacggaacgtaacgaacggtaacgggcgggtaaccgggaacgacgggttaagggttccgttacggtttacggttacgggttaccggacggtcccttacccggtcccccgttaaggg

SEQ ID NO: 286293 - DNA, 673 bp, Homo sapiens
  misc_feature: GYAE6OF01EA2RZ.51.12.B01.1.454.CMB.1.raw
  modified_base (395)..(395): a, c, t, g, unknown or other
  misc_feature (395)..(395): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagaacggcccggggcctcgagtgaaggtctcctgcaagacctcgtggcctacaccttcgagtggaccaacaacgtccacgtgggtcgccgccgacggcccctaggacgaagggtccttggacggtggagtgggtattgggtttagtcgtaggacgtaacgtgggtcgaccgtaacgtaaattacgngaccgtaacggtagggtacgggtttacgggggacgtaggggtacctagtacgtacggtacgggaacccggggtaccgtaccggtacctacgtccgacccgaactaaacgttactacgtacgtaacgtacgtaccgtagtctagactagttacgaccgacgtaccgtaccgttacttacgttacgtcgtacgtacgaacgtagacggcggacgacggtaggtacggttcgtacgttacggttcggttaccgtaggtcccttacccgtccccggtaacgg

SEQ ID NO: 286294 - DNA, 618 bp, Homo sapiens
  misc_feature: GYAE6OF01D141N.51.12.B01.1.454.CMB.1.raw
  modified_base (370)..(370): a, c, t, g, unknown or other
  misc_feature (370)..(370): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccgggcctcagtgaaggtctcctgcaagacctctggctacaccttcagtggacaacaacgtcacgtgggtgcgccgacggcccctaggacgaagggtcttggaggtggagtgggattggtttagtctaggagtaacgtggtcgccgtactaaattangacacgaggtaggttcggggacgtagggtcagtcgtagtacggaccgggactacgtaccgacgtaccgacctaacgtaacttacgagtacggaactacgaccagtctacgtactagtttacgaaccgtacgtaccggtaccgttacgttacgttacgtggtacgacggtaacgacggaacggccgggacgggtacgaggtacggttcgtacgttacgtcggttacgagggtccctccgtccccgtacg

SEQ ID NO: 286295 - DNA, 815 bp, Homo sapiens
  misc_feature: GYAE6OF01DTMEP.51.12.B01.1.454.CMB.1.raw
  modified_base (262)..(262): a, c, t, g, unknown or other
  misc_feature (262)..(262): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaacggcccggggcctcagtgaaggtctccgtgcaagacctctgctacaccttnagtggacaacacgtccacgtgggtcgcgccgacggccccgtggacgagggtcttggaggtggagtgggtagttgggtttagtcgtaggaagaacgtgggtacgaccggtaactaaaagttatcggactaacggtaggggttaacgggtttcgggggaccgtaaggggttactaacgttaccggaacggtttaccggggaacccggggggtaacctacccgggtaccccgtaacggttccccggtaacccgtaaaccgtaaaaccgtttaaccgacggtttaaacggggtaaacccttacgggtaaaccccctaagggtttacccgttaacggtaaccctttacggttttaaaccgggaaacccggtacccggtaacccggggttccccgtttaacgtttaactttacggtacggtttaccggaaccgtaacggaaacgggtaaccgggccggggtaaccgggaacggtagggtaccgggtttaccggtaccgttttaaccgggttcggggttaccggaccgggttccccttaccccggtacccccggtaacgg

SEQ ID NO: 286296 - DNA, 647 bp, Homo sapiens
  misc_feature: GYAE6OF01CM8VP.51.12.B01.1.454.CMB.1.raw
  modified_base (389)..(389): a, c, t, g, unknown or other
  misc_feature (389)..(389): n is a, c, g, or t
  modified_base (513)..(513): a, c, t, g, unknown or other
  misc_feature (513)..(513): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagagcccgggctcagtgaaggtctcgtgcaagacctgtggctacaccttcagtcggacaaactaacgtccaacgtcgggtcgccgccgacggcccccgtaggacgaagggtccgttggacggttgggatggggtattgggtttacgtcgtaggaagtacgtggtcgaccgaactaaaattntacgacctaacggaggtagggtttccggggagtacgggtcagtcgagtacgggaccgggactacgtaccgtacgtaccgacctaaccgtaacttacgacgtacggactacgaaccagtacgtanacgtattcgaacgtacgaccggtacgttacttaagttacgtagtcgaccgacgaacggacggacgggacggacggaaggtcggttacgtaccgtttacggtcggttacggacgtcccgtccgtaccccgtacgg

SEQ ID NO: 286297 - DNA, 628 bp, Homo sapiens
  misc_feature: GYAE6OF01AFXWQ.51.12.B01.1.454.CMB.1.raw
  modified_base (252)..(252): a, c, t, g, unknown or other
  misc_feature (252)..(252): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcaggtggtgcagtcgtggggctgaggtgaagacgcccgggctcagtgaagtctcctgcagcctgtgctacnccttcagtcggacaacacgtccacgtgggtcgcgccgacggtcccccgtggacgaagggtcttaggaggtggagtgggtagttggtttagcgtaggacgtaacgtggtacgaccgtaactaaagttgtggactacggagggttacgggttccgggcgtacgggtcagtcgagtacggaccgggactaccgtccacgtcccgacctaactaacgttacgacgtacggtaacgtacgaccgtagtacgtagacgtacgttacgaaccgtcgtaccgtccgttacttacttcgtcgtacgacgacgaggacggcgggacgtacggtaggtcgttacgtcgttacggtcggttacgaccgtcccttccgtccccgtaagg

SEQ ID NO: 286298 - DNA, 766 bp, Homo sapiens
  misc_feature: GYAE6OF01AVIC7.51.12.B01.1.454.CMB.1.raw
  modified_base (196)..(196): a, c, t, g, unknown or other
  misc_feature (196)..(196): n is a, c, g, or t
  modified_base (200)..(200): a, c, t, g, unknown or other
  misc_feature (200)..(200): n is a, c, g, or t
tcagcgatcgtatacacgaccggtgctcgatttagtagtgtagattccgcggggagcatcacccagcaaccacatctgtcctctagagaaccccctgagagccccgctcctcaccatggactggacctggaggatcctcttcttggtggcagcagccacaagagcccactcccaggtgcaggtggtgcagtccggnggtnaggaggtagaagacggcccggctcgagtaggtacgtcctccgtcgacgaacgtcctcggtcgtacctaccttacccgttacgacggtcggaaccaaaccgtacccgtaccgtacggttggggtccgcccggaccggacccggtcccccggtacggaaaccggtaacggggttccgttagggtacgggtagggtagggttagggtagttttagggttttaacgtcgtaggtaacggttaacggtgggtccgacccgtaattaaaagttcgtcgaaccgtaacggaagggtttacggggtttacggggacgtacggggtactacgtacgtaggtaccggggaaccgggacgtacccgtaccgtacgtcccgacccaacttaacctacgacggtaacgtaacgtaccgaccgtgttacgtacgtacttagttaccgaaccgtacccggaccgggttaccgttacttaaccttgtacggtacgaccgtaagaacggacggccgggaccgtacgtaggttccggttccgtacgtttacggtcggtacggacgtccctccccgtcccgtagg

SEQ ID NO: 286299 - DNA, 585 bp, Homo sapiens
  misc_feature: GYAE6OF01DGRCS.51.12.B01.1.454.CMB.1.raw
  modified_base (359)..(359): a, c, t, g, unknown or other
  misc_feature (359)..(359): n is a, c, g, or t
  modified_base (529)..(529): a, c, t, g, unknown or other
  misc_feature (529)..(529): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccacgtgggtgccgccaggcccctggataagggcttgaggtggatgggattggtttagtcgtgagaacgtggtcgccgctaaattntgcacgagggtacggtttcggggctaggggtcagtcgagtcggaaccggggacacgtccacgtccgccaactaacttaccgatggaactcgtaccagtacagtactagtttacgaccgaccgacggtccgttctattacgtgtcgcgaacgaggaacggcggacggacgnggtacggttccgacgttacgtcggggtttacgacggtccttccgccccgtaacggg

SEQ ID NO: 286300 - DNA, 593 bp, Homo sapiens
  misc_feature: GYAE6OF01EPL4V.51.12.B01.1.454.CMB.1.raw
  modified_base (286)..(286): a, c, t, g, unknown or other
  misc_feature (286)..(286): n is a, c, g, or t
  modified_base (381)..(381): a, c, t, g, unknown or other
  misc_feature (381)..(381): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcaggtggtgcagtctggggctgaggtgaagaacgcccggggctcagtgaaggtctcctgcaagacctctggctacaccttcagtggcaacaacgtccagtgggtnccgccacggcccctggacaagggcttgaggtggagtgggtatggtttagtcgtgagacgtggtcgcgataaattgcgcacgaggtggtttcgggntagggtcatcgagtcggaccgggacacgtccacgtccgaccaactaactacagtacggaacgtcgaacgtacgttctacgtactagtttcgaacgtaccgaccgggtaccttacgttacttacgtgtacggcgaacgtaaggacggcggtacggagtaggtcggttcgtacgttacgttcggtacggtacggtcctccccgtcccgtaacgg

SEQ ID NO: 286301 - DNA, 656 bp, Homo sapiens
  misc_feature: GYAE6OF01C4WZ9.51.12.B01.1.454.CMB.1.raw
  modified_base (250)..(250): a, c, t, g, unknown or other
  misc_feature (250)..(250): n is a, c, g, or t
  modified_base (378)..(378): a, c, t, g, unknown or other
  misc_feature (378)..(378): n is a, c, g, or t
  modified_base (409)..(409): a, c, t, g, unknown or other
  misc_feature (409)..(409): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttctggtgcagcagccacaagagcccactcccaggtgcgaggtggtgcagtctggggctgaggtgaaaggacgcccggggctcgagtgaaggtctctgacaagacctgnggactacacttcaggtggacaacaacgtccacgtgggtcgccgccgaacggccccgtagggaaccgaagggcttggagtggagtgggattggttatcgtagagtaacgtggacgccgaataaattagngacacggtaggtaggtttcggggatagggtnagtcgagtacgggaccgggacaccgtacgacgtaccgaccaacgtaaacttaacgacgttaacggaacgttacgaaccgtacgttacgtacggtaactagttttaaccggaaccgtaaccggtaaccgggtacccggtttaaccttaacgtttacccgtaggttaccggacgtaacgaacggaacggaccgggtacggaagaggtcggtacgtacgtacgttggacgaggcctccgtcccgtaacgg

SEQ ID NO: 286302 - DNA, 630 bp, Homo sapiens
  misc_feature: GYAE6OF01CSFYL.51.12.B01.1.454.CMB.1.raw
  modified_base (224)..(224): a, c, t, g, unknown or other
  misc_feature (224)..(224): n is a, c, g, or t
  modified_base (256)..(256): a, c, t, g, unknown or other
  misc_feature (256)..(256): n is a, c, g, or t
  modified_base (366)..(366): a, c, t, g, unknown or other
  misc_feature (366)..(366): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctggaggtgaagaggcccgggcctnagtagaggtctccgtgacaagcctctgctacnccttcagtggacaacaacgtccacgtgggtgcgccacggccccgtaggacagggcttgagtggagtgggagttggtttagtcgtagagacgtggtcgaccgactaaattngacacgaggtacggttcggggacgtagggtcagtcagtcgggaccgggacaccgtccacgtcccgaccgacctaactaccagtacgtaacctcgacctagtctagactagtttacgaaccgtacgacccggtaccgttaccgttaagtttaccgtggtacgaccgtaacgaacggacgggaccgggtacgggaacgtaagggtcggttaccgtacgtttacggttcgggttaccggacggtcccttccccgtaccccgttacgg

SEQ ID NO: 286303 - DNA, 555 bp, Homo sapiens
  misc_feature: GYAE6OF01BLRB2.51.12.B01.1.454.CMB.1.raw
  modified_base (505)..(505): a, c, t, g, unknown or other
  misc_feature (505)..(505): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttggagtggatgggatggtttagtctgagaactggtgccgacaaattatgcacgtagggtaggtttcggggctagggtcagtcagtcggaccgggacacgtccagtcgaccacaacgttacagtggaactcgaccagtctgactattcgacgacgacggtccgttactacttactgtgcgacgagaacggcggacgganaggtacggttccgtcttacgtcgggttcgaggtcctccgtccccgtacgg

SEQ ID NO: 286304 - DNA, 759 bp, Homo sapiens
  misc_feature: GYAE6OF01DZVLN.51.12.B01.1.454.CMB.1.raw
  modified_base (288)..(288): a, c, t, g, unknown or other
  misc_feature (288)..(288): n is a, c, g, or t
tcagcgatcgtatacacgaccggtgctcgatttagtagtgtagattccgcgggggagcatcacccagcaaccacatctgtcctctagagaacccctgagagccccgcctcctcaccatggactggacctggaggatcctcttcttggtggcagcagccacaagagcccactcccaggtgcgaggtggtgcagtctggggctgaggtgaagagcccggggctcagtgaaggtctccgtgcaagacctcgtggctactaccttcagtcggacaacaacgtccactgggtnccgccacggcccctaggacgaagggtcttggaggtggagtgggtattgggttagtcgtaggagtaacgtgggtcgccgtaactaaaattgtcgacaacgtagggtacgggtttacggggctaagggggttcaagttaccgaggttaccggggaacccgggggtacctaaccggttacccgaacgttccggaaccctaaccgtaaaacctttaaccgagttaccggggtaaactaccggtaaccctaaggttcgtaacggtacgttaactttagggaaccctaaccggtaccggggtaccctttaacgttaactttaccggttaggttacggaccggaaccggaaggaaacgggcccgggggaacgggtaaaccgtaggggttaaccgggttacccggtacgttttaccggggttacgggtttaccccggtacggggtacccctttccccggtaccccccgggttaaagggg

SEQ ID NO: 286305 - DNA, 600 bp, Homo sapiens
  misc_feature: GYAE6OF01BJM5T.51.12.B01.1.454.CMB.1.raw
  modified_base (313)..(313): a, c, t, g, unknown or other
  misc_feature (313)..(313): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacacgtccactgggtgcgccaggcccctggacaagggcttggagnggagtgggatggtttagtctggagaactggtcgccgactaaattgtgcgaacgtagggtaggtttcggggacgtagggtccatcgagtacggaccggggacacgtccacgtccgaccacaacttacagtaggaactcgaccagtctagtactagtttacgacgaccgacgggtcccgttacttacgttacgtacggtcgacgtacgaggtacggccgggcggacgaggtacggttacgtccgtttacggttcgggttacgacggtccttcccgtcccccgtaacggg

SEQ ID NO: 286306 - DNA, 571 bp, Homo sapiens
  misc_feature: GYAE6OF01DJYYO.51.12.B01.1.454.CMB.1.raw
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctntggctacaccttcagtggcaacacgtccactgggtncgccaggcccctggacagggcttgagtggatgggatggtttagtctgagtaactggtgccgtacaaaattntgacacgaggtaggtttcggggcagggtcagtcagtcggaccggggacacgtccatccgaccaactaacttcatggaactgacctagtctagactagtttcgaccgacgaccggtccgtacttattacgtgtgaccgtacaggaacggccgggacggacgagggtacggttccgcgtttacgtggttacggaggtcccttcccgtccccgtaacggg

SEQ ID NO: 286307 - DNA, 588 bp, Homo sapiens
  misc_feature: GYAE6OF01EEL98.51.12.B01.1.454.CMB.1.raw
  modified_base (363)..(363): a, c, t, g, unknown or other
  misc_feature (363)..(363): n is a, c, g, or t
  modified_base (491)..(491): a, c, t, g, unknown or other
  misc_feature (491)..(491): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaggggcttggagtggagtgggattggttttagcgttgagaaccgtggtcgccgacaaattgngcacgagggtagtttcggggcaggggtcagtcagtacggaccggggacaccggtccacgtccgaccaactaacttacagtcgaactcgacctagtctacgactagtttcgacgacgaccggtccgttntaacttacgtgtcgaccgagaggaaacgcgggacggacgaggtacgggttcgtaccgttacgttcgggttacggaggtccctcccgtccccgtacgg

SEQ ID NO: 286308 - DNA, 666 bp, Homo sapiens
  misc_feature: GYAE6OF01C3BJQ.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaagaaggcccggggcctcgagtgaaggtctccgtgcaagacctctggctacaccttcagtcggacaacaacgtccacgtgggtcgcgccacggcccccgtggacgaagggtcttggagtggagtgggattggtttagtcgtaggacgtaagttggtaggcccgtaataaagttagtcgacgtaacgagggttacgggtttcggggacgtaggggtactagtcgtagtacgggacccgggacaccgtccacgtccgaccaacgtaacgttacgagtacggaactcgaccgagttacgtagtacgttagtttacggaaccgtaccgaccggtcccgttacttacgttacggtgtacggacgtacgaacggtaggaccgggtacggaacgtagggttacgggttccgttacgtttaccggttcgggttaccggacggttccctcccgtcccccgtaacggg

SEQ ID NO: 286309 - DNA, 607 bp, Homo sapiens
  misc_feature: GYAE6OF01AGQ7K.51.12.B01.1.454.CMB.1.raw
  modified_base (255)..(255): a, c, t, g, unknown or other
  misc_feature (255)..(255): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaggtctctgcaagcctctggctacaccttnagtggcaacaacgtccacgtgggtgcgccacggcccctggacagggcttggaggtggagtgggattgggtttagtcgtaggagtaacgtggtcgccgactaaattacgtcgacgaacgtagggtacgggtttcgggggactaggggtcagtcgagtcggaccggggacacgtccactccgaccaactaacttacagtacggaactcgacctagtctagactagtttcgaaccgtacgaccggtccttacttacttacgtggtacgacgacgaaggaacggccggcggacgtacggtcggttacgtacgtttacggtcgggttaccggacggtcccttcccgtccccgtaagg

SEQ ID NO: 286310 - DNA, 593 bp, Homo sapiens
  misc_feature: GYAE6OF01BWVX4.51.12.B01.1.454.CMB.1.raw
  modified_base (365)..(365): a, c, t, g, unknown or other
  misc_feature (365)..(365): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaaggcccggggctcgagtgaaggtctcctgcaagacctctggctacacttcagtcgcaacaacgtccacgtgggtgccgccaggcccctggacaagggccttggagtggagtgggattgggtttagtctgagtaactgggtcgccgtactaaattntgacaacgagggtagtttcgggggacaggggtaccagtactagtcggaccgggacacgtccagtccgaccactaacttacgagtaggactcgacctagtctagactagttcgacgtaccgcggtaccgtactattcgtagtcgacgtacgagaaggccggtacggacagggtacggttccgacgtttacgttcggttacgacggttccgtacccgtccccggtaacgg

SEQ ID NO: 286311 - DNA, 572 bp, Homo sapiens
  misc_feature: GYAE6OF01C2O05.51.12.B01.1.454.CMB.1.raw
  modified_base (297)..(297): a, c, t, g, unknown or other
  misc_feature (297)..(297): n is a, c, g, or t
  modified_base (506)..(506): a, c, t, g, unknown or other
  misc_feature (506)..(506): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagacgcccactcccaggtgcaggtggtgcagtcgtggggctggaggtgaagacggcccggggcctcgagtggacggtctcctgacagcctgtcgactaccaccttgagtcggacaaccgaaccgtccacgtgggtcnccgccacggccccgtaggaacgaggtcttggaggtggagtggagttggtttagcgagacgagtggtcgaccgataaattgcgacgacgtagggttcggttcgggactagggtcagtcgagcgggacggactccgtacacgtccgacactaacgtcacgacgtaactcgactagtcgatacttgtacgacggacgcgtcctattattcgngtacgacgtagaggacggcggacgacgtaggtactgtacttcggtcgtacgctcctcccgtcgtag

SEQ ID NO: 286312 - DNA, 599 bp, Homo sapiens
  misc_feature: GYAE6OF01ERE6O.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcgagtgaaggtctcctgcaagacctctggctacaccttcagtggcaacaacgtccacgtgggtcgcgccgacggcccctggacgaaggggcttggaggtggagtgggagttggtttagtctgagtaactggtcgcgactaaattatgacacgaggtaggtttccggggcgtagggtcagtacgagtacgggaccgggacgaccgtccagtccgaccaacaacttacagtacggaactcgacgacgtcgtacgactagttagaccgtacgaccggtccgttacgttacttacgtgtcgacgtacgacggacgacgggcggaacgaggtacggttacgtacgttacgttcgggttacgacggtccttccgtccccgtagg

SEQ ID NO: 286313 - DNA, 726 bp, Homo sapiens
  misc_feature: GYAE6OF01CM30J.51.12.B01.1.454.CMB.1.raw
  modified_base (395)..(395): a, c, t, g, unknown or other
  misc_feature (395)..(395): n is a, c, g, or t
tcagcgatcgtatacacgaccggtgctcgatttagtagtgtagattccgcgggggagcatcacccagcaaccacatctgtcctctagacgaaccccctgagacgccccgctcctcaccatggactggacctggaggatcctcttcgttggtggcagcagccaacaagacgcccactcccgaggtcgcgagggtggtgcgtagtcgtggggctggaggtagaaggacggcccggggtcctcgaggtgaacggttcctaccgtggacaacgtccgtcgtcggcctacctaccttcgaggtcgaccaaaccgtaaccgtccaggttgggcgccggaccacgggccccgtaggaaccgtagggtccttaggacggtggtagtgggtattagggtttacncgtagaagtacgtggtacaccgaataaagtttcgagactaacggtaggttacgggtttacgggacgttagggtctaacggtaccgaggtacgggaaccgggacctaccggtacctaacgtcccgacctaacgtaaacgttacgacgttacggaaccttacggaccgttaggtactacgtaacttaggtttaccgaacgaccggtaccgtcgttacttagttacgtgtacggacgtaacggtacggacggaccgggacgacggtaaggttccggtttaaccgtacgttttacggtccgggttaccggagttccctaccccggtacgtaacgg

SEQ ID NO: 286314 - DNA, 608 bp, Homo sapiens
  misc_feature: GYAE6OF01CZCIK.51.12.B01.1.454.CMB.1.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (345)..(345): a, c, t, g, unknown or other
  misc_feature (345)..(345): n is a, c, g, or t
  modified_base (373)..(373): a, c, t, g, unknown or other
  misc_feature (373)..(373): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaagcccggggctcagtgaggtctcctgcaagacctctggctacnccttnagtggaccaacaacgtccacgtgggtgccgccacgggccccctaggaacgaagggtcttggacggtggagtgggtattgggtttancgtagagtactggtgccgtataaaattntgacaacgaggtaggtttcggggatagggtcagtcagtcggaccgggacacgtcacgtccgaccaacaaccttacgagtacggaactcgaccagtctagaactagtttacggaccgaacgtaccggtccgttactacgtttacgtcggtgaccgtagaaggacggccgggacgacgaggtacggttcgtacgtttacggtcgggtttacggagtccgtcccgtccccggtaacgg

SEQ ID NO: 286315 - DNA, 616 bp, Homo sapiens
  misc_feature: GYAE6OF01ERVVK.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtgcgccacggcccctggacaagggcttgagtggatgggattggtttagtctgagaacgtggtgccgactaaattatgcaaccgagggtaacggtttcggggcgtaaggggtcagtcgaagtgggaaccggggacaccgtccagtaccgaccgaactaaacttaccgagttacggaaacttcgaaccgtacgttctagtactaacgttttcgaaccgtaccgaccgggtccgttacttaacttacgtgtcgaccgaactaacggaacggtcgggacggaacgaggtacggttcgtacgttacgtcggttacggacggtcctccgtccccgtaacgg

SEQ ID NO: 286316 - DNA, 611 bp, Homo sapiens
  misc_feature: GYAE6OF01CRJL1.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggacaacaacgtccacgtgggtcgcgccgacggcccccgtggaccgaaggggcctttaggaggttcgggagtggggtattgggttttaacgtcgtaggaagtaacgtgggtcgccgtactaaagttagtcggcaacgtagggtacggtttcggggacgtaggggtcagtcgagtcggaccgggacacgtcacgtccgaccaactaacttacagtacggaactcgacctagtctagactagtttacgacgacgaccggtccgttacttacttacgtgtcgcgacgagacggcggacggagaggtacggttcgtacgttacgtcggttacgagtcctcccgtcccgtagg

SEQ ID NO: 286317 - DNA, 590 bp, Homo sapiens
  misc_feature: GYAE6OF01AM5XV.51.12.B01.1.454.CMB.1.raw
  modified_base (367)..(367): a, c, t, g, unknown or other
  misc_feature (367)..(367): n is a, c, g, or t
  modified_base (466)..(466): a, c, t, g, unknown or other
  misc_feature (466)..(466): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctctggcctacaccttcagtggacaacaacgtccacgtgggtgccgccacgggccccctggacgaagggcttggaggtggagtgggattgggttagtcgtgagaacgtggtcgccgacaaattngcacgaggtaggtttcggggactagggtcatcgagtcggaccggggacaccgtccatcccgaccactaacttacagtacggaactcgacctagtcgtanactattacgaaccgacgtaccggtccgttctattactgtcgtaccgagaggaacggcggtaccggagaggtcggttccgtacggtttacgtgggttacgacggtccttcccgtccccggtaagg

SEQ ID NO: 286318 - DNA, 701 bp, Homo sapiens
  misc_feature: GYAE6OF01DDD4C.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcaggtggtgcagtcgtggggctgaggtgaagaggcccggggcctcgagtgaggtctcctgcaacgacctcgtggctacctaccttcgaggtggacaaacctaaccgtccacgtgggtgccgcccgacgggcccccgtggaacgaacggggtcttaggaggtgggagtggggtagtttgggtttagcgtagagtaacgtggtcgaccgataaattgtcggactacggtagggttacggtttcgggggacgtacgggtctagtcgtaaggtccgggaacccggggactacccgtaccgaacgttccccgaaccgtaaaccgtaaactttacgaagttacgggaacttacggaacccgtaacgttcgtacgtaacttacgtttaacgaaccggtacgacccgggtccttaagttactttaccgtgtaccggaaccgacgaaacgggacggtccgggacgaacggtaggttacggttccgtacgtttacggtacggttacggcgtccctcccgtccccgtaagg

SEQ ID NO: 286319 - DNA, 599 bp, Homo sapiens
  misc_feature: GYAE6OF01AM9H1.51.12.B01.1.454.CMB.1.raw
  modified_base (369)..(369): a, c, t, g, unknown or other
  misc_feature (369)..(369): n is a, c, g, or t
  modified_base (513)..(513): a, c, t, g, unknown or other
  misc_feature (513)..(513): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagcctctggcctacaccttcagtggcaacaacgtccactgggtgccgccagggccccctggaccaagggccttaggaggtggagtgggattgggtttagtctggagtaacgtggtcgccgactaaaattntgacacgagggtacggtttcgggggcgaggggtcagtcgagtcggaccggggacaccgtaccgacgtcgacccaactaacttacagtcggaactcgaccagtctgactagtttacgacgacgtaccggcgttctacttacgtgngcgacgagtaacggccggacgggtagaggtcggttacgtcgtttacgtcgggttaccgagggtcccttcccgtaccccgtaacggg

SEQ ID NO: 286320 - DNA, 265 bp, Homo sapiens
  misc_feature: GYAE6OF01B6RW9.51.12.B01.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
  modified_base (263)..(265): a, c, t, g, unknown or other
  misc_feature (263)..(265): n is a, c, g, or t
tcagcgatcgtatacacgaccggtgctcgatttagtagtgtagattctctggctccaggtcagggacaacggtcacattggccatcagtggagtccaggcagaggacgaggctgactattattgtcaatcaacagacaccattggtacttatgtcttcggaactgcgaccaggtcaccgtcctgggcagcccaaggccaaccccatgtcactctgttcccacctctctcgancactcgtgagcggtctggacaaggcnatagnnn

SEQ ID NO: 286321 - DNA, 555 bp, Homo sapiens
  misc_feature: GYAE6OF01BJ5Z2.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggacaacaacgtccacgtgggtgcgccacggcccctggacaagggcttggagtggatgggattggtttagtctgagacgtggtcgccgacaaattatgacagaggtaggtttcggggctagggtcatcgagtcggaccgggacacgtccactcgaccaactaacttacagtacggaactcgacctagtctgactattgacgacgacggtcctacttatacgtgtcgcgacagaggcggcggagaggtacggttcgtcgttacgtcggttacgaggtcctccgtccccgtacgg

SEQ ID NO: 286322 - DNA, 247 bp, Homo sapiens
  misc_feature: GYAE6OF01A2JKH.51.12.B01.1.454.CMB.1.raw
  modified_base (229)..(247): a, c, t, g, unknown or other
  misc_feature (229)..(247): n is a, c, g, or t
tcagcgatcgtatacacgaccggtgctcgatttagtagtgtagattccgcgggcacgaccggtgctcgatttagtagtgtagattaccggacgggtgctcgatttagtagtgtacgacttccgcggcacgaccggtgctcgatttagtcacgcgagaaagggaaggcagcgtcactctgttcccgccctcctctcgtagcactctgagcgggctggcaaggcgcatagnnnnnnnnnnnnnnnnnnn

SEQ ID NO: 286323 - DNA, 591 bp, Homo sapiens
  misc_feature: GYAE6OF01CKM4U.51.12.B01.1.454.CMB.1.raw
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
  modified_base (360)..(360): a, c, t, g, unknown or other
  misc_feature (360)..(360): n is a, c, g, or t
tcagcgatcgtatacacgaccggtgctcgatttagtagtgtagattccgcgggggagcatcacccagcaaccacatctgtcctctagacgaaccccctgagagcccccgctcctcaccatggactggacctggaggatcctcttcttggtggcagcagccaacaagagcccactcccaggtgcagggtggtgcagtcgtggggctggaggtgaagacggcccggggctcgagtgaaggtctccgtgacaagacctcgtggcctacaccttcgagtggacaacaacgtccagtgggtcnccgccacggcccctggaccgaggcttgagtggatgggattggttancgagagacgtggtacnccgaataaattgcgacgacggtagggtcgggtttacgggcgtagggtacagttacgagtacgggaccgggtacaccgtcactcgaccaactaactacgagtacgaactcgacagtctagactattcgacacgaccgtctacttacgttacgtgcgtacgacgacgtaggccggcgacggtaggtcggttcgtcgttacggttcggtcgacggtcctcccgtcccggtacgg

SEQ ID NO: 286324 - DNA, 793 bp, Homo sapiens
  misc_feature: GYAE6OF01BS0DA.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaagcccggggcctcgagtgaaggtctccgtgacaagacctctggctacaccttcagtcggacaacacgtccacgtgggtcgcgccgacggcccctggaccagggcttggacgtggagtgggtattgggtttacgtcgtagaaggtaacgttgggtcgaccgtacgtaaaagttgtagaccgaagtaaggggtacggttttaccgggggacgtaacggggtacctagtaccgtaagttccgggaacccgggggtacctaccgggtacccgtaacggtacccgacccgtaaacgtaaaccctttaaccgacggttaaccggtaaacgttaccggtaacccgtaacggtttaccgttacgtaaccgttaacgtttacgaaacccggtaccggtacccggggtacccgtttaccgtttaacgtttaaccgttcggtaccggtaccgtaaaccggtaacgggaaaccgggaccggggtaaccgggtaaccggtaacggggttaccgggtttacccgttacggttttaccggttaccggggttaccgggtaccgggttccccttaccccggttccccccggtaaacggg

SEQ ID NO: 286325 - DNA, 939 bp, Homo sapiens
  misc_feature: GYAE6OF01CU7YA.51.12.B01.1.454.CMB.1.raw
  modified_base (285)..(285): a, c, t, g, unknown or other
  misc_feature (285)..(285): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtcgtggggctggaggtgaagaacggcccggggcctcaggtgaaggtctccgtgacaacgtaccctcgttcgggaccttaacctaccccgtttnaacgggttcgggaccaaaaccgtaaacccggttcccgaaccggttcggggggttacggccccggaccccggaccggggtcccccccggttaggggaaacccggaaacggggggtccgttttagggaagggttggggtaaggtttgggggggtaatttttacgggggttttaacgttcccggttagggaacgggtaaaccggttgggggttacggaaccccgggtaaccttaaaaagtttacgtacgggacctaaacgggtaacgggggtttaccggggttttaccgggggggacgtaacgggggtttcctaaggttacccgtagggttaaccggggaccccgggggtaacccgtaacccgggttacccgtaaccggtacccccgggtaaccctaaaccgttaaaaccccgtttaacgtaacggttaaccgggtaaaccgttccggtaacccgtaacggttaccgttacggtaaccgttagtttaaccggaacccggtaccggtacccgggtccggttacttaacgtttacggtcgttacgggaacccgtaagacggaacgggccgggaccgggaacggtagggttccgggttaccggttacgtttaccggttcgggtttaccggaggttccccgtcccgttcccccggtaaggg

SEQ ID NO: 286326 - DNA, 794 bp, Homo sapiens
  misc_feature: GYAE6OF01EKTQD.51.12.B01.1.454.CMB.1.raw
  modified_base (447)..(447): a, c, t, g, unknown or other
  misc_feature (447)..(447): n is a, c, g, or t
tcagcgatcgtatacacgaccggtgctcgatttagtagtgtagattccgcgggggagcatcacccagcaaccacatctgtcctctagacgaaccccctgagacgcccccgctcctcaccatggactggacctggaggactccttcttcgttggtggcagcagccacaagacgcccactcccgaggtgcgaggtggtgcaggtcgtggggctggaggtagaaggacggccccgggtctgaggtgaacggtcctccgtgacaacgtcctcgtggcctaaccgtaccttcgagtaggaccaaaccgtaccgtccacggtcgggtacgccggacccgacggtcccccgtagggaaccggtaacggggtcttagggaggtacggtaggtgggtagtttagggttttacgcgttagggaacgtacggtgggtaccgaccgtaataaagttcgnggaccgaacggtaggggttacgggttaccggggacgtagggtactagttaccggacggtacgggtaacccggggacctaccgtacccgtaacgtaccccgaacctaaacgttaaccgtaacgtagaaccggtaacctcgtaaccgtaggttactacgacgtttacgttacggaaccgttaagacggttaccggtacgtttacgttaagttaccgtaggtaccgaacgaccggaaacggtaacggggccgggttaaccggaacgggttacgttacccgggggtttacttaaaccgggtttcgggttaccgggaaccgtcccgggtttccctaaccccccggtaacggg

SEQ ID NO: 286327 - DNA, 698 bp, Homo sapiens
  misc_feature: GYAE6OF01BVAY6.51.12.B01.1.454.CMB.1.raw
tcagcgatcgtatacacgaccggtgctcgatttagtagtgtagattccgcgggggagcatcacccagcaaccacatctggtcctctaggagaaccccctgagagccccgctcctcaccatggactggacctgggacggatcctcttcttggtaggcagcagccacaagagccctactcccaggtgcaggtggtgcagtctggggctgaggtgaagaagcccggggctcagtgaaggtctcctgcaagacctctggctacaccttcagtcggcaacacgtccacgtgggtcgcgccaggcccctggaccaagggcttggagtggagtgggattggtttacgtcgtgacggtaacttgggtcgaccgacgtaaattacgtcgcacgtagggtagtttccgggggactaaggggtcaagttacgagtacggtaaccggggaccgaccggtaccgaacgtaccgacccgaaccgtaaaccgttaccgtaacgtacggtaacccgtacggtaacccgtacggtaccgttacgaccttacgtttacggaaccgtaaccggtaccggtcccgttacgttactttaccgtcggtacgtaccggaacggtaacggaacggtaccgggtaccgggaacgtaacggtacgggttaccgtaccgttaccgttcgggttaccggaccggtccctcccgtcccccgtaacgg

SEQ ID NO: 286328 - DNA, 670 bp, Homo sapiens
  misc_feature: GYAE6OF01CLTQ3.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctggaggtgaagagcccggggctcagtgaaggtctcctgcaacgacctctggctaccaccttcaggtggaccaaacaaccggtccacgtggggtcgccgcccgacgggcccccttagggaacgaagggggtctttaggaggtcgggaatggggatttgggttttaagtcgtggaagaacgtgggtcgaccgactaaaattgtgcaacgaggggtaggtttccgggggactacggggtcagtcgagtcgggaacccggggacacgtccagtccgaccaacgtaacttacagtacggaactcgaacctagtctagtaacctagtttaccgaacgtacgaccgggtccgttacttaacgttacgtggttcggacgtaacgtaaaggacgggtacgggcggaagtagggtaccggttacggtaccgtttacggtcgggttaccggtacgggtcccttcccgtcccccgtaacggg

SEQ ID NO: 286329 - DNA, 1016 bp, Homo sapiens
  misc_feature: GYAE6OF01AZXPA.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtgcagtcgtggggctggaggtagaaggaacggcccggggcctcgaggtgaacggtcctcctgacaacgtaccctcgtcggcctactaccttcaggtacggacaacgaaccgtccacggtcgggtcgccggtcccgaccgggtcccccgtagggaaccggtaacggggtccgttaggaggtacgggtaggtaggggtagtttagggttttacgtcgtaggtaagtaaccggttggggtcgaccgtaacgtaaagttacgtacggaaccgtacggtaacggggttacggggtttaccgggggacgttaacggggttaccgtaaggttaccgtaacgggtaccgggggaacccgggggtaacctacccggggttaacccgacggttaccccggaaacccgttaaaccgttaaaaccgttttaacccggtaacgggttaaccggggtaaaacccgttaccgggtaaaccccgtttaacggttacccggttaacggttaaaccggtttaaccgggtttaacccgggaaaaccccgggttaccccgggtaaaccccggggttacccccggttttaaacgttttaaccgttttaacccgggttacccggggttaaccgggtaaacccccggtaaaaggggttaaccccgggaaaaccgggggtcccggggggttaaaacccggggtaaacccggttaaccggggggtttaaacccggggttttacccgggttaaacccggtttttaaaccgggggtttcccgggggtttaaccgggggtaacccccggtttaccccccggttaccccccggttaaccccccggggtttaaacggg

SEQ ID NO: 286330 - DNA, 606 bp, Homo sapiens
  misc_feature: GYAE6OF01BWFS7.51.12.B01.1.454.CMB.1.raw
  modified_base (395)..(395): a, c, t, g, unknown or other
  misc_feature (395)..(395): n is a, c, g, or t
  modified_base (522)..(522): a, c, t, g, unknown or other
  misc_feature (522)..(522): n is a, c, g, or t
  modified_base (551)..(551): a, c, t, g, unknown or other
  misc_feature (551)..(551): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcgagggtggtgcagtcgtggggctggaggtagaaggacggcccggggcctcgagtgaaggtcctccgtgacaacgacctctggcctacaccttcgaggtcggacaacctacgtccacgtgggtcgccgccgaccggtccccgtaggacgagggtcttggacggtagggtagtgggtagttggttagtcgtagagtacgtggtcgctaataagtncgactacggaggtcggttacgggcgtaggtcacgtcgacgtcggaccgggtacaccgtctacgccgaccgactaacgtacagtacgactacgactgtctagactagtcgacgacgcgtcttacgttntacgcgcgacgagacggacgacggcgtanacgggtcgttaccgtcgttacggttcggtacggtcgtccctcccgtaccgtacgg

SEQ ID NO: 286331 - DNA, 684 bp, Homo sapiens
  misc_feature: GYAE6OF01BGE1N.51.12.B01.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagcgatcgtatacacgaccggtgctcgatttagtagtgtagattccggtcgggggtaggcatcacccagcaaccacatctgtcctctagagaacccctgagacgccccgctcctcaccagtggactggacctggagagtcctcttcgttggtcggcagcagccaacaagagcccactccccaggtcgcaggtggtgcagtctgggctgnggtgaagagcccgggctnagtgaagtctccgtgacaagcctcngactaactacctttacagtcgacaacaccgtaccaacgtgggtacgccgaccgcggcccctaggaccgaacgggtcttaggagtcggatacgggtacttaggtttaagtcgtaggaacgtaacgtggtcgaccgtactaaagttgcgacgtaacggaggttacggtttacggggactaagggtcctacgtacgtaacgtcggaccgggtactaccgtctacgtccgacctaaccgtaaacttacgacgttacggtaactacgtaacctagtactacgtaacttacgttacgaaccgtacgtacggttcccgttacttaacttacgttcgtccggacgtaacgtaggaaccgacggtaccggtaacgtacgggtacggttccgtacgttacgttcggtaccgtaaccggcccttcccgtaccccgttacgg

SEQ ID NO: 286332 - DNA, 716 bp, Homo sapiens
  misc_feature: GYAE6OF01A5RW1.51.12.B01.1.454.CMB.1.raw
  modified_base (409)..(409): a, c, t, g, unknown or other
  misc_feature (409)..(409): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagaacggcccggggcctcagtgaaggtcctccgtgacaagtaccctctcggcctacgaccttcgaggtcggaccaaacgaaccgtccacgtgggtcgccgcccgacggcccccgtaggaaccgtaaggggtctttggaggtggagttcggggtatttgggtttagcgttaggagtaacgtggtacgccgtaataaagttntacggcaacggtagggtaggtttccgggggacgtagggtctacgtcgaacgtacgggaacccgggaccgtaccgtaccgacgttccgaccgtaacctaactaaccgtagtacggtaacgtacgtaaccgtacgtacgtacgtactagtttacgaaccggtaccgtaccggtaccgttaccttacgttacgttcgtacggaccgtaaccgaaggacggaccgggaccggtacgacgggtacggttaccgtaccggtttaccggttacgggttaccggacggttccccttccccgtacccccgtacggg

SEQ ID NO: 286333 - DNA, 158 bp, Homo sapiens; identical to SEQ ID NO: 286242
  misc_feature: GYAE6OF01BJ5L0.51.12.B01.1.454.CMB.1.raw
  modified_base (157)..(158): a, c, t, g, unknown or other
  misc_feature (157)..(158): n is a, c, g, or t

SEQ ID NO: 286334 - DNA, 620 bp, Homo sapiens
  misc_feature: GYAE6OF01DE5W1.51.12.B01.1.454.CMB.1.raw
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccgaggtgcaggtggtgcagtctggggctgaggtgaagagcccgggctcagtgagtctcngcanactgtgctacnctnagtggacaacgacgtccagtggtgccgccaggcccctggacgaagggcttggagtggagtgggtagttggtttagcgtaggagtacgtggcgtacgataaaagttgtgcaacgtaggtaggttcggggagagggtcagtcgagtacgggaaccgggtacaccgtccaacgtccgacctaaccgtaactacgacgtaggtaaccctcgaaccgtacggttaccgtacgtaccgttagtttacgaaccggtaccggtaccgggtccgttacttacttaaccgtgtaccgtacgtacgaacggacggcggacggtagacggtacggttcgttacttacggttcggttacggacggtcctcccgtccccgtagg

SEQ ID NO: 286335 - DNA, 754 bp, Homo sapiens
  misc_feature: GYAE6OF01BW0JV.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaaacggacggccccgggggcctcgaggtggaaggtcctccgtgacgaagaccctctggacctaccaccctttcgaggttcggaccaaaccgaaccgtccctacggtgggtacgccgacccgaccggggcccccgtgggaaccgtaacggggtccgttggaggtcgggaggtcgggtaagttgggtttagtcgtaggtacggtaacgtggggtacgaccgtaacgtaaatttcgacggactaacggtacggggttacgggtttcggggacgtagggtcagtacgaggtcgggaacccgggtaccacgtaccacgtacccggaaccaactaaacccgttagacgtacggaaccgtacgaccgtacgttactacggtactacgtttcggaaccgtaccgaccggtacccgtttacttaacgtttaccgtcggtaccggacgtaacggaaggtaacgggtccgggacggtaagaacgggttcggttaccgttcgtttaacggttcgggtttacccggaccgggttcccctccccggtaccccgttaggg

SEQ ID NO: 286336 - DNA, 831 bp, Homo sapiens
  misc_feature: GYAE6OF01BBNFZ.51.12.B01.1.454.CMB.1.raw
tcagcgatcgtatacacgaccggtgctcgatttagtagtgtagattccgcgggggagcatcacccagcaaccacatctgtcctctagagaaccccctcgagagccccgctcctcaccatggactggacctggaggatcctcttcttggtggcagcagccacaagagcccactcccaggtcgcaggtggtgcagtctgggctgaggtgaagacgccgggcctcagtgaacggtctaccgtacgacgaacggtacctcgtcggtctacctaccgtttcgagttacgggaccaaaccgtaaccgttaccctaacggtcggggttacggccggtaccccggaccgggtacccccgttacggggaaaccggtaacgggggtcccgtttaggggtaacgggttggggtagggttacgggggtacggtttaggggttttaacgtcgttagggtaaccggtaaccgttggggtaccgaccggtactaaaagttacgtacgacgaaccgttagggtagggttttacccggggacggttaagggttacctaagttccggaagttaccggggaaccggggtaccctacggtacctaacgttacccgacctaacgtaaaccttacgaagttcggtaaactccggtaaaccgtagtccttaggtaacgttagtttacggaaccggtaaccgtaccgggtaccgtttacgtttaacttacggtacgtagaccgtacggtaaacgtacggtcccgggtacggaacgttaggttacccgggttacttacggtttaaccggttcgggttacccgtacggtaccccgttcccggtccccggtaaagggg

SEQ ID NO: 286337 - DNA, 695 bp, Homo sapiens
  misc_feature: GYAE6OF01BRE2I.51.12.B01.1.454.CMB.1.raw
  modified_base (239)..(239): a, c, t, g, unknown or other
  misc_feature (239)..(239): n is a, c, g, or t
  modified_base (250)..(250): a, c, t, g, unknown or other
  misc_feature (250)..(250): n is a, c, g, or t
  modified_base (287)..(287): a, c, t, g, unknown or other
  misc_feature (287)..(287): n is a, c, g, or t
tcagcgatcgtatacacgaccggtgctcgatttagtagtgtagattccgcgggggagcatcacccagcaaccacatctgtcctctagagaaccccctgagagcccagctcctcaccatggactggacctggaggatcctcttcttggtggcagcagccaacaagacgcccactcccgaggtcgcgagggtggtgcagtcgtggggctggaggtgaagacggccgggctcgagtgagtcnctgacagcctnggctacacctcgagtcgacaacacgtccagtgggtcncgccgacggcccgtaggacgagggtctggagtggtagtgggtagttgggtttacgtacgtaggaacgtaacggtcggtacgaccgtataaacttgtcgacgtacggagggttagggttcgggagacgggtcagtacgacggtacgggaccgggtactaccggtaccgtacgtaccgaaccctaaccgttaaccgttacgacggttacggaacctacggtaccgtacggtacgtacgtaacgttacgttaaccgggaaccgtaaccggtacccggtacgtttacttaacggttacgtcggtaacgacggtacgaacgggtaccgggcggtaaccggacggtacgggttacggttaccgttacgttaccgggttcggttaaccggccgttccgtccccggttaacccggg

SEQ ID NO: 286338 - DNA, 553 bp, Homo sapiens
  misc_feature: GYAE6OF01BCV6Y.51.12.B01.1.454.CMB.1.raw
  modified_base (352)..(352): a, c, t, g, unknown or other
  misc_feature (352)..(352): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaggtctcctgcaagcctctggctacaccttcagtggcaacaacgtccacgtgggtgcgccacggcccctggacaagggcttgagtggagtgggatggtttagtctgagactggtgccgactaaattntgcacgaggtagtttcggggcagggtcagtcagtggacccgggacacgtccacgtccgaccaactaacttacagtacgggaacttcgaccagtctagactagtttcgacgacgaccggccttcttacttacgtgtcgcgacgagaggcgggcgagaggtcgttcgtcttacgtgggttacgacggccttccgtccccgtag

SEQ ID NO: 286339 - DNA, 667 bp, Homo sapiens
  misc_feature: GYAE6OF01B5D8A.51.12.B01.1.454.CMB.1.raw
  modified_base (251)..(251): a, c, t, g, unknown or other
  misc_feature (251)..(251): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtagaagaacgcccggggcctgagtgaacgtcctcctgacaagcctntggactacaccttcgagtggaccaacaaccgtccacgtgggtcgccgccgaggcccctggacgaggtcttggagtggagtgggtacgttggtttacgtcgtagacggtaacgtgggtacgaccggataaaaacttgtggaccgtaacggtacgggtacgggttttccggggacgtacggggttaccaagtcgtacgtacgggaacccggggtactaccggtacctacgttacccgacctaaccgtaaacttacgaagtacggtaactcgactagtctagactagttacgacgtacgacggtacccgtacgttacttcgtgtacgacgaacgacggaacggacgggcgtaacggtaggtccggttacgtacggttacgttacgggttacgacggtcccgtacccgtccccggtaagg

SEQ ID NO: 286340 - DNA, 797 bp, Homo sapiens
  misc_feature: GYAE6OF01B5SCF.51.12.B01.1.454.CMB.1.raw
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
tcagcgatcgtatacacgaccggtgctcgatttagtagtgtagattccgcgggggagcatcacccagcaaccacatctgtcctctagacgaaccccctgagagccccgctcctcaccatggactggacctggaggatcctcttcgttggtggcagcagccacaagacgcccactcccagggtgcgaggtggtgcagtcgtggggctggagggtagaaggaacggccccggggccttgagtgaaggtctcctgaccaagcctntggcctacctccttgagtggacaacgaacgtccacgtgggngccgccgacggccccgtaggaccgagggtctggaggtaggtagtggggtacttgggttttacgtcgtaggacgtaacgttggggtacgcccgtagtaaaattggtcgacgtaaggtagggttacgggtttccggggacgtaggggtcctagttaccggaacggttacggggaacccgggtaacccgtaccgtacccgacggttacccgacccgtaactaaccgttaacgacggttaccgaaaccgttacggtaaccgtaacggttccgttaacggtaacccgtttaagttttaccgggaacccggtaaccggtacccggggttacccgtttaccgtttaacgtttaccggtacggttcggaacccgtaacggtaacgggaacccgggtaccgggaacccgggaccgttaacgggtccgggtttaccgtaccgttttacgggtacggggttaccggtaaccgggttccctcccccggtaaccccggttaacgggg

SEQ ID NO: 286341 - DNA, 698 bp, Homo sapiens
  misc_feature: GYAE6OF01BGCM6.51.12.B01.1.454.CMB.1.raw
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
tcagcgatcgtatacacgaccggtgctcgatttagtagtgtagattccgcgggggagcatcacccagcaaccacatctgtcctctagacgaaccccctgagacgcccccgctcctcaccatggactggacctggaggactcctcttcgttggtggcagcagccacaagacgcccactcccaggtgcgaggtggtgcagtcgtggggctggaggtagaagacggcccgggctgagtgacgtctccgtgacaacgtcctcgngacctactaccttgagtcgacaaccgacgtccaggtggcgccgccgaccgtcccgnggacgaggtctggaggtggagtgggtatttggttacgcgtagacgtacgtggtaccgaccgtaaattaaagttgacgacggtaacggtaggggttcggttcggggacgtacggtactaggtacgtacggtacgggaccggtaacgtaccgtaccgacgtccgaaaccgtacctaaacgttaacgacgttacgaacgttccgaacgttcgtacgtagtaacgttacgttacgaaccgtaccggacccggttaccttacgttagttacgtaggtaacgaccgtaaacggacggtacggaccggaaccggtaggtacggttacccggttacgtacgggtttacggttccgggtaaccgttacggtcccttacccgtcccggtaag

SEQ ID NO: 286342 - DNA, 689 bp, Homo sapiens
  misc_feature: GYAE6OF01CP92J.51.12.B01.1.454.CMB.1.raw
  modified_base (216)..(216): a, c, t, g, unknown or other
  misc_feature (216)..(216): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
tcagcgatcgtatacacgaccggtgctcgatttagtagtgtagattccgcgggggagcatcacccagcaaccacatctgtcctctagacgaaccccctgagagcccccgctcctcaccatggactggacctggaggactcctcttcgttggtggcagcagccaacgaagacgcccactcccaggtgcagggtggtgcgagtcgtggggctggaggngaaggacggcccggggctgagtgacgtctctgacacgctgtgactactccttgngtcgacaacacgtccngtggtcnccgcgccggcccgtaggacgaggtcttaggaggtggtagtgggtagtttgggttacgtcggtagaacggtagttcgggcgtaaccgtaagttaaacttggacgtacgacgggtacgggttacggggttccggggagtacggggtctaacggtcgacgggtaccgggtaacccgggactaccggtaccctacgcccgtaactaaccgtaacttacgaggtaccggtaactcgacgtcgtaccgtagtaaccgttggtaccgaaccgtaccggtaccgttacgtacttaacgttcgtcggcgaaccgaaggacggaacgggcgggtaacgaggacgggttcggttaccgtacggttacgttcgggttacccgacggttccctccccgtacccggtagg

SEQ ID NO: 286343 - DNA, 724 bp, Homo sapiens
  misc_feature: GYAE6OF01BQOE1.51.12.B01.1.454.CMB.1.raw
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
tcagcgatcgtatacacgaccggtgctcgatttagtagtgtagattccgcgggggaggcatcacccagcaaccacatctgtccttctagagaaccccctgagagcccccgctcctcacccatggactggacctggaggatcctcttcttgggtggctagcagccaacaaagacgcccactcccaggtgcgaggtggtgcagtcgtggggctggaggtgaagacggcccggggcctcgagtgaaggtctcctgcaagacctgcggctacnccttnagtgacaacacgtccagtggtcgcgccacggccctggacgagggtctggaggtggagtgggtagttggttagtcgtgtagtacgtgggtgaccgataaagttagcggactaacgtaagggttcgggtttcggggacgtaagggtacacgtacgacgtccggggaaccgggtaccaccgtccaacgtccccgaacctaacgtaaccgttaagacgttaaccgggactacgtaccgtagttcacgttaaccgttagttaccgaacggaaccgtacccgggtacccgtttacttaaacgttccggtaggtaccggaacggtaacggtaaacgggaaccggggtacccgggtaccgggtaaggttacgggttacccgggttaccggttaccgttttaacgggtccggggtttacggaaccccggtcccctttacccccggaccccggtacgggg

SEQ ID NO: 286344 - DNA, 790 bp, Homo sapiens
  misc_feature: GYAE6OF01CSFD7.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggaggactccttctttcttggtggcagcagccaacaagacgcccactcccaggtgcagggtggtgcagtcgtggggctggaggtagaagacggcccggggcctcgagtggaacggttcctccgtagaccaacgaccctcgtcggcctaccgtaccttcgaggtcggaccaaactaaccgtccgtacggtggggtcgccggaccccgacgggcccccgtagggaacgaacgggtcgtttggaggtagggaggttggggtagtttagggtttacgtcgtaggtacggtaacgtggggtacgaccgtaactaaagttacgtacggacgtaacgggtaggggtttacgggttccgggggacgtaggggtacctaggtaccgtagggttaaccggggacccggggtaacctaccgggtaccgaaccgtccccggaacctaacgtaaaccgttaaccgaggtaacgggtaacctaccggaaccgttacggttactacggttaaacttacggtttaaccggaacccggtaaccggtacccggttaccgttacgtttaaacgttccgtaggtaccggaacgtaacggacgggtaaacggcgggtacgaaggtacggtacggtttcgtacgtttcggtcggtaccgcggtccttccccgaccggtag

SEQ ID NO: 286345 - DNA, 822 bp, Homo sapiens
  misc_feature: GYAE6OF01ATJW4.51.12.B01.1.454.CMB.1.raw
  modified_base (304)..(304): a, c, t, g, unknown or other
  misc_feature (304)..(304): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtgcagtcgtggggctggaggtgaagaacgccggggcctcgagtgaaggtcctcgtgacaacgtcctcgtcggctacctaccttcaggtcggacaacgtacgtccacgtggggtacnccggaccgacggcccccgtagggaaccgaagggtccttggacggtgggtacgtggggtacttgggtttaacgtcgtagggtaacggtaaccgttcggggtacggtaccccgtaagttaaaacgtttacggtcggaacccgtaacgggttaacggggttaacggggtttttacccggggggacggttaacgggggttctaacggttaccggtaacgggttaccgggggaacccgggggtacctacccgggttaccccgaacgttaccccgtaacccgtaaccgttaaaccgtttacggaaccgttacgggtaaaccgtaccgtaaccgtacgttacgtacgtaaccgttaacgtttacggaacccggtacgtacccgggttacccttacgttaacgttaccgtggtaccgggactaacggtaacgggaacggccggtacggacgttagggttacggttacccgttagtttacgggtacggttaccggaaccggttcccgttacccgccccggttaaggg

SEQ ID NO: 286346 - DNA, 600 bp, Homo sapiens
  misc_feature: GYAE6OF01DBKOA.51.12.B01.1.454.CMB.1.raw
  modified_base (292)..(292): a, c, t, g, unknown or other
  misc_feature (292)..(292): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (461)..(461): a, c, t, g, unknown or other
  misc_feature (461)..(461): n is a, c, g, or t
  modified_base (531)..(531): a, c, t, g, unknown or other
  misc_feature (531)..(531): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaaggaacggccccggggcctcgagtgaaggtctccgtgcaagacctctggctacaccttcaggtgcaaacacgtccagtgggtnccgccacggcccctggacgaagggcttgagtggagtgggattggttagtctagacgaacgttggtgaccgtanaaagtttngcagaggtaggttcggggctaggtctagtcgagtcgggaccgggacaccgtcatcccgactacaacgtcagtacgactcgactagtcncgtactattacgacgacgaccggtcctacttagttactgtacgacgtacgaaggtacggaccggcggaanacgggttacggtcccgttacgttacggttacggtttaccggaaggttcccctccccgtccccgtaaggg

SEQ ID NO: 286347 - DNA, 813 bp, Homo sapiens
  misc_feature: GYAE6OF01C38UL.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcgttggtggcagcagccacaagacgcccactcccgaggtgcaggtggtgcgagtcgtggggctaggaggtagaaacggacggcccgggactcgaggtcgtaacggtcctccgtgacgaacgtaccttcgtacggacctaaccgtccgttacgacggtacggaaccaaccgtaaccgtaccgtaggttcgggtacgacccggaccggaccgggtacccccgtagggaaaccgaggggtccgttaaggacggtagggaggttagggttaacgttgggtttacgtcgtaggacggttacgtgggtcgaaccgtaagtaaagtttgacggactaagggtacgggttacgggttcgggacgtacgggtactaagttcgaacgggtccgggaacccgggtactaccggtacctacgtccgaaaccgtaacgttaaacgttaccgtaacgggacgttaaccgacgtaaccgtacggttaacgcgttaaacttacgggttaaccggaaccgtaccggtacgggttacccttagtttaaccgttcggtaccggcgaaaccggtacgacgggtacgggaccggtaaaccgggtggtacgggtttaaacggtttccggtaaccggtttcgggtaccgggttaaccgtcccgtccccgttaaccccccggacgtttaaacggg

SEQ ID NO: 286348 - DNA, 794 bp, Homo sapiens
  misc_feature: GYAE6OF01COCRD.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggaggatcctcttcttggtggcagcagccaacaagacgccccactcccaggtgcgagggtggtgcaggtcgtggggctggaggtgaagaacggcccgggcctcagtgaaggtcctcctgacaacgcctcgtcgactaccaccgttgaggtgacaaacgaccgtcctaggtgggtcgccgaccgacggccccgtaggaacgacgggtcttaggaaggtcgggtagtcgggtattgggttacgtcgtaggaacggtacgtgtccgacgaattaaacgtagtcgacgaacggtagggtacgggttcgggagtacggtactagtacgaggtccggggaaccgggactaacccggtcaacgtacccgaaccctaaacgtaaaccgttacgaacggtaaccggtaactacggtaaccgtacgttacgacgttaacgtttacgttaaccggtaaccgtaacccgggtaaccccggttaccgtttaaccgtttaaaccgttacgggttcggaaccgggaaacccgtaaacggggaacgggaaacccggggtccgggtaaacccggaacgggtaagggttttaaacggttcccgttacccggttttaagggtacccgggtttacgggaaccccgtttaccccggttcccccggttaccccgttaaacgggg

SEQ ID NO: 286349 - DNA, 848 bp, Homo sapiens
  misc_feature: GYAE6OF01EG7LM.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggactcctcttcttggtggcagcagccacaagacgcccactcccgaggtcgcgaggtggtgcaggtcgtggggctggaggtagaaggacggcccggggctcgaggtagacggtcctccgtgacacgtacctcgtacggtacctaacctaccgttagacggtcggaaccctaaaaccgtacccggtcccgtaacggttcggggccgcccgaaccccggacccgggtaccccccggtaggggaaacccggtaacgggggttccttaaggggtaagggtcgggtaagggttaggggttagttttaaggggttttaccgtcggtaaagggaacgttaaccggttgggtaacccgtaccgtaaaagttaaacgttgtaccgacggtaacgggtacggggttacgggtttaccgggacgtagggtaccagtaccggtaggaccgggtaacccggtacgacccgtcgtaacgtccccgaacctaaaccgttaacgtaacgtaacggtaccggtaacctacggtaacccttacgttcgtaacgtacgttacggtaccggtaacccgtacggtacccggtaccgtttacgttacgttaccggtacggtagtaaccggaggttaaaccggaccgggtccgggaacggttacctagggtttccgtaccgtttacggtaccgggtttcggaacccggttcgtaccccttccccggttaaccgtacggg

SEQ ID NO: 286350 - DNA, 702 bp, Homo sapiens
  misc_feature: GYAE6OF01B9JUM.51.12.B01.1.454.CMB.1.raw
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctggaggtgaagacgcccgggctcagtgagtctcctgcagcctntggctacaccttnagtggacaacaaccgtccacgtgggtcgccgccgacggcccctggacaagggctggagtgggatggggattgggtttagtcgtaggacgtaacgttgggtcgacccgactaaaagttacgtggaccgaacggtaagggtacgggtttccgggggacgtacggggtccaacgttcgacggtacgggaacccggggtaaccaccggtacctaccgtacccgaaccctaacgtaaaccgtttaaccgagttacgggaacctcggtaacccgaggttacctaggtaaccgtagtttacggaaccgaccggtacccgggtaccgttacgttaacgtttaccgtaggttaccgacggtaacgacgggaaacggccgggaccgggtaacgtagggtacggttaccgtacgtttacggttcgggttaccgacgggtccctcccgtccccgtagg

SEQ ID NO: 286351 - DNA, 600 bp, Homo sapiens
  misc_feature: GYAE6OF01ASF40.51.12.B01.1.454.CMB.1.raw
  modified_base (376)..(376): a, c, t, g, unknown or other
  misc_feature (376)..(376): n is a, c, g, or t
tcagcgatcgtatacacgaccggtgctcgatttagtagtgtagattccgcgggggagcatcacccagcaaccacatctgtcctctagagaacccccctgagagcccccgctcctcaccatggactggacctggagatcctcttcttggtggcagcagccacaagagcccactcccaggtgcaggtggtgcagtcgtggggctgaggtgaagaacggcccggggcctcgagtgaggtctcctgcaagcctcgtggctaccaccttcagtggacaacgaccgtccacgtgggtcgccgccacggcccccgtggacaagggcttggagtggagtgggagttggtttagtcgtaggagaacgtggtcgccgactaaattntgacacgaggtacggttcgggacgtagggtcagtacgacgtacgggacccgggactaccgtaccacgtcccgacctaaccgtaactacgagtacgaactcgaccgtagtcgtagacttacgttgaccgacgccggtcctactattacgtgtgcgagaggacgccggacgacgaggtcggttcgtacgtttacgtcggttcgacggtccctcccgtcccgtacgg

SEQ ID NO: 286352 - DNA, 895 bp, Homo sapiens
  misc_feature: GYAE6OF01DC32A.51.12.B01.1.454.CMB.1.raw
tcagcgatcgtatacacgaccggtgctcgatttagtagtgtagattccgcgggggtaggccaaactcaccccagcgaaccacactctgtcctctagacgaaccccctgacgagcccccgctcctcaccgagtggacttcggtacctgggaggactcctcttcgttggtaggcagccacgccacgaaggacgcccacgtcccgaggtgcgtaggtggtgctagtcgtggggactggaggtgaagacggcccggggctgagtgaagtcgtcgtcctgactaacgtaccttcgtaggtaccttacgaccgttcaggtacgacaacgaacgtccgacggtcggtcgccgaccgacggccctagggaacgtacgggtacgttggaggtagggagtagggtagttaggtttacgtacgttacggaacgtaggtacggttacgaccgtaacgttaaagttcgtaacggaccgtaacggtacggggttagggtttccggggacgtaacggtccgtaacgttacgtaacggtaccgggaccgggtaaaccgtacccgttaccgtaacccgtaccggaaccctaaaaccgttaacccgttaaccgtaaacggttaccggtaaacccggttaccgtaacccggtcggttaaccgggtaaccgttaacgttacccgttttacgggaaaccccggaaccgtttcccgggaacccgtttacgtttaacccgttccggttacggttacccggtccgttaaaaccccgggaaaggggaaaccgggtttacccgggaacccgggttaaacgttaacggggtttaccggttaaccccggttttacggttaaacccgggtttacgggtacccgggtaacgggttcccccggttaccccggttaaacccccgggg

SEQ ID NO: 286353 - DNA, 565 bp, Homo sapiens
  misc_feature: GYAE6OF01B1P55.51.12.B01.1.454.CMB.1.raw
  modified_base (286)..(286): a, c, t, g, unknown or other
  misc_feature (286)..(286): n is a, c, g, or t
  modified_base (350)..(350): a, c, t, g, unknown or other
  misc_feature (350)..(350): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcnccaggcccctggacaagggcttgagtggagtgggatggttagtcgtgagtaacgtggtgccganaaattatgcacgaggtaggtttcggggacgtagggtcatcgagtggaccgggacacgtcatcgccactaactacatgactgacctagtcagactgttcgacgacgacggtccgttacttattacgtgtacgacgtagacggtaacggcggccggagaggtacgggttcgtacgttacgttacgggttacggaggtccttccgtcccccgtaacgg

SEQ ID NO: 286354 - DNA, 773 bp, Homo sapiens
  misc_feature: GYAE6OF01E5V28.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcagggtggtgcagtcgtggggctggaggtgaagaacggcccggggcctcgaggtaggaacggtcctcctggaccaacggtacctcgtgggcctacaccttcaggtcggacaacaaccgtccacgtgggtcgccgaccgaccgggccccgtggaacgaaggggtcttaggaggtgggagtgggtattgggtttagtcgtaggtaagtaacggtgggtacgccggaactaaattagacgtacgacggtaacgggttaggtttccgggggacgttacggggtactaggttaccgtaaggttaccggggaacccggggtaccgtaaccggtacccgaacgttacccgaacccgtaacgtaaaccttaaccgtacgtaaggtaaccgtacgaacccgtagtaccgtaaggtactacgtttacggacccgaaccgtacccgggtacccgttacttaacgtttaccgtacggtcgaccggtaacgaaacgggaaccggtccggggtaccggtaacggtaacggggttcgggtttacccgtacgtttacccggttggggttaccggtacccgggtcccgttcccgtcccccggttaacggg

SEQ ID NO: 286355 - DNA, 749 bp, Homo sapiens
  misc_feature: GYAE6OF01DWCJ6.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagaacggcccggggcctcagtgaaggtcctccgtgacaagacctctggactaccaccttcagtcgacaacacgtccagtgggtgccgccgacggcccctaggacgagggtctggagtggagtgggattggtttagtctaggagtaacgtggtcgaccggtaataaattagtgacgtaacggtagggtacggtttcggggactagggtactagtcgtagtacgggtaacccgggaccgtaccggtaccaacgtacccgaaccctaaaccgtaaccgttaacgtacgtaacggtaaccgtacgaaccgtacggttacgtactaacgttatttaccggaaccggtacccgtaaccgggtccgttaaccgtttacgtttaaccgttggtaccggtaaccgtaaacggacgggtaaacgggcccgggtaaccggggtaacgacggggtttaaccgggttacccggttaccggttttaacccgggttcggggttaaccgggtacccgggttcccccgttcccccggtaaacccccggtaacgggg

SEQ ID NO: 286356 - DNA, 728 bp, Homo sapiens
  misc_feature: GYAE6OF01BD2JX.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcgttggtggcagcagccacaagacgcccactcccgaggtgcgaggtggtgctagtcgtggggctggaggtgaacgaacggcccggggcctcgaggtaggaaggttcctccgtgacctaacgacctcgtcggactactaccttacgaggtacggaccaaacgtaaccgtcctacggtgggtcgccgaccgacggtccccgtaggaacgtacgggtcttaggaggtaggagtgggtagttggtttagtcgtagtaacgtaacgttggtacgaccgtagtaaagttgtacgacgtaacgtagggtaggtttcgggacgtaggtaccgagtacgtagggttaccgggaaccgggtaacctacccggtactaacgtcccgaaccaacgttaacttaacgaggttacggaacctcgaccgtagtccgtagtacttagttaccgaacgtaccgtacgggttacgttaccgttaagttacgttgtaccggtacgtaacggaaagtaccgggacggacgggtaaccgaaggttacggtcgtttaaccgaccggtttacggtacccggaggtcccgttacccgtccccggtaacgg

SEQ ID NO: 286357 - DNA, 829 bp, Homo sapiens
  misc_feature: GYAE6OF01CCGS8.51.12.B01.1.454.CMB.1.raw
  modified_base (259)..(259): a, c, t, g, unknown or other
  misc_feature (259)..(259): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccaacaagacgcccacctcccaggtgcaggtggtgcagtcgtggggctgaggtgaagaaggcccgggcctcagtgaaggtctccgtgcaagcctgtgctacnccttcaggtcggacaacgtaaccgtccgtacgtcggtcgccgtaccgacggtccccgtagggaccgaacggggtccgttaggacggtgggtaacgtaggggtagtttagggttttaacggtcgtagggaaagtaaccggtacgggtacggtacccggtaaacttaaaacgttaacgtcggtaccgtaacggtaacggggtttacggggtttacccgggggtacggtaacggggttaccgtaacggttacgtaacgggttaaccggggaaccccggggaccgttaaccggtacccgtaacggtccccgaaccctaaaccgttaaaccgttaacgtaacgtacggtaaacccgttacgtaacccgtagtttccgtacgtaaacgtttcgttaacggaacccgaaccgtacccgggttaccttacgttaactttaacgtcggtaacggacccgtaaggtaaccggaacgggtccgggaaccggtaagtaacggttaccggggtttcctacgttttaccggggttgggttacccccggaaggttcccccttaaccccggtaccccgggttaacg

SEQ ID NO: 286358 - DNA, 742 bp, Homo sapiens
  misc_feature: GYAE6OF01AWF72.51.12.B01.1.454.CMB.1.raw
tcagcgatcgtatacacgaccggtgctcgatttagtagtgtagattccggcgggggagcatcacccagcaaccacatctgtcctctagagaacccctgagacgccccgctcctcaccatggactggacctggaggatcctcttcgttggtgcagcagccacaagacgcccactcccgaggtcgcagggtggtcgcaggtcgtggggctggaggtgaacggaacggcccggggcctcgaggtggaacggttcctccgtgaccgaacgtacccttcgtcggtaccttaaccgtaccctttacggaaggttccggaaccaaaaccgtaaccgttcccgaacggttcggggtcgccccggaccgaacccgggtcccccgtaggggaaccgtaaggggtcctttaggacgggttgggtaggttcggggtaagtttcgggtttaacgtcgtaacgggtaaggtaaccgttgggtacggaccgtaattaaaagttgtcgaacgtacggtaggggttacggttacggggacgtacgggtacacgtcgtaaggtaccgggaaccgggactaccgtacacgtcccgaacctaacgtaaccgtacgacgtacggaacgtcgaccgtgtcgtatacttagttacgaccgtacgtccggtacttacttacgtagacgtacgcgtaagacggacggacggacggataggttcgttcgtacgttacggtcggttacgacggtcctcccgtccggtag

SEQ ID NO: 286359 - DNA, 660 bp, Homo sapiens
  misc_feature: GYAE6OF01B0JDD.51.12.B01.1.454.CMB.1.raw
  modified_base (320)..(320): a, c, t, g, unknown or other
  misc_feature (320)..(320): n is a, c, g, or t
tcagcgatcgtatacacgaccggtgctcgatttagtagtgtagattccgcgggggagcatcacccagcaaccacatctgtcctctagacgaaccccctgagacgccccgctcctcaccagtggactggacctggaggatcctcttcgttggtggcagcacgccaacgaagacgccccactcccgaggtcgcgagggtggtcgcgaggtcgtggggctaggaggtgaacggacggcccggggcctagaggtacggaaggtcctcgtgacgaacgacctcgtacggctactccttcgaggtcgacaacaccgtccagtggcnccgcgacggcccgaggacgagggcttggagtggagtagggtagttggttagtcgtagagtacgttggacgacgaataagttcgacgcgtaaggagggttacgggttcgggacgtagggtacacggtacgacggtcggaaccggacgaccgtcgacgtccgaacaacctaaacgtacaggtacgacgtacgaccgtctacgacgacgtagttacgaacgccgtacggtccgtaacttacggtacgtacggacgaccgacgaaggtacggacgggacgtaacgtacgggttacggttcgttaccgttacggtcggacgtaacggtccctacccgtcgtacgg

SEQ ID NO: 286360 - DNA, 911 bp, Homo sapiens
  misc_feature: GYAE6OF01ARYHT.51.12.B01.1.454.CMB.1.raw
tcagcgatcgtatacacgaccggtgctcgatttagtagtgtagattccgcgggggagcatcacccagcaaccacatctgtcctctagacgaaccccctgagacgccccgctcctcaccatggactggacctggaggatcctcttcgttggtggcagcagccaacaagacgcccactccaggtgcaggtggtgcaggtcgtggggctggaggtgaaggaacggccccggggtcctcgaggtacggaacggttcctccgtagacaaacggtacccttcgtacgggccttaaccgacccgttttacgaacggttcggaaccaaaaccgtaaccggttacccgaacggttcgggggtcggacccggccccgaaccggggtccccccgttaggggaaccggaaacggggttccgtttaggggaacgggtttacggggaggttacgggggtaacgttttcggggtttttaacggtaccgttaggggaaccggttaaaccggttgggggttaccgaacccgggtaaacttaaaaacggtttacgtacggtaccggtaaacggtaacgggggtttaacgggttttacccggggggaggtaaccggggtttacaacggttccgtaacggggtacccggggtaaccccgggggtaaacctacccggggttacccaaacgggttaccccgaaccgtaaaccgttaaaccgttacgtaacgtaccgggtaaacctaccgaaacgtacggttactggtaacctttggtacgaacccggacggtaacccggttccttaacgttacgtagtccggtaacgtaccggtaagacgggtaccggggacggaacggtaacgtacgggttcggtttaccgttacgtttacgggttcgggttaccgacggtcccttcccgtacccggtaagg

SEQ ID NO: 286361 - DNA, 704 bp, Homo sapiens
  misc_feature: GYAE6OF01BC9BE.51.12.B01.1.454.CMB.1.raw
  modified_base (207)..(207): a, c, t, g, unknown or other
  misc_feature (207)..(207): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactcggaccgtggaggatcctcttcgttgggtggcagcagcccacaagagcccactcccaggtgcaggtgtgcagtctggggctgnggtgaagacggcccgggctcgagtgaacggtcctctagcaagacctcgtggacctactaccttgagtcggccaaccgaaccgttccaacgtgggtacgccgccacggtccccctgggaaccgtaagggtctaggacggttggaacgtgggtagttgggtttacgtcgtaagacggtaacgtggggtccgaccgtaagttaaacgttcgcggtaccgaacggtagggttacgggtttcggggacctaggggtccaagttcgtagtacgggaacccgggtctacccggtcacgtaccgacccctaacgtaaccgttacacgtaacggtaccgtacgaacgtgtacctacgaactttacggttacggaacgtaccgacccggtaccgtttacttacttaacgtcgaagtaccgtaacggacgagggtcccggaaggaccgtaacggtcggttacccgtcgttacggtcggttaccgccggttaccctcccgacccgtagg

SEQ ID NO: 286362 - DNA, 862 bp, Homo sapiens
  misc_feature: GYAE6OF01EMYQC.51.12.B01.1.454.CMB.1.raw
tcagcgatcgtatacacgaccggtgctcgattttagtagtgtagattccggcgggggagcgatcacccagcaaccacatctgtcctctacgacgaacccctggagagcccccgctcctcaccctagtggactcggaccgtggaggacttccgtcgttaccgttggtggccgaacgcacgcccaacgaaacgacgcccccaaccttccccgaggttggtccgaggttggtgccgagtcgtggggcgtggaggtaggaacgaacggcccggggtcctcgaggtccggaaacggtcccgtccgtgctaacggccctacgtcggaccttacctaccgttacgaggtacgaccaaaccgtaaccgtccaacggtagggtccgccggacccgtaccggccccgtagggaaccgaaggggtccttaggacggtacggacggtagggtacgttacgggttttaacgtaaccggtaggtaacggtaaccggttacgggtaccgtaacccgtaaacgttaaacgttacgtacggacccgtaaccggtagggttaaccgggtttaccggggaaccgtaccgggttacctaacgttaccgtacgggttaccggggaacccgggtacccgtaccggtacccgtaacggttacccggaacccgtaacggttaacgttaccggaacgttacgggaaccgtccgaacgtcgttacgtacgtaacgttacgttacgaccgtaccgaccggttacccgttacgttaacgttcgtacggtcgaccggtaacgtaccgggaacggccggaaccggtacggtacggtaccggttccgtaccgttaccggtccggtacggaccgtcccttacccgcccgtaggg

SEQ ID NO: 286363 - DNA, 280 bp, Homo sapiens
  misc_feature: GYAE6OF01ET4G4.51.12.B01.1.454.CMB.1.raw
  modified_base (240)..(240): a, c, t, g, unknown or other
  misc_feature (240)..(240): n is a, c, g, or t
  modified_base (276)..(280): a, c, t, g, unknown or other
  misc_feature (276)..(280): n is a, c, g, or t
tcagcgatcgtatacacgaccggtgctcgatttagtagtgtagattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcacgcccaaggcccaaccccactgtccactctcgtccccaccctctctcgtanccactcgtgacggcggtctggcaaggcgctaatagnnnnn

SEQ ID NO: 286364 - DNA, 558 bp, Homo sapiens
  misc_feature: GYAE6OF01E3AJC.51.12.B01.1.454.CMB.1.raw
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtcgcgccaggcccccgtggacaagggcttgaggtggagtgggatggtttagtctgagaactggtgccgtacaaatttatgcacgaggtaggtttcggggcgaggggtcagtcgagtcggacccggggacgacgtccgatccgaccacaactacatagaacgtgaccngtctnactattcgacgacgaccgtccgtacttattactgtgcgtacgagaggcggcggacaggtgttcgacgtttacgtcgggttacgaggccttcccgccccgtagg

SEQ ID NO: 286365 - DNA, 810 bp, Homo sapiens
  misc_feature: GYAE6OF01C8M5R.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggaggatcctcttcgttggtggcagcagccaacaagacgcccactcccgagggtgcgagggtggtgctaggtcgtggggctaggaggtgaaagacggcccggggctcgagtggacgtcctcgtgacgaacgacctcgtcggacctaacctaccgttacgtaggtacggaaccaaaccgtaaccgtcctacggtcgggtacgcccgtacccggaccggtacccccgtagggaaccgtaacggggtccgttagggaagggttggtacggtagggtaacgttttgggtttaacgccgttaagggaacggtacggttcgggtaccgtaacccgtaaattaaaacgttgacggtaaaccgtaacgggtacggggtttaccgggggtttacggggacgttaacggggttactaacggttacgtaaacgggttaccggggaaaccccggggaaccctaacccggttaccgaacccgtacccggaaccctaaacgttaaaccgttacggaacggttacgtaacccgtacgaacccgttacgttaccgtacgttacgttaacggtttaaccgaaccggtaccgtaccggtaccgttacttacgttcgagtacgacgaagacggacggccgtaacggatagggtacgttcgtcgtttacggtcggtacgaccgtccctccgccgtagg

SEQ ID NO: 286366 - DNA, 711 bp, Homo sapiens
  misc_feature: GYAE6OF01DIKPA.51.12.B01.1.454.CMB.1.raw
  modified_base (289)..(289): a, c, t, g, unknown or other
  misc_feature (289)..(289): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaagaacggcccggggcctcagtgaaggtctcctgacagacctgtggctacaccttcagtgacaacaacgtccacgtgggtnccgccacggccccgtaggacgaagggcttgagtggagtgggtattaggtttagtcgtaggagaacgtgggtcgaccgacgtaaaattgtagactaacggagggttacggggtttccgggggacgtacggggttactagttacgaggtaccgggaacccgggggacctaaccggtcctacgtcccggacctaaaccgtaaacttacgtacgttacgggtaaaccttcggaaccctacggttacgtacgtacgttaagtttaccggaccggaaccgtaccgggtaccgttacttacgttacgtggtacggaccgtaaagacgggaacgggaccgggtaaccggaaggtacgggtaacggtttccggttacgtttaacggttcgggtttaacgaccgggttccctccccggttacccggtaacgg

SEQ ID NO: 286367 - DNA, 818 bp, Homo sapiens
  misc_feature: GYAE6OF01BZPQT.51.12.B01.1.454.CMB.1.raw
tcagcgatcgtatacacgaccggtgctcgatttagtagtgtagattccgcgggggagcatcacccagcaaccacatctgtccctctagagaaccccctgagagcccccgctcctcaccatggactggacctggaggatcctcttcttggtggcagcagccacaagagcccactcccaggtgcagggtggtgcagtctggggctgaggtgaagagcccgggctcagtgaaggtctcctgcaagacctctggctacacctcagtcggcaacacgtccacgtgggtcgccgccgacggccccgtggaccgaaggggcttggagtggagtggggattgggttagtctaggacggtaacgtgggtcgtaccgacgtaaagttagtcggaccgaacggtaggggtacgggttttacgggggggaccttagggggtacctaacgttcgaacgggtttaccggggaaccccggggggtaaccctaaccccgggttaccccgtaacgttaccccggaaccctaacccttaaaacccgtttaaccgtaacggttaaccgggtaaacccgttaccgggaaccccgttacggttacccgtacggttaaccgttaacggttttaccggaacccgggttaacccggtaaccggggttaccccgttttaacgttaaccgttttacggttacggttaccggaaccggtaaccggaaacggggtaacgggtaccggggaccgggtaacgtacggggtacggtttcccggtaccgttttaaccgggtcggggttacccggtacggtccccgttccccggttacccccggtaacggg

SEQ ID NO: 286368 - DNA, 831 bp, Homo sapiens
  misc_feature: GYAE6OF01E1YRF.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccgaggtgcgaggtggtgcagtcgtggggctggaggtgaaggaacggcccggggcctcgaggtgaaggttcctccgtgacgaacgacctcgtggcctaccgacctttcgaggtcggacaaccaacgtccacgtggtcgccgccgacggccccgtagggaccaaggggtccttaggaggtcgggagtagggtagttcgggttttaagtcgttacggaaggtaaccggttgggttacggaccccgtaacgtaaaagtttacgtacgaccgtaaacgtaggggttaacgggttttaccgggggcgtaaacgggggtcaaggttacccgtacggtacggggtaaccccggggtaacccgtaaccgggtaccccgtaacgtccccggtaaacccgtaaccgttaaaaccttaccggtaacgttaacgggtaaacccgtaccggaacccgtacggttaccgtaacggtaaccgtacgttttacggaacccggtaccgtaacccgggtccgttaccttaacgttacgttacggtacgaccggtaaccggtaagggaacgggccgggtaccgggtaaccggaagggttaaccgggttaccggtaaccgtttaccggttacgggtttaaccggtacgggtccctttccccggacccccgttaacggg

SEQ ID NO: 286369 - DNA, 837 bp, Homo sapiens
  misc_feature: GYAE6OF01A5XHY.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagaacggcccgggctcagtgaaggtcctccgtgacaagtacctcgtggcctaactaccttcgaggtcggaccaacgaccgtccaacgtgggtcgccgacccgacggccccgtaggaacgtaagggtccttaggacggtgggaagttggggtacgtttgggttttaacgtcgttaggaacggtaaccgttggggtaaccggtacccggtaaacttaaaagtttcacggtaaccgtaacgggtaagggtttaccgggggtttaccgggggacgtaacggggttacctaacggttaccgtaacgggttaccggggaacccggggttaaccctacccgggttaccccgtaacgttaccccggaacccgtaaaccgttaaaccgtttaacgaacggttacgggtaaacctaccggtaaccgttaacgttcgttaacgtaacgttacgtttacggaaccggtaaccgacccgggttcctttaacgttaacgttacgttacggtacggaaccgtaaacggacgggaacgggtacccgggaaccggtaaggaacggggtttcggttacccgttaccggtttacgggtacgggttacccgtaccggttccccgttaaccccgtccccggttaagggg

SEQ ID NO: 286370 - DNA, 563 bp, Homo sapiens
  misc_feature: GYAE6OF01A5B9Z.51.12.B01.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (511)..(511): a, c, t, g, unknown or other
  misc_feature (511)..(511): n is a, c, g, or t
  modified_base (550)..(550): a, c, t, g, unknown or other
  misc_feature (550)..(550): n is a, c, g, or t
tcagcgatcgtatacacgaccggtgctcgatttagtagtgtagattctctgggctccaggtcagggacaacggtcacattggccatcagtggagtccaggcagaggacgaggctgactattatgtcaatcaacagacacctattggtacttagtcgtcttcggaactgccgaccaaggtcaccgtctgggtcagcccaaggcccaacccgngtgtccacgtctcgttccccgccttctctacggtancctactcgtggacggtccgggctggaccaaggccgactaagtaggctacnctgcncgtncgtgacncnctgactgntacgcagtcacgtnacgcgtanacacgtagcgactgacctatcgacgtcgtacntacggatcgtaccgtacgngtacgcgtacttcgacggtatcctgtacctggctaagcgcgtacncgtcagttgacctagcaccngtaacgtcgaacgctcaacggcctaacgttgaagtctccgagttaaccgnggttaccccaagtccggtagtacccttgggttaaacccncggttcgacgtcg

SEQ ID NO: 286371 - DNA, 666 bp, Homo sapiens
  misc_feature: GYAE6OF01CRZH8.51.12.B01.1.454.CMB.1.raw
  modified_base (361)..(361): a, c, t, g, unknown or other
  misc_feature (361)..(361): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagacggcccgggctcagtgaaggtctcctgaccaagacctcgtggcctaacgacctttcaggtcggaccaaacgtaaccgtccacgtgggtcgccgccgacggccccgtaggacgaacgggtcttggaggtggagtgggtattgggtttacgngttaggagtacgttggtcgaccgtaactaaagttcgagtacaacggtagggtacggtttcgggacgtagggtcagtcgagtcgggaccgggtacgaccgtccacgtaccgaccaactaactaacgagtacggtaactcgtacagtacgtacgtactacgtttacgacgtacgaccgtccgtacttacttacgtcgtacgaccggaacgtaacggacggtccggggacggaacggtaacggtacggttccgtacgtttaacggtcgggttaccggtacggtcccgttcccgtacccccggtaaggg

SEQ ID NO: 286372 - DNA, 825 bp, Homo sapiens
  misc_feature: GYAE6OF01DHHPG.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactcggacctggaggatccctctttcgttgggtggcagcagcccaacaagacgccccactcccgagggtcgcgagggtggtgcgagtcgtggggctggaggtaggaacggacggccccggggctcgaggtagacggtctccgtgacaacgtcctcgtcggtcctacctaccttcgacggtcggaccaaaccgtaaccgtccgtacggttcgggtcgcccggtacccgaccggtccccggtaggaaccggtaacggggtcgtttgggaggtggggtaagtcgggttaggtttacgggttttacgtcggtaggtaacggtaaccggttcgggtacggtaaccgtaaacgtttaaagtttacgcggtaacccggtaacgggtagggggtttacgggtttaccgggggacgttaacggggttacacgttacggcgggtacccgggaacccgggtacgacccgttaccgtactacccggaccctaacgttaccgtaacacggtcggtaaccgtacgtacctaggttcctaggtaccttaaggttacggaccgtacccggtacggttcccttaacgttacgttacggtcgacgtacggtaacgaacggtacgggacggacggtacggttaaacggtcgggttacccgttaggtttaccggttacgggttaccggtaccggttacccctacccggtacccggttacggg

SEQ ID NO: 286373 - DNA, 798 bp, Homo sapiens
  misc_feature: GYAE6OF01DJDGY.51.12.B01.1.454.CMB.1.raw
  modified_base (266)..(266): a, c, t, g, unknown or other
  misc_feature (266)..(266): n is a, c, g, or t
  modified_base (270)..(270): a, c, t, g, unknown or other
  misc_feature (270)..(270): n is a, c, g, or t
  modified_base (294)..(294): a, c, t, g, unknown or other
  misc_feature (294)..(294): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaaggaacgcccggggctcaggtgaacggtctccgtgacaagacctcgtggacctacncctnagtcgacaacaacgtcagtgggtnccgaccgtacggccccgtaggaacgtaaggggtcttaggacggtggacgtggggtattagggttatccgaggtaagtaacgtgggtacgacccggtattaaaaagttcgtagaccgtaacggtagggttaacgggtttccggggggaactacggggttaactaacgttaccggtaagggtaccgggtaaccccggggaccttaaccgggtccctaacgtacccggtaccctaaacgttaaactttaccggaagttacggtaaacctccggtaaccccaggttccgtaaggtaaccttacggttacggaaacccggtaccgtaacccggggttaccgttaaccgttaacgttaaccggttcggtaccgggtaaccgtaacggtaaggggacccggtacgggaaaccgggacgttaaacgggtaccgggttttccgaccggttttaaacggttccggggttaacccgtacgggtaccccctttcccgtaacccccgggttaaaggg

SEQ ID NO: 286374 - DNA, 689 bp, Homo sapiens
  misc_feature: GYAE6OF01AGHU7.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctgaggtgaagagcccggggctcagtgaaggtctcctgcaagcctctggctacaccttcagtcggacaacacgtccacgtgggtgccgccacggcccccgtgggaccgaaggggtccttaggaggttgggagttggggtagtttgggtttaagtcgtaggaacggtaaccggttggggttacggtaccggacttaaaagtttgtcgaccgtaacggtagggttacgggttttcgggggacgtaggggtctaacgtcgaacggttacgggaccgggtacgtaccgtccacgtcccgacctaactaaccttacgacgtacggaactcgacctacgtcgtagacttagtttacgaacgtaccgaccgggtaccgttacttacgttacgtgtacggtacgaacgaagggaacggccggggacggacgtagggtacggtttccgtaccgtttacggtcgggttacgacggttcccgtccccgtccccgtaacggg

SEQ ID NO: 286375 - DNA, 864 bp, Homo sapiens
  misc_feature: GYAE6OF01ADQ6X.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggagatcctcttctggtggcagcagccaacaagacgcccactcccgaggtgcgagggtggtgcgagtccgtggggctgaggtagaaggacggccccggggctacgaggtaggaacggtctccgtgaccgaacgtaccctcgtacggtcctaacctacccgtttcgaaggtcggaacccaaaaccggtaacccgtcccgaacgggtttgggggaccgaccccgacccggaaccccgggtccccccggttaaggggaaccccggtaaggggtccttttaaggggacgggttacgggacggttagggggttacgtttttacgggttacgtacgttaagggaacggttaaccggttcggggtaccgacccgtaaattaaagttcgcgtaaccgtaacgggtacgggtttaacggggggtttaccgggacggtaacggttccttacgaccggtaagggtacccgggtaacccggggaccttaaccgccgtacgtaccccgactaacgtaacccgttagtaacgtacgttaaccgacgtacccgtacgtacgtacgaaccgttacgttacgaacccggtaccgttaccggttacccttagttaccgttacgttccgaaggttcccgaaagtaccgggtaacggccgggtaacggtacggttaacggttccgggttacccttacgttttacgggtccgggtttaccgaccggtttcccccctacccggtccccgtaagggg

SEQ ID NO: 286376 - DNA, 890 bp, Homo sapiens
  misc_feature: GYAE6OF01D17U9.51.12.B01.1.454.CMB.1.raw
tcagcgatcgtatacacgaccggtgctcgatttagtagtgtagattccgcgggggagcatcacccagcaaccacatctgtcctctagacgaaccccctgagagcccccgctcctcaccatggactggacctggaggatccctctttcgttggtggcagcagccaacaagcgcccacctcccgaggtgcgaggtggtcgcaggtccgtggggctggaggtagaaaggacggcccggggcctagagtgaaggtcctcgtgacgaacgtcctcgtcgtcctacctccgttacgaggtacggaaccaaaccgtaaccgtccgaggttcgggccgcccggaccccgaccgggtacccccgtaggggaaaccggtaacgggttccgttagggacgggttagggtaggttacggggttagttttagggttttaacgtacggttaaggaacggttaacggttcggggtacccggtaacccgttaaagttaaaacgtttcgacggtaccgtaaacggggttacggggtttacggggtttccggggacgtaacggggttaccacgttacgggtacgggttaacccgggggaacccgggtacctaaccggtaccccgtaacggttacccccgaaaccgtaaaccgttaaccgttaaacggacggtaaaccgggttaaaccgtaccgtaaccgttacgtaccggtttaacgaaccgttttaggtaacccggaaccgtacccggtaccggttacgtttacttaacggttcgtcggtaaccgaacggtaacgaccgggacggtacccgggtcggtaactggggtttacccggttccttaaacgggtttccgggttccgggttaaccgggtacccttccccctttacccgggcccggttaaaggg

SEQ ID NO: 286377 - DNA, 671 bp, Homo sapiens
  misc_feature: GYAE6OF01C0BEV.51.12.B01.1.454.CMB.1.raw
  modified_base (381)..(381): a, c, t, g, unknown or other
  misc_feature (381)..(381): n is a, c, g, or t
  modified_base (513)..(513): a, c, t, g, unknown or other
  misc_feature (513)..(513): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtatggggctggaggtgaaggaacgcccggggcctcagtgaaggtctcctgcaagacctctggctactaccttcagtggacaacaacgtccagtgggtgccgcccgacggcccccgtaggacgaaggggtcttggaaggtggagtcggggattgggtttagtcgtggagaacgtggtgccgacgtaaattntgcgtacgagggtagtttcggggatacggggtcacgtcgagtacgggaacccggggtactaccggtccgtaagtcccgccgaactaaacttacagtacggtaaccgtacgaccgtaggttcctcgtaacctntttaacggaccgtaaccgtacggggtcccgttaacttaacgtttacgtcgtacggaccggtacgaaggtaacggtcgggacggacggtaggtacgggttacccggtacgttaccggttgggttaccggaccggtcctccccggttcccccgtaaaggg

SEQ ID NO: 286378 - DNA, 654 bp, Homo sapiens
  misc_feature: GYAE6OF01BRCNU.51.12.B01.1.454.CMB.1.raw
  modified_base (527)..(527): a, c, t, g, unknown or other
  misc_feature (527)..(527): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccaacaagacgcccactcccgaggtgcgaggtggtgcagtcgtggggctggaggtgaagacggcccggggcctcgagtgaggtcctccgtgacaagcctcgtggacctaccaccttcaggtcggaccaaacgaaccgtccacggtcgggtcgccggccgaccgggccccgtagggaaccgaaggggtcttaggagggtggaggtggggtagtttgggtttagtcgtaggaacggtaacgtcggggtcgaccgtaataaagttcgcgacgacggtaggggtacgggtttcggggacgtggtcagtcggaggtaccgggaccggtactaccgtcgacgtccgaacctaactaacgttacaggtacggtaacncgtactggtctagactagtcgacgtaccgcgtcttatacttcgagcgacgaacgacggacgggacggtcggaacgtgggtacggttccgtacgttacggtcggttacgacgtccctcccgccgtagg

SEQ ID NO: 286379 - DNA, 766 bp, Homo sapiens
  misc_feature: GYAE6OF01DQ9TP.51.12.B01.1.454.CMB.1.raw
  modified_base (193)..(193): a, c, t, g, unknown or other
  misc_feature (193)..(193): n is a, c, g, or t
  modified_base (472)..(472): a, c, t, g, unknown or other
  misc_feature (472)..(472): n is a, c, g, or t
tcagcgatcgtatacacgaccggtgctcgatttagtagtgtagattccgcgggggagcatcacccagcaaccacatctgtcctctagacgaacccctgagagccccgctcctcaccatggactggacctggaggatcctcttcgttggtggcagcagccaacaagacgcccactcccgaggtgcaggtgtgcnggtcgtggggctggaggtagaagacggcccgggcctcgagtgaggtcctccgtgacacgacctcgtcggtacctaaccgtaccttacgaggttacggacctaaacccgtaaccgttccgtaacggttcggggtaccgtccggaccccggaccgggttacccccggtaggtaaccggtaaacggggttccgtttaggaacgggttgggaacggttggggtaagttttggttaacgtcgtaagaaccgtaagtggggtaccgaccgtaacgtaaattacgnggtaaccgaacggttagggttaccgggtttccggggacgtacgggttactacgtaccggtagggtaccgggtaaccccgggacgttacccgtaccctacgtaccccgacgtaaccgtaaacgtttaccgaacggtaacgtaaccgtcgaaccgtacgttcgtagtaccttaggttaccgaacccgtacggtcccgtacgttacttacgttcgtgacgtacgaacgaggccggaggaccgtaggtacgtcggttactccgttggtacggtaccgcgtacccgtcccgcggtacgg

SEQ ID NO: 286380 - DNA, 867 bp, Homo sapiens
  misc_feature: GYAE6OF01ESPHJ.51.12.B01.1.454.CMB.1.raw
  modified_base (366)..(366): a, c, t, g, unknown or other
  misc_feature (366)..(366): n is a, c, g, or t
  modified_base (411)..(411): a, c, t, g, unknown or other
  misc_feature (411)..(411): n is a, c, g, or t
  modified_base (856)..(856): a, c, t, g, unknown or other
  misc_feature (856)..(856): n is a, c, g, or t
tcagcgatcgtatacacgaccggtgctcgatttagtagtgtagattccgcgggggagcatcacccagcaaccacatctgtcctctagacgaaccccctgagacgcccccgcttccacaccatcggactcggaccgtggaggtactccttctttcgttgggtggcacgcgacgtaccaacgaagtccgacccacgtcccgaggtcggcgtagggtggtacgcgtaggttcggtggggctaggtaggtacggaagaccgggtcccggactgtaggacgtacgtcctcgtacgacgacgtcctcgtaccgtaccttaccgtacgtgaacggttcgaacccgtaaacgtccgccgtacgggtacgggtcncccggtacccggtaccggccgtaaggaccgtagggtcttacgggnggtacggtaggtgggtatttcggttacgtagtaggtaacgtaccgggttggacccgaccgttaaagttaaccgtttagaccggtacggtaaaccggtcggggtttttacggaacccgggtggtaacggttcacggttaccggtaccgggttaaccggacccgggtaccgtaccgtacgtacccgtacccgtaaccgttaaacccgttacggtaaaccggtacggttaaccggtaaccggttaccgaaaccggttccggtaaccgtttaacgtaccggtttaacggtcccgtaaaccgggtcccgtaacgggttttaccgagttttaaccgacggtttacggaccggtgaacccggggtaaacgcggggttacccggacgtaacttacccggggttgttacccgttaacggttcggtaaccgggtctaccgggttcccgtaccccnggtttaccggg

SEQ ID NO: 286381 - DNA, 806 bp, Homo sapiens
  misc_feature: GYAE6OF01EMMJZ.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggaggatcctcttcttggtgcagcagccacaagacgcccacctcccaggtgcaggtggtgcaggtcgtggggctgaggtagaagaacggccccggggcctacgagtgaacggtctcctgacaagacctacgtggactacaccttacagtaggacaaccaccgtccacggtgggtcgccgaccgtacgggcccccgtgggaacgaacggggtccgttaggtaggtggtacggtagggtagttggtttaggtcgttaggtaagaacgtaggtcggaccgtaataaattagtcgtacgaacgtaggtacggtttacggggactacggggtctaacgtacgaacgggtacgggaacccgggaccctaaccggtaccgtaaccgtacccgaacccggtaaaccttaaacccggttaaactaacgggttacccggtaaaaccgtccgtaaacccgtacggttaccgttacggtaaccttaacgttttaaccggaacccggtaacccggtaacccggggtacccgtttaacccgttaacgtttaaccgtaggtacggtacccgtaaacggaacgggaacgggaccgggaccgggtaaccgtaagggttaccgtttacgtaaccggtttaccggttaaccgggtacggtaccggaccccgttaccccgtcccccgtaacggg

SEQ ID NO: 286382 - DNA, 571 bp, Homo sapiens
  misc_feature: GYAE6OF01DSN7Q.51.12.B01.1.454.CMB.1.raw
  modified_base (363)..(363): a, c, t, g, unknown or other
  misc_feature (363)..(363): n is a, c, g, or t
  modified_base (529)..(529): a, c, t, g, unknown or other
  misc_feature (529)..(529): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggacaacaacgtccagtgggtgcgccgaggcccctggaacagggcttgagtggatgggattggtttagtcgtagagaacgtggtcgaccgactaaattgngacaacgagggtagtttccggggcaggggtcagtcgagtcggacccggggacaccgtaccacgtacgaccaacgaacttacgagtaggaactgacctagtctagactagtttgaacgacgacggtccgtacttattacgtgtcgacgacaggacgcgggacgacgnggtacgtcgtcttacgtcggtcgaggtcctcccgtcccgagg

SEQ ID NO: 286383 - DNA, 609 bp, Homo sapiens
  misc_feature: GYAE6OF01EGWG4.51.12.B01.1.454.CMB.1.raw
  modified_base (394)..(394): a, c, t, g, unknown or other
  misc_feature (394)..(394): n is a, c, g, or t
  modified_base (444)..(444): a, c, t, g, unknown or other
  misc_feature (444)..(444): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaaggaacgcccggggacctcgaggtgaaggtctcctgacaagacctcgtggctacctaccttcaggtggacaaccaacgtccacgtgggtcgccgccgacggcccctagggacgaaggggtccttggaggtggagtgggtattgggtttagtcgtaggagtaacgtggtcgaccgactaaagttngacacggaggtcggtttcggggcgtagggtcatcgagtcggaccgggacncgtcagtccgacactaactacgagtacggactacgacctagtcctgtactagttacgaccgacgaccgggtcctacttattacgtgtcgacgacgaggacgcggacggacgaggtcggttacgtcgttacggttggttaccgaggtccctcccgtcccgtaacgg

SEQ ID NO: 286384 - DNA, 920 bp, Homo sapiens
  misc_feature: GYAE6OF01AM8XC.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggagatcctcttcttggtggcagcagccacaagagcccactcccaggtgcaggtggtgcagtctggggctgaggtgaagacgcccggggctcgagtgaacggtctccgtgacaacgacccgttctggtaccctaaccgtaccctttacgacggttaccgggacctaaaaccgtaaacccggttcccaaccggttcgggggtacggacccggtaccccgtaaccggggtcccccccgtaggggtaaacccgaaacgggggttcctttaggggaaccgggtaggtaacggtttgggggtaactttggggtttttaacggtccgttaagggaacggttaaacccgtttgggggtacccgtacccccggtaaattaaaaacgttacggtaccggtacccgttaaaggtaacgggggttacggttttaccggggggaacccgttagggggtacccagttaccggaacggttccgggggaacccgggtaacgtccccgggtaaccctaacggttcccgtaaccctaacggtaaaccctttacgaacgttaacgggtaacccgttacggaacccgtacgggtttaaccttacggaaaccgtttaacggtttaccgggaaacccgttacccgggaacccgggtttccccgggttaacttaaccgttacggtttacccgggtacggtacccgtaacggaaacgtaacggggtcccggtaccggtaacgtacgggttacgggtacccgttacttaacgggttacgggttacgaacggtcccttaccccggtcccggtaagg

SEQ ID NO: 286385 - DNA, 757 bp, Homo sapiens
  misc_feature: GYAE6OF01DZ1A4.51.12.B01.1.454.CMB.1.raw
  modified_base (239)..(239): a, c, t, g, unknown or other
  misc_feature (239)..(239): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggagggtagaagaaggcccggggcctcagtgaaggtcncctgcaagacctctggctacaccttcagtggacaacacgtccagtggtgcgccacggccccgtggacgaagggtctggaggtggagtgggacttggtttagtcgtagagtaacgtgggcgaccggtaataaagttagtcgaccgtaacggagggtacgggtttccgggggacgtaggggtaccagtacgtaaggtcgggaacccgggtaccaccggtaccgacgtacccgaccctaaactaaccgttaacgtaacgtacggtaacctcgtaaccgtacgttaccgtaacggtaacgttaacgtttaccggaaccgggtaacccgtaccccggggttacccgtttaaccgttaacgtttaccggttacggttacgggtaccgtaaaccggaaacgggaaacgggtcccggggaaaccggtacgggtaacgggttacgggttacccgttacccggtttaaccgggttcgggttaacccgggtaccggttaccccgttaccccggtacccccgtaacgggg

SEQ ID NO: 286386 - DNA, 775 bp, Homo sapiens
  misc_feature: GYAE6OF01AT29X.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaaggaacggcccgggggcctcgagtgaaggtctcctgcagacctctggctaccaccttcaggttggaccaaacctaacggttcccacgttggggtcgccgtccgacgggtccccccttggggaaccgtaacggggctttggaaggttgggagttgggggtattgggttttaggtcgtaggaacggtaacgttggggtcggaccggtactaaaagtttcggagaccgtaaccgtaggggttaacgggttttccggggggactagggggttaccacggttaccgaaggttacggggacccggggtaacgtacccggtacccgtacgttaccccgaccgtaaccgtaaaccgttaacctacggtaaccgggtaacctacggtaccgtaacggttacgtacgtaccttaaggttttaccgaacggtacccgaaccgggtccgttaccttattaccgtacgtacgacgacgtacggaacggtcgggaccggtacggtacggtacgggtttccgtaacgtttccggttacgggttaccggtacccggtaccgttcccgtcccccggtaaacgg

SEQ ID NO: 286387 - DNA, 842 bp, Homo sapiens
  misc_feature: GYAE6OF01BL1ZF.51.12.B01.1.454.CMB.1.raw
tcagcgatcgtatacacgaccggtgctcgatttagtagtgtagattccggcgggggagcatcacccagcaaccacatctgtcctctagagaaccccctgagacgcccccgctcctcaccatggactggacctggaggactcctcttcgttggtggcagcaggccacgaagacgcccactcccgaggtgcgaggtggtgcagtcgtgggctgaggtagaagacggcccgggctacgaggtcgaaggtcctccgtagaccgaacgtccgtcgtacggtaccttaacctaccgttacgacggttcggaaccgtaaaccgtaaccggtccgtaacgggttgggtaccgacccgtacccggaccgggtacccccgtagggtaccgtaacgggtccgttaggaggttacggtaaggtcgggtagtttcgggtttagtcgtaaggtacgaacggttcgggtaacgacccgtaagttaaacgtcgtacgaccgtaacggtacgggtcggggtttaccgggacgttaaggtccgtaagtaccggtaacggggtccggggtaacccggggtactaacccggttcgaaccgttaccccgaaacccgtaacgttaaaaccgttcggtaacgttaaacccgggaaccgtaccgggtaaccttaccggttacgtacggttaaaccgttacgttaacccggaaccggttaaaccggtacccgggttaccttaacgttacggtaaccgtcgaacgaacggtacgaaacgggtacgggtaccggcttaacgggtaggttaccgggttccgtaacggtttacggtcgtaacggtccgtccgtacccgtaccggttaacgg

SEQ ID NO: 286388 - DNA, 728 bp, Homo sapiens
  misc_feature: GYAE6OF01AZDSE.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccgaggtcgcacgggttggtcgcagtcgtggggctggaggtgaagacgcccggggctcgagtcgaaggtctccgtgcgaagtacctcgtgggaccttaccaacctttcgacggttcggacaaaccgaaccggttccaaccgttggggtcgcccgtacccacgggccccccgttagggaaccaacggggtcttaggacggtgggaacgttggggagtttacgggttttagtaccggttaggtaacggtaaacgtttcggggtacgcccgggtaacttaaaacgttacgttcggaccgtaacggtaggtacgggttttaccggggcgtaggggttcaacttcgaagttcgggacccgggtaacgtaccgtccgtacgtacccggaacctaaccgtaaacctttacgagtacggtaactacgaccgtacgtcgtactacgtagttacgaaccgtacgaccgtaccgtattacgttacgtagtcgacgtacacggacggcggacgacgcggtcggtcgtacgttacgtcgggtaccgaggttccctccgtcccgtaacgg

SEQ ID NO: 286389 - DNA, 893 bp, Homo sapiens
  misc_feature: GYAE6OF01EWFHC.51.12.B01.1.454.CMB.1.raw
  modified_base (190)..(190): a, c, t, g, unknown or other
  misc_feature (190)..(190): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcgttggtggcagcagccacaagacgcccactcccgagtgcaggtggtncagtcgtggggctggaggtagaagaacggcccggggctcgagtagtaacggtcctccgtgacgaacgaccgtcgtcggtacctaccgaccttcgaggtacggaccaaaccgtaaccggtcccgtagtggggtcgcggtacccgacggtccccgtggaacggtaacgggtctggaggtcggaggtgggtagttagggttttacgacgtaggaacggtaacggtgggtaccgtaccggtataaacgtttcgtaggaccctaacgggtaagggttaccggggtttaccgggggacggttaacggggttactacggttaacgtaaccgggttaccgggggaacccggggtaacccgtaccgggttaacccgtaccggtaccccggtaacccgtaaacgttaaacccgtttaacggtaaccggtaaccgggttaacccgtaacggtaacccgttaacggttaccggtacggtaaaccgttagtttacccgggaaacccgggtacccgtacccgggttaacccgttacgtttaaccgttaccggttacgggtaacccggtaacgtaaccggtaaaccgggtaccgggtaccggggtaccgggtaaacggttacccgggttaacgggtttaccccgttacgggtttaaccggttacgggggttaccccgaaacgggttttcccccctaaccgggttcccccgttaacggg

SEQ ID NO: 286390 - DNA, 869 bp, Homo sapiens
  misc_feature: GYAE6OF01C9DVW.51.12.B01.1.454.CMB.1.raw
  modified_base (166)..(166): a, c, t, g, unknown or other
  misc_feature (166)..(166): n is a, c, g, or t
tcagcgatcgtatacacgaccggtgctcgatttagtagtgtagattccgcgggggagcatcacccagcaaccacatctgtcctctagacgaaccccctgagagcccccgctcctcacccatggactggacctggaggactcctcttcgttggtggcagcagcccanaagacgcccacctcccgaggtcgcgtaggtggtgacgtacggtcgtggggctggacggtagaaaggaccgggccccggggtacctcgaaggtggtaacggttcctcccgtgaccgtaacggtacccgttcgtcggtacctacctaccgttacgacggttcggacctaacgtaccgtcctacggtcgggtcgaccggtcccaccgggccccgtaggaaccggtacggggtcttacgggaggttacgggaggttcgggggtaattttcgggtttaacgtacggttacgggaccgggtaacccgggttcgacccggtaactaaagttacgtccgtaacgtacggtaacggggttacgggttttacggggaccggtagggtacctacgtccgtacggtaccggggtacccggggtactacccggtacctacggtacccggtaacccctaaccttaaaccggttacgaacgggttaccggaaccttccgggtaaaccctacggttaccgtaacccgtagtttaacggttaccggaacccgtacccgggttacccgggttccttaacgttcggttaacgtcggttaccggaacgttacggaacgggtacggtacgggaaccggtacgggtaaccgttggggttccccttacggttaaccggttcgggttaccgaccggtccctttacccccggacccgtagttacccgg

SEQ ID NO: 286391 - DNA, 669 bp, Homo sapiens
  misc_feature: GYAE6OF01ARCGZ.51.12.B01.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (293)..(293): a, c, t, g, unknown or other
  misc_feature (293)..(293): n is a, c, g, or t
  modified_base (354)..(354): a, c, t, g, unknown or other
  misc_feature (354)..(354): n is a, c, g, or t
  modified_base (421)..(421): a, c, t, g, unknown or other
  misc_feature (421)..(421): n is a, c, g, or t
tcagcgatcgtatacacgaccggtgctcgatttagtagtgtagattccgcggggggagcatcacccagcaaccacatctgtcctctagagaaccccctgagacgcccccgctcctcaccatggactggacctggaggatcctcttcttggtggcagcagccacaagacgcccactcccaggtgcaggtggtgcagtcgtgggctggaggtagaagacggcccgggctcgagtgaaggtctcgngacaagcctntggctacaccttagagtcgacaacgacgtccacgtgggcnccgccgacgggtccccgtaggaacgaagggtcttaggagtggagtgggtattgggtttacncgtaggacgtaacggttcgggacacccgaataaagttgtacgacgaagtagggttaggttacggggntaggtacagtcaacggtcggaccgggtacacggtccacgtccgaaccaacgtaacgttacagtacggtaactccgactagtacgacgtaactagttccgaaccggaccgtaccggttaccttacgtacttacggtagcggaacgtaacgaagggaacgggccgggaaacctaggtaaacgggtcggtttaccgtacggtttaaccggtcgggttacgtacccgccgtttacccccgcggtaaacgggg

SEQ ID NO: 286392 - DNA, 814 bp, Homo sapiens
  misc_feature: GYAE6OF01A87NC.51.12.B01.1.454.CMB.1.raw
  modified_base (742)..(742): a, c, t, g, unknown or other
  misc_feature (742)..(742): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccacctcccaggtgcaggtggtgcagtcgtggggctggaggtgaagaaggcccggggctcagtggaaggtcctccgtgacaacgacctctggctactacctgagtgacaaccaacgtccacgtggggacgccgaccccgacggcccccgtagggaccgaaggggtccgttggaggttggaaggtcggggtaagtttcgggttttacgtcgttagggaagtaacggttgggtacggtacccgtaactaaaagtttacgtacgacccgtaacggtaacggggttacggggttttaccggggggaccgtaaccggggttactaacggttaccgaaagggttaccggggaaccccggggggtaacccttaaccgggtaaccccgtaaccggttacccccggtaccctaaaccgtaaacccgttttaaccggaacgttaaccgggtaaaccgtaccggtaaaccccgtcggttaaccgtacgtaacttacggtttaacgaacccgtacggtacccggtcgttaacttacgttacgtcggtaccgacgaacgtaagggtacggaccgggtacggtaaccggnggttaccggttacgttaccggtttaaccggtcgggttacggtaccggtcccttcccggtaccccgtaacggg

SEQ ID NO: 286393 - DNA, 704 bp, Homo sapiens
  misc_feature: GYAE6OF01DWKJ8.51.12.B01.1.454.CMB.1.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (286)..(286): a, c, t, g, unknown or other
  misc_feature (286)..(286): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccgaggtgcgaggtggtgcagtcgtgggctggaggtgaagacggcccgggctcgagtgaaggtctcctgcaagacctcgngctacnccttnagtgacaacacgtcagtggcncgcgacggccctggacaggtctgagtggagtgggattggttagtcgtagaagtacgtggtacgacgtataaagttgcgacgagtaggtacggtttacggggagtagggtactagtacggtagtacgggacccgggtaaccgtacgtaccgtacgtaccgacccgtaaacgtaacccgtaagtaacgtaacggtaaccgttaccggtaaccgtacgttaccgtacggtaacttaacgttaccgaaccggtaccgtacccgggttaccgttaaccttaacgtttacggtacggttacggaacgacggtaacggaacgggaccgggacggtacggaacgggtttccggttacggttaaccgtttacgggttacgggttaccggtaacccggtcccgttaccccggtcccccgttaaagggg

SEQ ID NO: 286394 - DNA, 819 bp, Homo sapiens
  misc_feature: GYAE6OF01DNEAM.51.12.B01.1.454.CMB.1.raw
  modified_base (184)..(184): a, c, t, g, unknown or other
  misc_feature (184)..(184): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
tcagcgatcgtatacacgaccggtgctcgatttagtagtgtagattccgcgggggagcatcacccagcaaccacatctgtcctctagacgaacccctgagacgccccgctcctcaccatggactggacctggaggatcctcttcttggtggcagcagccacaagacgcccactcccaggtgcgnggtggtgcaggtcgtggggctggaggtgaaagacggcccggggctcgagtgaacggtctcctgacaagacctgtcggactacnccttcgngtcgacaacacgtccacgtggtcgccgccgacggccccgtaggaaccggtaagggtcttaggagggtagggtagttacggggtagtttagggttttagtacctagggaaacggtaacgttcggggtacgaccgtaagttaaaacttcgcggtaacaacggtaggggttacgggtttccggggacgttacggggtctaaacgttccggtaacggtaccggggtaacccgggtaaccgtaacccggttaccgtaaccggttacccggtaaccccttaaaccgttaaaccgttaacccgttaacgggttaaccggtaaaccgtacggtaacccgtaacgttacggttacgtaacgttacggtttaaccgaacggtaccggtaacccgggttcgttacgttacgttacgttacgtacggtaaccgtaacggacggaacgggccgggtaaccgggtaaagttaccgggttcgggtttacccgttacggtttaccgggtttcgggtaaccgggttaccggtccccggttcccggtacccccgttaacgggg

SEQ ID NO: 286395 - DNA, 812 bp, Homo sapiens
  misc_feature: GYAE6OF01ACEJR.51.12.B01.1.454.CMB.1.raw
  modified_base (196)..(196): a, c, t, g, unknown or other
  misc_feature (196)..(196): n is a, c, g, or t
  modified_base (238)..(238): a, c, t, g, unknown or other
  misc_feature (238)..(238): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttctggtgcagcagccacaagacgcccacctccaggtcgcaggtggtgcagtccgnggggactgacggtgaaggacggcccgggctcgagtgaggtcncctgacaaggtcctcgtacggctacgtaccttcgaggtcggacaaccgtaaccgtcctacgtgggtcgaccggtcccgacggtcccccgtaggtacgaacggtccgttaggaggttacgggtaacgtagggtagtttaaccgggtttagtccggtaagacggtaacggtccggggtacgtccccggaagtaaaagttcgtaacgccgtaagggtaacggttacggggttccggggactagggtacacgttaccgacgggttacgggaccgggtaaccttaaccggtccgtaaccgtaccgtaaccggtaaccgttaactaacccgggtagttaacggggaacctaaccggaacccgttggtaacccgtaagtccctaaaggtttcggaaaccgtacccggaaccgggttttccaccgttttaaagttccgttaacggcggtaaaccggtaacggaaccggaaggggtcccgaaaacccgggtttaggaacccggggtttgtaaccccggttttaccttacgggtacccggggttacgtacccggtcccctttacccccggcccggtttaaaggg

SEQ ID NO: 286396 - DNA, 660 bp, Homo sapiens
  misc_feature: GYAE6OF01DOYKJ.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccaacaagacgcccactcccgaggtgcgaggtggtgacgagtcgtggggctggaggtgaaggacggcccggggtctacgagtagaggtcctctgacaacgacctcgtcggcctactccttacgagtcgaacaactaccgtcacgtggtcgccgccgacggtcccgtaggacgaggtctagaggtggtagtgggtagttcggtttatcgtaggaacgtacgtgggccgacgtaacttaattacgcgaacgtacgggtagggtacgggtttcgggacgtaggtctacgcggtagacggtaccgggtacaccgtacgtacgtaccgtaaccaacttaacgtactacgtacgtaacgtacgacgtacgtctaacgtacgttacgttacggaacgtccgtaccggtcttacgttacgttacgtcgtagacgacgtaggacggtcggacgtacgtaggtacgttccgtacgttacggttcgggtaccgtacgcccgtccgtcccgtagg

SEQ ID NO: 286397 - DNA, 715 bp, Homo sapiens
  misc_feature: GYAE6OF01C71QO.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaagaacggccccggggctcgagtgaacggtctccgtgcaagacctcgtcggctaccaccttcaggtcggacaaccgaaccgtccacgtgggtcgccgcccgacgggcccccgtaggaaccgaacgggtccgttaggaggtcggtaggtgggtagtttgggtttagtcgtaggaagtacggtggtcgaccgtaacgtaaattgcgacgtacggagggttacgggttcggggacgtagggtacagtacgacggtaccggggaacccgggtaccaccggttaccacggtacccgaacctaaacttaaccttacgaacggttacggaactacggacctacgtctacgtaactttagttacgaccgaccggtaccggtccttaacgttacgttacgtgtacgaaccgtaacgacgggacggccgggaaccggaggttacgggtacggtttccggttacgtttaccgggttcgggttaccggtaccgttcccctcccgtccccggtaaacgg

SEQ ID NO: 286398 - DNA, 756 bp, Homo sapiens
  misc_feature: GYAE6OF01B3KV2.51.12.B01.1.454.CMB.1.raw
  modified_base (84)..(84): a, c, t, g, unknown or other
  misc_feature (84)..(84): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
tcagcgatcgtatacacgaccggtgctcgatttagtagtgtagattccgcgggggagcatcacccagcaaccacatctgtcctntacccccccgagaacccccctgagacgcccccgctccctcaccatggactggacctggaggatcctcttcgttggtggcagcacgccaacaagacgcccactcccgaggtgcgaggtggtgcagtcgtggggctggaggtagaagacggcccgggctcgagtgaacggtctcngcaagcctcgngcctactaccgttgagtcgacaacgactcacgtgggtcgccgccgacggccccgtaggacgaagggtctggaggtggagtgggtagttggtttagtcgtagagtacgtggtacgccgtaacttaaattacgcggacgaacggtagggttacgggtttacggggacgtagggttctaacgttacgtaacggtccgggaaccgggtaccgtaccgtaccgtaccgtacccgaaccctaaccgttaaacgttacgtagtaccggtaaacgtcgtaacccgtacgtacgttaacgtaccttaggtttaacccgaacggttacccggaacccgggttaccgtttacgtttaaccgtttaacggttcggtacggaaccgaacgggtacgggaccgggtaccgggaccggtaaggtaccgggttcgggttaccttacggtttacggttcccgggttacgggtaccgtccccgttcccccgtaccgggtaaccggg

SEQ ID NO: 286399 - DNA, 885 bp, Homo sapiens
  misc_feature: GYAE6OF01BX96C.51.12.B01.1.454.CMB.1.raw
tcagcgatcgtatacacgaccggtgctcgatttagtagtgtagattccgcgggggagcatcacccagcaaccacatctgtcctctagacgaaccccctgagacgccccgctcctcaccagtggactggacctgggaggacttccttctttcgttgggtcggcagccacgcccaacgaacggacgccctaaccgtcccgaagggttcgaccgtagggttggtcgtcgttcggttccggtaggggtcgttaggaaggggtacggaaacggtaacccgggccccgggggtacctacggtaggtacggtaacggttccctccgtagaccgaacgtcccgttacggtacggaccttaacctaccgtttacggaacggttaaccggaaccgtaaacccgtaaacccggttccgtaacgggttcgggtccggacccggtacccggaccggtacccccggtaggggaaccggtacgggttacgttagggaggtacgggtaggttacggggtacgttttacgggttcgtacgtaaggtaacgtacggttacggtcggaaccgtaacgtaaagttcgacgtacccggaaggttacgggttcgggtttaccgggacggtacgttacgacttacgggtaacggtaccgggtaccggaccggtaccgtaccgtaccgtacccgaaccgtaaccgtaacgttaacgacgttaacggtaaccgtaccgaacgttacggtacgtacgtacgttacgtaaccggtacgtaccgttccgtacttacgttacgtacgtcggtacgacgacggtacggacggtaccgtacgggtaccgtacgggttcgtacggttcgttaccgggtcgtaacggtcccgttacccgttaccgtaccccggtacgg

SEQ ID NO: 286400 - DNA, 830 bp, Homo sapiens
  misc_feature: GYAE6OF01EBGCY.51.12.B01.1.454.CMB.1.raw
tcagcgatcgtatacacgaccggtgctcgatttagtagtgtagattccgcgggggagcgatcacccagcaaccacatcctgtcctctagagaaacccccctgagagccccgctcctcaccatggactggacctggaggactcctcttcttggtggacagcagccacaagacgccccactcccaggtgctaggtggtgcgagtcgtggggctgaggtgaaggacgcccgggcctcgagtgaaggtctccgtagccaagacctcgtcggacctacctaaccttcgagtcggaccaaaccgaaccgtccacgttgggtacgccgccgaccggccccgtaggaccgaacgggtcgttggacggtgggagttagggtacgttgggtttacgtcggttaggaacggtacggtggtacggaccggtaacttaaaggttcgacggaccgtaacggtaacggggtttacgggtttccggggacgtaagggttcctaacgttacggaacggttaccggggaacccgggtaccgtaccggtacccgtaacgttaccccgtaacccgtaaaccttaaaccgtttaacgttaaccggttaacggtaaccgtaccggtaacccgttaacgttaacgtacggtaacgtttaacgtttaccggaacccggtaacccggtaccgggtttacccgttaacctttaacgggttaccgttacgggttaccggaaacgtaacggaaaccgggaacggtaccgggaacgggtaacgtacgggttaccgggttacccttacggtttacggttcgggttacccgtacggttcccctccccgttaccccgtacgg

SEQ ID NO: 286401 - DNA, 816 bp, Homo sapiens
  misc_feature: GYAE6OF01C5S2P.51.12.B01.1.454.CMB.1.raw
  modified_base (277)..(277): a, c, t, g, unknown or other
  misc_feature (277)..(277): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggactcctcttcgttggtggcagcagccacaagacgcccactcccgaggtgcgaggtggtgcagtcgtggggctggaggtgaaaggacggcccggggctcgaggtgaaggtcctctgacaacgcctcgtcggctacctaccttnaggtacgactaaacgaccgtccgagtgggcgcgccgaccggccccgtaggaaccgtaagggtccttagggaaggtcgggtaagtggggttaagtttacgggtttagtaccggtagggtaaaccggtaacggtttgggggaactacccggtaaagttaaaacgtttgaccggtactaacgggtaggggttacgggtttacgggacgtacggggtactaacgtacggtacggtacggggaacccggtactaaccgggtcacgttacccgaaccaacgttaaacgtagaacgtacggtaaccgtacgaaccgttacgttaccgtaggtaaccttaaggttaccggaacggtacccggttaacgggttacccgttatttaaaccggtttcgtacgggtaaccggtaaccgtaaggtaaccgggaacgggacccggggtaaaggtacccggtaaaggggtttcggtttaccccgttaacgggtttacggttcggggttaaacccggaccgggttcccttaaacccccgggtccggttaaacggg

SEQ ID NO: 286402 - DNA, 836 bp, Homo sapiens
  misc_feature: GYAE6OF01DJP7U.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggaggactcctcttcttggtggcagcagccacaagacgcccactcccgaggtgcgagggtggtgcagtcgtggggctggacggtgaaaggaacggccccgggggcctacgaagtggaacggttcctccgtgacctaagacccgttcgtcggcctaacctaccgtttaccgaggttcggaaccaaaccgtaaccggttcctaacggtggggtcgaccggccccgtacgggccccccgttaggaaccgaacggggttcttggtaaggtcggaggtgggtagtttgggtttaacgtcgtaacgggacgtacgtcggtcggacccgaacgttaaaagttgtccgacgtaaccgggtaaggttaccggggtttcggggacgtaggttaccagttacgaacggtccggggaacccgggtaccgtacccgtccgaacgtccccggtaacccaacggttaaaccttaccgtaacgtacgggtaaaccccttcgaaacccgtcggttcttaaccgtaacgttcgtttaacgaacccgtacccggtacccgggtaccgtttaacttacggtttccgttagggtcctaaaccggtacgtaaccggtaacgggcccgggtaacgggaaccgtacgggttaacgggtttaccctaccggttttaacgggttcccggggtttacggacccgtttcccgtccccccgtttcccggtaaacggg

SEQ ID NO: 286403 - DNA, 805 bp, Homo sapiens
  misc_feature: GYAE6OF01EZRT8.51.12.B01.1.454.CMB.1.raw
  modified_base (269)..(269): a, c, t, g, unknown or other
  misc_feature (269)..(269): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatccctcttcttgggtggcagcagccacaagacgcccactcccgaggtgcgggtggtgcagtcgtgggctggaggtgaagaacggccccggggcctcgagtgaacggtcctcctgcaagacctcgtggcctacnccttcagtcggacaaacctaccgtccacgtgggtcgccgcccgaccggccccgtagggaccgtaacggggtcctttggacggttgggtaggtggggtaagtttagggtttacgtcgtaggaacgtaacgtcggtacgaccgaccgtaaagttagtcgactacggtaacggggttacgggtttccgggggacggtacgggtaccagttacggtaacggtaccgggggtaacccggggtaacccgtacccggtaacccgtacggttaccccgaaacccctaaacctaaccgtttaacgaacgtacccgggtaacgtacccgtaacccgtaggttacctacggtaaccttaacgtttaccggaacccgtaaccgggacccggttacccgttaacgtttaacgtttaccggtaggttaccggacccggtaacgaacgggtaacgggcccgggtaaacggacggtaacgggtacgggttaccgtacggtttaacggttcgggttaccgacggtcccctcccggtaccccgtaggttaccgg

SEQ ID NO: 286404 - DNA, 587 bp, Homo sapiens
  misc_feature: GYAE6OF01A8CGV.51.12.B01.1.454.CMB.1.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaaggagcccggggctcagtgaaggtctcctgcaagacctntggctacaccttcagtggcaacaacgtccacgtggtcgcgccacggcccctggacaggctgngtgagtggntggtttagtcgtgagacgtggtcgccgactaaagttgtgacacgtaggtacggtttcggggctaggggtcagtcgagtcggaccgggtacacgtccagtccgacctacaacttacgagtacggtaacgtgacctagtctagtaactacgtttcgaccgtaccgaccggtccgttacttacttaccgtgtcgacgacgacggacggtcggcggtacgaggtcggttccgtacgtttacgtcgggttacgacggtcctcccgtccccgtagg

SEQ ID NO: 286405 - DNA, 786 bp, Homo sapiens
  misc_feature: GYAE6OF01BR6N9.51.12.B01.1.454.CMB.1.raw
  modified_base (213)..(213): a, c, t, g, unknown or other
  misc_feature (213)..(213): n is a, c, g, or t
  modified_base (558)..(558): a, c, t, g, unknown or other
  misc_feature (558)..(558): n is a, c, g, or t
tcagcgatcgtatacacgaccggtgctcgatttagtagtgtagattccgcgggggagcatcacccagcaaccacatctgtcctctagacgaaccccctgagacgccccgctcctcaccagtggactggacctggaggatccttcttcttgggtggcaggcacgccacaagacgcccaactcccgaggtcgcgacgggtggtgcgtagttcggnggggctggaggtaggaacggaaccgggcccccggggtacctacagggtcggaaggttccctccgtagaccgaacggtaccctcggtacggtaccttaacctacccttacgtacggtacggtaacctaaacctaaccggttccgaacggggtttcggggtccgaccccggtccggaaccccggggcccccgtaaggggaaccggtaacgggtccgttagggaggtagggtggttacgggtagttttcgggttttaggtccgttaggaacggtcggttcggtacggtacccgtaacgttaaagttcgacgtaacgacgggttaggtcggggttcgggactacgggtnacgtcgagtaccgggtacccggactccgaccgctcccggaacctaaccgtaatcgtaacgacggacttacgaccgttagtcgtacgaccttgtaccggacgaccgtacccgtacgttacttacttacggtcggtacaaggtacgaaggccgacgggtcgaacgggtcggttacgttacggttcgttaacgggtttcggaccggtactcccccggttccgcccggttag

SEQ ID NO: 286406 - DNA, 846 bp, Homo sapiens
  misc_feature: GYAE6OF01BWBQK.51.12.B01.1.454.CMB.1.raw
  modified_base (173)..(173): a, c, t, g, unknown or other
  misc_feature (173)..(173): n is a, c, g, or t
tcagcgatcgtatacacgaccggtgctcgatttagtagtgtagattccggcgggggagcatcacccagcaaccacatctgtcctctagacgaacccctgagacgcccccgctcctcaccagtcggacgtggacctggaggtactccttctttcgttggtggcagcagcccaanaacgaccgcccaccgtcccgagggtcgcggtagggtggtcgacgtacggtcggtcggggtagtagggtaagggtacggaaaacggaccggggccccgggttcctaaggtaggtacgggtaagtcccctcgacggacctaaccgtccgtccgtaccggtaacctaccgttacctacgggtacgtacggaaaccctaaccggtacccgtaccgtacgggtcgggttccgacccggtacccggaaccccggtccggaaggtacgggtacgggtcgtagggtacggtcggtaggtgggttacgttgggttagtccggtaaggtacgtcggtacggtcgtaacgtaaacgtagttacggcgtacggaacggttacggttacggggtacggacggttacggacttacgggtccgtacgggtaccgggacccgggttagtacccggtaccgtaccggtacccgaccgttaaactaaccggttacgttaacggtacggtaactacggaaccgtttacgtacgtaacgttacgtacgttaccggtaacggccgttaccggtttaccgtacgttacgtcgtacggtacgtaacgtaacggacgaccgggtacggtcggaggttacgggttcgtacgttaccggttacggtccggtacgtccgttcccgtcccgaaggtaccgg

SEQ ID NO: 286407 - DNA, 775 bp, Homo sapiens
  misc_feature: GYAE6OF01D0EYG.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccgaggtgcaggtggtgcagtcgtggggctggaggtgaagaacggccccggggctcgagtgaagtcctccgtgacaacgacctgtggacctacctaccttcgaggtcggaccaaaccgaacgtccacgtgggtcgccgcccgacggcccccgtaggaacgtaagggtcttggacggtggagttgggagtttggtttagcgtagagtacgtggtcgaccgtaataaacgttagcgacgtaaggtacggggttacgggtttccgggggacgtaggggtctaacgtaccgaggttaccggggaacccggggtacctaaccggtccgaacgttaccccggaaccctaaaccgttaaaccgttaacgtaacgtaacggtaacccgtacggtaacccgtacggttactacggtaacttacgtttaccggaaccggaacccgtacccgggtacccggttactttaacgttacccgtaggtaccgaccggtaacgacgggtaaccgggccgggaccgggtaacgtacgggttaaccgggttaccgtaccggtttaaccgggttcgggtaccggtaccggttccccgttacccgttcccccggtaaaggg

SEQ ID NO: 286408 - DNA, 848 bp, Homo sapiens
  misc_feature: GYAE6OF01E38JR.51.12.B01.1.454.CMB.1.raw
  modified_base (371)..(371): a, c, t, g, unknown or other
  misc_feature (371)..(371): n is a, c, g, or t
tcagcgatcgtatacacgaccggtgctcgatttagtagtgtagattccgcgggggagcatcacccagcaaccacatctgtcctctagacgaaccccctgagacgcccccgctccctcaccagtggactcggaccgtggaggtactccttcttcgttgggtggcagcacgcccaacaagacgccccacctcccgaggtgcgtagggtggtcgcgtaggtcggtcggggctagggagggtaggaacggaaccgggccccggggtactacgtaggtacggtacggtcctccgtacgaccgtaacgacctcgtacggtacctacctaccgttcgaggtacggaacctaaaccgaccgtccgacgggtcgggtccncccggccgaccggtccccggtaagggaaccgtacgggtcgttagggacggtagggtaggtcgggtttaggttaggtttacgacgtaaggaacggtacggttcggtacgtaaccgtaaattaacgttcggagtaaccggtaacgggttaggggttacggggttacgggacgtaggtacctaacggtacggacggggtaacccgggacccggtacgtaccggaccgtacgaccccgtaacctaacgttaaccgtagacggtaccgtaacaaccgtacgtaagtccgtagttaccttacgggttaccgaaccggtacccggtaccggtacctttacgttaccgttacggtcggtaaccgaaccggtaaggaacggaccggggtaaccgggtaccgtaagggttcggttaccggttccgggttacccgttacgggttaccgggttaccggacccgtttccccgtcccgtacgggttacggg

SEQ ID NO: 286409 - DNA, 763 bp, Homo sapiens
  misc_feature: GYAE6OF01B1CFI.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcacgccaacaagacgcccactcccgaaggtgcgaggtgtgctagtcgtggggctgaggtgaaggtacggcccggggtctacgaggtaggaacggtcctccgtgacaacgacctcgtcgactacctaccttgacggtcgaccaaacaccgtaccagttcggggtcgaccggcccgacggtcccccgtagggaaccgtaacgggtcgttacggaggttacggtaggttacgggtatttacggggttttaagtccgtagggacggttaaccgtggggtaccgtaacccgtaagttaaaacgttacgtcgaccgaacgggtaaggttcggggtttccggggaacgttcgggtataccggttacgacgggttaccgggacccggtaacgtaccggtacctacgttaccccgaacctaacgtaaaccgttcaacgtacggtaacttccgaaccgtacgttcgtagtaccgttagttaccggaaccgtcggtacccggttacgttacctaggttaccgtcgtacgacctaaggaggaaccgcgggacgtaagtcgggtacggttaccgttacgtttacgggtcggttcgaaccggtttcctaccccgtccggtaacg

SEQ ID NO: 286410 - DNA, 754 bp, Homo sapiens
  misc_feature: GYAE6OF01AGZAS.51.12.B01.1.454.CMB.1.raw
  modified_base (485)..(485): a, c, t, g, unknown or other
  misc_feature (485)..(485): n is a, c, g, or t
tcagcgatcgtatacacgaccggtgctcgatttagtagtgtagattccgcggggagcatcacccagcaaccacatctgtcctctagacgaacccctgacgagccccgctcctcaccatggactggccgtggaggactcctctttcgttggtgacgagcagccaacgaacgtaacgccctactcccgaaggtcgcgacgggtggtcgcgaggttcggtcggggctaggacggtgaacgacggcccgggacttcgagtaggaacgtctaccgtgacgaacgtcctagtcggacctaccaccttcgaggtacgaaccgtaacgtaaccgtccggtacgttcgggtcgcccgtaccgaccggaccccgttcggaaccgaggtccgttggacggttggacggtgggtactttggttagtcgtacgagtaacgttggacgcctaagtagttacgcacggtacgtaggttcggttaccgggagtacggtacngttaccggaggtacggtaccgggtaccggtaccgttacgaccgtcgtaacctaaccgtaaacgtacgtacgttacggaacgtaccgaccgtacgttacgtacgtaacgttacggttaccgtaacggaccgtacggttaccgttacgttacgttactacggtacgtaacggacggtaacggaacggccgggttacggacggttacggtaccggtttcggtaccctttacggggtactacgggtaccgtaccgtacccggtccgtaacggg

SEQ ID NO: 286411 - DNA, 777 bp, Homo sapiens
  misc_feature: GYAE6OF01EKJ4M.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcgttgggtggcagcagccaacaagacgcccactcccgaggtgcgagggtggtgcagtcgtggggctggaggtagaaggaacggcccgggggcctcgaggtgaacggtcctccgtgacaacgcctctggacctacaccttcaggtcggaccaacaccgtcacgtgggtcgccgccgacggccccgtaggaacgtaggggtcttaggaggtaggtacggtgggtagttgggtttagtcgtaaggaagtaacggtgggtacgaccgtaagtaaattacgcgacgtaacgggtagggtacggggtttacgggggactacggggttactaacggtcggtaacggtacggggaacccgggaccttaccggtaccgtacgtacccgacctaaaccgttaaccgttaacggtaacgtacgggaaaccgttacgaacccgttaggttaccgtaacggtacttaaccgtttacggaacccggtaacccggtaccggttacccgttaactttaaccggttacgtacggttacggaacggtaacggaacgtaacggggccgggtaaccggtaagtacgggttacggttaccgttcggttaacggttccggttaacggccggttccctaccccggtcccgtaacggg

SEQ ID NO: 286412 - DNA, 779 bp, Homo sapiens
  misc_feature: GYAE6OF01BW8NA.51.12.B01.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaacgccggggcctcgagtgaaggtctcngcaagacctcnggctacaccttnagtcggacaacgaacgtccactgggtcgccgccgacggccccgttaggacgtaacggggtctttggaggttacgggagttgggacgttgggtttaagtcgttaggagtaaacgttggggttacgccggtacgtaaaattacgtggaccgaacggtaagggtacggttttccgggggactaggggttactaacgttaccgaaggttcgggaacccgggggtaaccgtaccggtaccgtaacgttaccggaacccgtaacgtaaaccgtttaacaacggttaacggggttaaacctacggttaacccgtaaggttaccgtacggtaacccgtttaagtttaacccgtaacgggtaacccgtaccggggttaccccgttacgtttaactttacggttacggtacggtacggaccgtaaccgggaagggtccgggtaccggaaaccgaggggttacggttaccggtacggtttaacggttcgggttacggtacgggttacccttccccgtaccccggtaacgg

SEQ ID NO: 286413 - DNA, 833 bp, Homo sapiens
  misc_feature: GYAE6OF01DSQE9.51.12.B01.1.454.CMB.1.raw
  modified_base (173)..(173): a, c, t, g, unknown or other
  misc_feature (173)..(173): n is a, c, g, or t
  modified_base (660)..(660): a, c, t, g, unknown or other
  misc_feature (660)..(660): n is a, c, g, or t
tcagcgatcgtatacacgaccggtgctcgatttagtagtgtagattccggcgggggagcatcacccagcaaccacatctgtcctctagagaaacccctgagacgcccccgctcctcaccatggactggacctggaggatcctcttcgttggtggcagcacgccaacgaagacnccccactcccgaggtgccgtagggtggtcgacgtaggttcggtgggggtctagggagggtaggaaacgggaccgggccccgggggtacctacgagggtagaacggttcctccgtagaccgtaacggtcccttcgtacggtaccttaacctacccgtttcggaaggttaccggaaccaaaaccgtaccggtccctaacgggttcggggcctcccggaccgtaccgggtccccgtagggaaccggtacggggtcgttaggacggttagggtaaggtgggtagttttacgggtttagaccgtaggaacggtacggtcggtacgacccggtaatttaaagtgacggtaccgaacgggttaggggttcggggttacggggacgttacggtactacggtacggtacgggtacccgggaacccgggtactacccgggtactaccgaccgtaaaccctaacgtaacttaacgaggtacgtacctacgacttacgntaacgtacttcgttaacgaaccggtaccgtaccgttcttaacgttacttacggtcggacgaaccgtggaaacggtccggaccgggtaacggacggttaggttccgtttaccggtacgtttacggggttaccggtacggacccggtttcccctaccccgggtaacccgttcggg

SEQ ID NO: 286414 - DNA, 836 bp, Homo sapiens
  misc_feature: GYAE6OF01B8Y3T.51.12.B01.1.454.CMB.1.raw
  modified_base (289)..(289): a, c, t, g, unknown or other
  misc_feature (289)..(289): n is a, c, g, or t
tcagcgatcgtatacacgaccggtgctcgatttagtagtgtagattccggcgggggagcatcacccagcaaccacatctgtccctctagacgaaccccctgagacgccccgctcctcaccatggactcggaccgtggaggtactcctctttcgttgggtggcaggcacgccaacgaacgacgaccccacctcccgagggttgcgtagggttcgggtcgcgtgttcggtcggggtcgtggtaggagaacggacggcccggggtacctgagtggtaacggttcctccgtanacgaacgccgttcgtacgccgtaccttacccgttacgacggttacggaacctaaaccggtaccggtaccgtacggttggggccgccggaccccggtaccggtccccgggtaacggaacgggtaacgggtcttagggacggttacgggtgggtacgggtagttttacgggtttacgacgtaacgggaaggttaacggtcgggttacgaccgtaaacttaagtacgtccggacaagggtacgggttagggggttccgggacggtacggttacacggttacggtacggacgggaccgggtacctccggtacgtccgtactaaccgtaacgtacgtaactacgtacggtaacgtacgtaccgtagttcgtaacgtatttacggtaccgaaccgtaccgttccgggactttacgttacgttaacggtgaccggttacgaacggtacgggaccggtagggtaccggtaagttacggggtcgttacccgggttaaggttaccgggtcgggttaccccggtaagtcccccggttacccgtacccgggttaacggg

SEQ ID NO: 286415 - DNA, 918 bp, Homo sapiens
  misc_feature: GYAE6OF01D94YS.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccaggtgcagggtggtgcaggtctggggctgaggtgaagacgcccggggctcagtgaaggtcctcctgacaacgacctcgtggcctacaccttcaggtcgacaaacacgtccacgtgggtcgccgccgacggccccgtggacgaacgggtcgttggacggtggtaggtgggtagtttgggtttacgtcgtaggaacggtacggtacggggtacgaccggtaactaaaagtttctacggaccgtaaccgggtaaggggttacgggttttccggggggaccggttaagggggttccgtaacgggttaccgtaagggttacccggggaaccccgggggtaaccgtaaccccgggttaccgaaccgttaccccgggaaacccgttaaacccttaaaaccgtttaaccggtaaacgggtttaaccggggtaaaccgtaccggtaaaccccggttaacggtttacccggttaacggttaacccggtttaaacggttttacccgggaaaccccggtaacccgggtacccccggggtttaaccggttttaccgttttaaaccggtttaccggttacgggtacccggtaacgggtaaacccggaaagggttaaacccggggaccgggggtaacccgggtaaccggttaaccggggttacccggggtttaccggttaccgggtttaacccgggtttacggggtttacggtaaaccgggttcccccgttaccccggtacccccgttaaccggggg

SEQ ID NO: 286416 - DNA, 845 bp, Homo sapiens
  misc_feature: GYAE6OF01BVH6B.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggaggatcctcttcttggtggcagcagccaacaagacgccccactccccgaggtgcgagggtggtgcaggtcgtggggctggaggtgaagacggcccggggcctcgaggtgaacggtcctccgtgacaacgacctcgtacggaccttacctaccttcgtacggtcggaacctaaaccgtaacccgtccaacggttcggggtccgcccggtacccgaccgggcccccggtaggggaaccgtaacggggtcgttgggacggtgggaggttggggtagttttagggttacgttcgtaaggtaacggtacggttcgggtacgaccgtaaataaaacgtttcgcggtaaccggaacggtaggggttaccggggtttccggggaacggttacgggtactaacggttccgaacgggttacggggaaccccgggggtaccaacccgttaccgtaaccgtaccccggtaaccttaaacctaaaccgttaaccgtaacggttacggtaaacccgtccgtaaccgtaacgtttctaaggtaccgtttacgttacggaacccggtaaccgtacccggggtttacccttaacgtttaaccttcgtacgggacgtacccggaacggagggacccggaccgggtaccggagttaacgggttcgggttaccgtttaccggttaggttccgggttacggaccggttccccgtaccccgtcccggtaacgg

SEQ ID NO: 286417 - DNA, 833 bp, Homo sapiens
  misc_feature: GYAE6OF01DJ6Y1.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggaggactccttctttcttgggtggcagcacgacccaaacaacggacgccccaacctcccgaaggttcgacgagggttggtcgacgtaggttcgtggggcgtaggagggtaggaaacgacgggcccggggcctacgaggtaggtaacgttcctaccgagacgtaacggccctgttacggactaacctaccgttacgaggtacgaacaaacgtaaccgtccgtagtcgggtccgaccgaccgtaccggtacccgtagaacgtaagggtcttagtggtacggagttagggtagtttacggttagtacctaggaacgtaacgttggggtaaccacggtaaacttaaagttcacggtagaacggttaaggggttcggttacggggacaacgggttaccaagttaccggaaggtaccgggaacccgggaaccgtaccggtacgaacgttacccgaacctaaaccgttaaacgttaagaacgggtacgtaaaccggaccgtaaacgtcgttaacgtacgtacgttaacgttacggaaccgtaccggtacgggtacccttagttaaaccgttagtccggtacggaaacgtacgaaacggtaacgggacccggggaacaagggtaacggtttaccgggttccgttaaacggtttaccggttcgggtaacccggtaacggtccccgttaaaccccgtcccggttaaaggg

SEQ ID NO: 286418 - DNA, 744 bp, Homo sapiens
  misc_feature: GYAE6OF01C2JTC.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactggacctggagatctcttcgtggtgcagcagccacaacgacgccctactcccgaggtgcgtaggtggtgcctaggtcggtggggctaggaggagaacggaccgggcccggggtctgaggtagacggtcctccgtgacaacgaccttcggcgtacctaacctacccgttcgaggtacggaccaaccgtaccgttcgacggtggccgaccgccgaaccggcccgtagacggacggttctaggcgtaggagtagggtatttgggttatcgagtacggtattacggtcgaacctaagtaacttggacgtaacgtacgggtggttacgggttcccgggagttcggtactcgagtacgggacgtaccgggaactccggttacaccgaccgtaaccgaacttaagtaccgtaacgtacggacttaccgtaacgtcggttacctacgttacggtaacttaccgggacgaccccggttaaccggtcgtttaaacccgttgttaacggttcggaacggtaaccgaacggacggtaccggaccggggtacgtaaacggtccgggtttaaagtcccggttaaggttccgttacggggtacctacccggtcccgttacccgaacgttacggg

SEQ ID NO: 286419 - DNA, 798 bp, Homo sapiens
  misc_feature: GYAE6OF01CC162.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggagatcctcttcttggtggcagcagccacaagacgcccactcccaggtgcagggtggtgcagtcgtggggctggaggtagaagacggcccggggcctcgagtcggaaggttcctccgtgaccaacgaccctcgtcggaccttacctaccgttgacggtgaccaaaccgtaccgttaccacggttgggtcgccgacccgtaccggccccgtaggaaccgagggtcttagggagtgggacgtgggtatttgggtttacgtcgtagggagtaaccggttggacggaccgtaaattaaacgttgaccggtacgaacggtaggggttaccggggtttaccggggacgtacgggttacacgttaccgaacgggttacggggacccgggggaacctaccggtaccgacgttaccccggaaccctaaaccgttaacgttaaccgaaggttacggtaacccgtacggtaacccctaggtttacggtaaccgtaaccgtttagtttaacccggaaccgtaccggtacccgggtttccgttaactttaaccgttcggtacgtaccgaccggaacggtacgggaaccggtcgggaacccggtagttaacggggttcggttcccgttaggttccggttagggtaccccggtagtcccccgttccccgtaaccccgtaagg

SEQ ID NO: 286420 - DNA, 683 bp, Homo sapiens
  misc_feature: GYAE6OF01A278N.51.12.B01.1.454.CMB.1.raw
  modified_base (253)..(253): a, c, t, g, unknown or other
  misc_feature (253)..(253): n is a, c, g, or t
  modified_base (440)..(440): a, c, t, g, unknown or other
  misc_feature (440)..(440): n is a, c, g, or t
tcagcgatcgtatacacgaccggtgctcgatttagtagtgtagattccgcgggggagcatcacccagcaaccacatctgtcctctacgagaaccccctgagagccccgctcctcaccatcggactggacctggaaggactcctcttcttggtggcagcagccacaagagcccactcccgaggtcgcaggtcggtgcagtcgtgggctgacggtgaagacgcccgggctcgagtgacgtctcctgcagacctcnggctacaccttcgagtcgacaacgacgtccacgtggtgccgtaccaccggccccgtggaacctaggggtcttaggaggttcggagttcgggtagtttcgggttttagtaccgtagggaacgtaaccggttggtaccgtccgtaactaaaacgtttgacgacgtaacgacgggttggtttaccggggngtacgggtcacgtctaggtacggaccgggacctaccggtaccacgttaccgacctaactaacgttaacgacgtacggtaacgacgaccgtacgtctacggtactagttacggacgtaccgaccgggttaccttacttaacgttcgtacggtacgacgtacggaggtaccgcggtacggacctagggttccgttccgtacgtttaccggtacggtacccgtagtcccttccccgtaccggtacg

SEQ ID NO: 286421 - DNA, 658 bp, Homo sapiens
  misc_feature: GYAE6OF01EZ1H7.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactccccaggtgcaggtggtgcagtctggggctggaggtgaagaagcccggggctcaggtgaaggtcctcctgcaagacctctggcctacaccttcagtggacaacaacgtccacgtgggtcgcgccacggcccctggacagggtctgagtggatgggatggtttagtcgtagagaacgtggtcgaccgtactaaattactgacaacggaggtacgggtttcggggacgtaaggggtcacgttcgaagtacgggacccggggaccgtaccggtaccgacgtcccgaccctaacgtaacctttacaagtacggtaaccgtacgaaccgtacggttacgtacgacctaagtttccgaaccggaccgaccgggtaccgttacttagtttacgtcgttcgacggaacgtacggaacggcgggacgggaacgagggtacggttccgtacgttacggttcggttacggtacggccttacccgtcccccgtaacgg

SEQ ID NO: 286422 - DNA, 735 bp, Homo sapiens
  misc_feature: GYAE6OF01AQCQG.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctccctcaccatggacgtggacctggaggatccttcttcgttggtggcagcgacgccaacaagacgcccacctcccaggtgcgaggtggtgccagtcgtggggctggaggtagaaggacggcccggggtcctcgaggtacgaggtcctccgtgactaacgaccgtcgtcgaccttaccgtaccgttacgaggtacggaccaaacctaccggtacctaccggtgggtcgaccggccccgacccggtccccgtacgggaaccgtaacggggtcttaggtagggtagggtaaggtcggggttagtttagggtttacggtacgtaggtaacggtaacggtggtccgtaccgtaactaaagttggacgtacgaacggtaaggttcgggttcgggacggtaggtcgtactcgtacgtcgggtaacccggaccgtaccgtaccgtagtaccccgacctaaccgtaaccgttacgtaaggtacggtaacctaccggaccgtaacgttcgtacggtataccggtacgtacccgacggttaccgtaccggttacttaacggttcgtacgtacgacgtagacggtacgcggtcgacgaggtcgtacgtacgtagtcgtacgcgcctccgtccgtag

SEQ ID NO: 286423 - DNA, 821 bp, Homo sapiens
  misc_feature: GYAE6OF01DEY3S.51.12.B01.1.454.CMB.1.raw
  modified_base (161)..(161): a, c, t, g, unknown or other
  misc_feature (161)..(161): n is a, c, g, or t
  modified_base (247)..(247): a, c, t, g, unknown or other
  misc_feature (247)..(247): n is a, c, g, or t
  modified_base (305)..(305): a, c, t, g, unknown or other
  misc_feature (305)..(305): n is a, c, g, or t
tcagcgatcgtatacacgaccggtgctcgatttagtagtgtagattccgcgggggagcatcacccagcaaccacatctgtcctctagacgaacccctgagagccccgctcctcaccatggactggacctggaggatccttcttcttggtggcagcagccanaagacgcccactcccgaggtgcgagggtggtggctaggtcgtggggctggaggtgaaggacgcccggggcctcgagtgagtcctcngacgacgacctgtcgctacctccttgagtcgaccaactaaccgtcctaggtcgggtcnccgccgacggtccccgtaggaacgagggtctggacgtggtaggtgggtagtttggttagcgtagtagtacgtggtcgaccgtaataaagttgtcgaacgtaacggtagggtttacgggttcgggacgttacggtatcgttacggacggtacgggtaacccggtacgtaacccggtacctaccgtaacccggtaaccctaaccgtttaaaccgtacgtaacgggttacggtaacccgttaccggtaaaccgtttacggttaccgttaacgtaccgtttaacgtttaaccggaaccggttaaccccggtccgggtttaccgtttaacgttaaaccggttttccggttacgggttaccggaaaccggttaaaccggtaaacgggaccgggaacccggggtaccggtaacgggttacggggtttaaccggtttccccggttaaacggttttcccggggttaccggggttaaccgtaccccgggttttaacccctcccccggtttaccccggtaaacgggg

SEQ ID NO: 286424 - DNA, 525 bp, Homo sapiens
  misc_feature: GYAE6OF01AYEA1.51.12.B01.1.454.CMB.1.raw
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (433)..(433): a, c, t, g, unknown or other
  misc_feature (433)..(433): n is a, c, g, or t
  modified_base (484)..(484): a, c, t, g, unknown or other
  misc_feature (484)..(484): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactccccaggtgcaggtggtgcagtctggggctgaggtgaagaagcccggggctcagtgaaggtctcctgcaagacctctggctacaccttcagtggcaacaacgtccactgggtgcgccaggcccctggaccaagggcttgagtggatgggatggtttagctgagaactggtgccgcaaattatgcacaggagtttcggggcngggtcntcatcgaccgggacaccgtccgatcgaccacacttacatggaactgaccagtctnactatttgacacgaccggccgttctattactgtgcgtcagaagcggcgganaggcgttcgcttacgttcggttacgaggcgtctccccgacg

SEQ ID NO: 286425 - DNA, 833 bp, Homo sapiens
  misc_feature: GYAE6OF01AYNBD.51.12.B01.1.454.CMB.1.raw
  modified_base (193)..(193): a, c, t, g, unknown or other
  misc_feature (193)..(193): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcgttggtggcagcagccaacaagcgcccactcccaggtgcgaggtggtgcngtcgtggggctggaggtgaaggacggcccggggcctgagtgacggtctcctgacaagcctcgtggtcctaccaccttcaaggttcggaccaaacgtaaccgtccgacggttcgggtacgccgcccgtaaccgggtcccccgtagggaaccgtaacggggtccttaggacggttaggggacgtggggtaagtttcgggtttacgtcgtaggaacgtaacgtggggttaccgacccgtaagttaaaacgttacgtacgacggtaaccgtagggggtttcggggtttaccggggacgtaacggggttacctagttaaccgggaacggtttaccggggaacccggggtaccgttaaccccgggttacccgtaacggtaccccggtaacccttaaacccgtaaaccgttaccgtaacgggttaaccggtaaccgtacgtaaccctacggttacgtacggttaacgtttacgttacggaacccggttaacgacccgggtttacccttacggtttaacttaccggttacggacggacccggtaacgaaccgggaaccggtcgggtaccggacggtagggttcccggttacccgtcggtttaaacggtccggttacgacccggtttacccgtaccccgtccgtacggg

SEQ ID NO: 286426 - DNA, 675 bp, Homo sapiens
  misc_feature: GYAE6OF01BK711.51.12.B01.1.454.CMB.1.raw
  modified_base (248)..(248): a, c, t, g, unknown or other
  misc_feature (248)..(248): n is a, c, g, or t
  modified_base (259)..(259): a, c, t, g, unknown or other
  misc_feature (259)..(259): n is a, c, g, or t
  modified_base (557)..(557): a, c, t, g, unknown or other
  misc_feature (557)..(557): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccacctcccaggtgcgaggtggtgcagtcgtggggctggagggtgaaggaacggcccggggcctcgagtgaaggtcctccngacagcctcgngctacaccttcgagtgacaacaccgtccacgtgggcgcgccgacggcccctggaacgagggcttaggaggtggagtgggagtttgggttacgtcgtaggacgtaacggtggtacgccgtataaattgcgactagaggtgggttcgggagaggtactacgacgtaggtaccgggaaccgggacctaccggtactacgtaccgaccctaacgtaacgttaacgacgtaacggaaccgtacaaccgtagtactcgtactagttacgaaccgtaaccggccggtaccctaattacttaccgngtaccgacgtaacgtacgaacgggtaccggacgggtaactaggggttacgttacccggttaccggtttacggtaccgggttacggaccgttacccgtccccgttaccccggtaacggg

SEQ ID NO: 286427 - DNA, 668 bp, Homo sapiens
  misc_feature: GYAE6OF01B45WO.51.12.B01.1.454.CMB.1.raw
  modified_base (160)..(160): a, c, t, g, unknown or other
  misc_feature (160)..(160): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (641)..(641): a, c, t, g, unknown or other
  misc_feature (641)..(641): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccanaagagcccactcccaggtgcagggtggtgcgagtcgtggggctggaggtgaagaagcccggggctcagtgaggtcnccgtgcaagacctgnggctacaccttnagtgacaacacgtcagtgggtcncgccgcggccctggacgagggtctaggagttcggagtgggactttagggtttactacggtcgtaacgtaacggttgggttacgcccgtaataaagttgtgaccacggtagggtcgggtttacggggacgtagggtacagtcgtacgtacgggacccggggtaacgaccggtacaaccgtcccgaccgtaacctaaacgttaccgagtacggaaccgtcgaccgtacgtccgttagacgttacgttacggaaccgtacgaccggttccgtacttacttacgtgtacgcgaacgacggtaacggcgggccggtacgacggttacgggttaccgtaacgtttcggttagggttaccgnggttcccctccggtcccccggtaacgg

SEQ ID NO: 286428 - DNA, 683 bp, Homo sapiens
  misc_feature: GYAE6OF01C562H.51.12.B01.1.454.CMB.1.raw
  modified_base (410)..(410): a, c, t, g, unknown or other
  misc_feature (410)..(410): n is a, c, g, or t
tcagcgatcgtatacacgaccggtgctcgatttagtagtgtagattccgcgggggagcatcacccagcaaccacatctgtccctctagacgaaccccctgagagcccccgctcctcaccatggactggacctggaggatcctcttcttggtggcagcagccaacaagacgcccactcccgaggtgcgagggtggtgcaggtccgtggggctggaggtgaaggaacggtcccggggcctacgagtggaacggttctcctgacaacgcctcgtcgctaacctcttcgagtggaccaacaaccgtcacgtgggcgaccgccgaaccggtccccgtaggaacgtacgggtctggacggtgaggtgggtatttgggttacgtcgagaacgtacgttggtcgaccgtattaaagtncgacgaggtcggtacgggttcgggatacggtatagtacgaggtacggacccgggtactaccgacgtaaccgtccgaaccgtaacgtaaactacgtagtaccggtaaccgtacgtacgttacggtacgtacgaactttcgttaacgaaccgtaccgtaaccggttctacgtttatcgttcgtacgacgtaactacggacgtcggtacgaacgtacggttacgtccggttcgttacggttcggttaccgacggttccctcccggtaaccgtacgg

SEQ ID NO: 286429 - DNA, 846 bp, Homo sapiens
  misc_feature: GYAE6OF01BZ7SE.51.12.B01.1.454.CMB.1.raw
tcagcgatcgtatacacgaccggtgctcgatttagtagtgtagattccgcgggggagcatcacccagcaaccacatctgtcctctagacgaaccccctgagacgccccgctcctcaccatggactggacctggaggactccttcttcgttggtggcagcagccaacgaagacgcccactcccgaggtgcgtagggtggtgcaggttcgtggggctaggaggtagaaggaacggcccggggtcctacgaggttacgtaacggttcctaccgtacgacgaacgtacccgttcgtcggtaccttaaccgtaccgtttacgacggttacggaaccctaaaaccgtaaccggttccgtaacggtcggggtaccggcccggtaccccggacccgggtacccccggttagggtaacggttaacgggggtttcggtaaggggttagggtaaggtggggttaacggtttgggttttacgtcgtaggaacggttaacggtcgggtaccgtccgtaaacgttaaagtttcacggtaacgtaccgggtaaggggtttacgggttccggggaacgttacgggttctaacggtacggaacgggtccggggaacccgggtactaaccggtaccgtacgtacccgtaccctaaacgtaaccgttacgaacgtaacgtacgtacgtacgtacgttacgtacgtacttaacggtacgaacccgtacggtaccgtaccttacgttacttacgttggacgtacggaacgttaggaccggtcgggtaaccggaacggttagttacggttccgtacgtttaacggtccgggttaaccgcgttacccgtccgtacccggtgttaccggg

SEQ ID NO: 286430 - DNA, 821 bp, Homo sapiens
  misc_feature: GYAE6OF01EOADD.51.12.B01.1.454.CMB.1.raw
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagaaggcccggggctcgagtgaaggtcctcctgacaacgcctcgnggctacaccttnaggtgaccaacaaccgtccacgtcgggtcgccgaccgaccggtcccccgtagggaaccgtaacggggtcttagggacggtagggtacggttggggtaagtttcggggttttaacggtccgttaggaacggtaaccggttggggtaccggacccggtaacgtaaaagtttacgtcggacgaacggttaggggttacggggttttaccgggggaccgttaaggggtcctaaggttaccgaacgggttacggggaacccggggtaacctacccgggttacccgtaggtaccccgaaccctaaaccgtaaaccgtttaaaccgacgttaacgggtaaacctcggtaacccgtacgtttccgtaagtaaccgttagtttacggaaccggtacccggtaaccgggtcccgtttaactttacgttacgttcggttacggacgtaaaccgacggtaaaccgggccgggaaccggtagtaacgggttaccggttcccggttaccgtttacgggtacgggttacccggtaccgggttccccttccccggtaaccccggttacgg

SEQ ID NO: 286431 - DNA, 715 bp, Homo sapiens
  misc_feature: GYAE6OF01CCH65.51.12.B01.1.454.CMB.1.raw
  modified_base (246)..(246): a, c, t, g, unknown or other
  misc_feature (246)..(246): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttctggtggcagcagccacaagacgcccactcccaggtgcaggtggtgcagtctgggctgaggtgaagacgcccgggctcagtgaaggtctccgtgacaagacctntcggactaccgtacctttacgaggttcggaccaaacctaaccggtccacgttggggtcgcccggtaccgaacgggcccccgtagggaaccgaaacggggtccttaggaaggttaggaacggtggggtaattggggttttagtacgtaggtaacgtaacgtgggtccgaccggtaactaaagttacgtcgacgaaccggtaagggtacgggtttcggggacgtacggttccaagtcgagtacgggaccgggaacgaccgtacacgtacgaccgaactaaacttacacgtacggtaactaccgtaacgtacgtacgttacgtactacgtttacgaacgtaaccgtaccggtaccgtaacgtttacgttacgtgtaccggtacgtaaccgaaaggacggacgggaccggtaagacgggtacggttaccgttcgttacgttcggttaacggacgtccgtcccgtcccgtacgg

SEQ ID NO: 286432 - DNA, 849 bp, Homo sapiens
  misc_feature: GYAE6OF01AWJZ9.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcacccatggactggacctgggaggactccttcttcgttgggtggcagcagccaacgaagacgcccacctcccgaggtgcagggtggtgcagtcgtggggctggaggtagaaggacggcccggggcctcgaggtgaaggtcctccgtgaccgaacgtacccgtcgtacggtaccctaaccgtaccccgttacgacggttcgggaacccaaacccgtaaacccggttccctaaccggtgggggttaccggccccggacccgtaacccggggtccccccggttacggggaaacccggtaaacgggggttcttttacggggaaggttacggggtaggtttacggggtaagttttacgggttttaacggtccggttaggaacgggttaaccgtttggggtaccgtaccccgggtaaacttaaaagtttcgtaacggtaccggtaaacgggtacggggttacggggttttacgggggacccgttaaggggttcaagtaccggaacggtaccgggtaacccgggacctaccgtaccgtacgtacccggacctaaccgtaaacttaacgagtaacgtaacgtacgaacgtacggtacgtagaccgtttacgtacgaccggaacgtaccgtccgtacttagttactaggacgtacgtacaaggacgggtacggaccggtaggtacggtagggttccctacgtttcggtacggttacccgaggtcccccttacccgtcccgtaagg

SEQ ID NO: 286433 - DNA, 981 bp, Homo sapiens
  misc_feature: GYAE6OF01B06ON.51.12.B01.1.454.CMB.1.raw
tcagcgatcgtatacacgaccggtgctcgatttagtagtgtagattccgcgggggagcatcacccagcaaccacatctgtcctctagacgaaccccctgagacgcccccgctcctcaccatggactcggacctggaggactcctgttcttggtggacagcacgccaacgaacgacgacccacctacccgtaggtcgcggtagggttcggtacgcgtacggttccggtggggtacgttaggaaggggtagaaaccgggaacccgggccccgggggtaccctacggaggttacggaaccggttcctacccgttagaccgtaaaacgtccccgttacgtaccgggtaacctaacccgttaacccgttcggtaacggtaccgtaaccgtaaaccgtaaccccggtcctaacggggtcggggttaccgacccggaccccgtacccggggtaccccggtaagggaaaaccgggttaccggggtcggtttaacgggagggtttaagggtacggtttaacggggtacggttttaggggttttaccggtaaccgtaggtaaaccgggtttaacggtcggggttaccgaaaccccgggttaaaagtttaaaccggttagtacccgggaaacgttaaccgggtaacgggggttttaacccgggggttccgggtaaaccgggtaagggtttaccgtaccgtttacggaacggggtacccgggggtaacccgggttaacccgggtaccggtaccctaaccgggttaaccccgttaaccgaaaccgtttaaccggttaacgtaacggtaccgtaactaccggtaccgtacgtacgtacgtaacgtcgtacggaccgtaaccgtaccgtccgttaacgtacgttacgtacgtacggacgaacggaacggacgggtaccgtaacggtaagtacgggttacggttcgttaaccggtttcggtaccggtacgtaccgtccgtttacccgaacgttacgg

SEQ ID NO: 286434 - DNA, 933 bp, Homo sapiens
  misc_feature: GYAE6OF01C6UP3.51.12.B01.1.454.CMB.1.raw
  modified_base (212)..(212): a, c, t, g, unknown or other
  misc_feature (212)..(212): n is a, c, g, or t
  modified_base (334)..(334): a, c, t, g, unknown or other
  misc_feature (334)..(334): n is a, c, g, or t
  modified_base (368)..(368): a, c, t, g, unknown or other
  misc_feature (368)..(368): n is a, c, g, or t
tcagcgatcgtatacacgaccggtgctcgatttagtagtgtagattccgcgggggagcatcacccagcaaccacatctgtcctctagacgaaccccctgagacgcccccgctcctcaccatggactggaccgtggaggactccttcttcgttggtggcagcacgcccaacaagacgccctactcccgaggtcgcgaggtggtgcgagtcggnggggctggaggtagaacggacggcccggggctacgacgtaggacggtcctccgtagactaacgtcctcggtcggactaccgtaccttcgaggacgaccaaaccgtacgtccgtaggtcggcnccgaccgaccggtccgtaggactaggtcgtaggnggtaggacggtagtggtttacggttacgtacgtaggtaacggtacggtcggtaccggtaacctaaagtttaaacgtaggtaccgtacggtaaacggggtaacggggtttaccggggttaccggggaccggttaacggggtacctaaacggttacgggtaaccggggtcccggggaaacccgggtacctaaccgggttccccaacgttacccccggaaacgttaaaaccttaaaccggtacggtaaccgtaccgggttaaccgtaaaccgggtaccgtttaacggttacgttaacggtaaacgttttccgggtttaaacgggaacccccgaacccgggtttacccggtttcccgttttaaaaccgttaggttttaaccccggagggtaaccggaacccgttaaacgggaaacccggggtaacgggtccccgggggaaaccgttaaggggggttaaaccccgtttcccggggtttttacccggtaaccgttttaacgggggttaccggggtaaaccccggttaacccgggttccccctttaaacccccccgggtacggttaaagggg

SEQ ID NO: 286435 - DNA, 704 bp, Homo sapiens
  misc_feature: GYAE6OF01D5QV5.51.12.B01.1.454.CMB.1.raw
  modified_base (214)..(214): a, c, t, g, unknown or other
  misc_feature (214)..(214): n is a, c, g, or t
  modified_base (254)..(254): a, c, t, g, unknown or other
  misc_feature (254)..(254): n is a, c, g, or t
  modified_base (531)..(531): a, c, t, g, unknown or other
  misc_feature (531)..(531): n is a, c, g, or t
tcagcgatcgtatacacgaccggtgctcgattttagtagtgtagattccgcgggggagcatcacccagcaaccacatctgtcctctagagaaccccctgagacgccccgctcctcaccagtggactcggaccgtggaggtactccttctttcgttgggtcggcagcacgccaacgaagaccgaccccaccgtcccgaggtgccgtagggtggtncgagtcggtgggtctaggaggtagaaggaccggccggganagtcgagtaggacgtcctcgtgacgaacgtcctcgcgcctacctaccttcgagtcgaccaaacgtaccgtccgaggtcggacggccgaccggaccggtccccgtaggaacggtaacgggtcgttaggacgtggaggttggtacgtttggtttacgtcgtagtaacggtacgttcggtacggaccgtaaattaaagttcgtacgaacgtacggtagggttccgggttacgggactaggtcagtacgtaggtaccggaccggtacgtaccgacgtaccnccgaacctaacgttaacgttacgagtaacggtacctacgtaccgttgtaccgttagtacttacggttaccgaaccgtaccgggtaccgttacctatttacgacgtgtacgacgtacgaaggacggcggagacggtggtcgttcacgttgtcggtacgcgtcccgtccgtaccg

SEQ ID NO: 286436 - DNA, 753 bp, Homo sapiens
  misc_feature: GYAE6OF01EB67H.51.12.B01.1.454.CMB.1.raw
  modified_base (57)..(57): a, c, t, g, unknown or other
  misc_feature (57)..(57): n is a, c, g, or t
  modified_base (163)..(163): a, c, t, g, unknown or other
  misc_feature (163)..(163): n is a, c, g, or t
  modified_base (210)..(210): a, c, t, g, unknown or other
  misc_feature (210)..(210): n is a, c, g, or t
  modified_base (383)..(383): a, c, t, g, unknown or other
  misc_feature (383)..(383): n is a, c, g, or t
  modified_base (745)..(745): a, c, t, g, unknown or other
  misc_feature (745)..(745): n is a, c, g, or t
tcagcgatcgtatacacgaccggtgctcgatttagtagtgtagattccgcgggggancatcacccagcaaccacatctgtcctctagacgaaccccctgagacgcccccgtctcctcacctagtcggactggaccgtgggaggtacttccttcttcgttgggngacaggcacgaccaacgaaggccaccctacgtacccgagggtcgcgnggtgtgccgtaggtcgtgggctggagggtagaacgggacggcccgggctacgaggtagacggttctcgtagacgtaccgactcgtaggacctactaccgtagtacggtcgaccaacgtacctcgtacggtggtaccgcgtaccgaccgacccggacgacggacggtcgtacgnggtaggtacggtggttaggttaggttacgtacgtaggtaacggtacggtaggtccgaacgtaaacgttagtacggtacctaagggtaccgttaggggttacgggttagggtaccgtaggggttacctacggtacgtaccgggtaccgggtaccggacccgttaccggaccgttaccggtacgaccctaaacgttaccgtaagtaaccgtacggtaacctacggtaccgtagtaccgtagttaccgttaacgtcgaacccgttacggtccggtaacttcttaacgcgtacgtacgacggagtacggacggtacgggactagggacgttccggattacggttcgtcggttgaccctaccggtcncgttacgg

SEQ ID NO: 286437 - DNA, 900 bp, Homo sapiens
  misc_feature: GYAE6OF01CM1J2.51.12.B01.1.454.CMB.1.raw
  modified_base (58)..(58): a, c, t, g, unknown or other
  misc_feature (58)..(58): n is a, c, g, or t
  modified_base (180)..(180): a, c, t, g, unknown or other
  misc_feature (180)..(180): n is a, c, g, or t
  modified_base (202)..(202): a, c, t, g, unknown or other
  misc_feature (202)..(202): n is a, c, g, or t
  modified_base (563)..(563): a, c, t, g, unknown or other
  misc_feature (563)..(563): n is a, c, g, or t
tcagcgatcgtatacacgaccggtgctcgatttagtagtgtagattccggcgggggancatcacccagcaaccacatctgtcctctagacgaaccccctgagacgcccccgctccctcaccagtggacctggaccgtggaaggtactccttctttcgttgggtcggacagcagacccaanaacgacgcccactcccgaggtncgaggtggtcgcgacggtcgtacggggtctaggtacgggtaggaaaacggaccgggcccccgggggtacctaccggtaagggttaggtaaaccgggttcccttaccggtacgtaacgaaaccggtcccgttccggtcggtaacccttaacccgtaaccgtttaggaaccggttcggaaaaccctaaacccggtaaacccgtcccgtaagggttgggccgccccggaccccgtacccgggccccgttaaagggaacggtaacggggtcttagggaggggtacggaagggtttgggtaagtttcgggtttaacgcgttaaaggaacggttaacggtcgggtacaaccggtaaacttaaagttnaccggaacgtagggtacggggtttacgggtacccgggagtacggttacacgtcggtaaccggtcggggaaacccgggtacgtaacccgtacgtaccgtaaccccgtaaccgtaaactaaccgttacgaacggttaaccggtaacgttaaccgacccgttaacgttacgtacccgtaagtttaacggttacggaaccgtaccggtaaccgttccgttatttaccggtaacggttcgtaacgaccgtaaggagggaccgggtaccggagttaaccggtagggtttcccgtaacggtttccaggttcgtaacggtcctaacccgtcccgtaccgtaaggg

SEQ ID NO: 286438 - DNA, 871 bp, Homo sapiens
  misc_feature: GYAE6OF01DJZDZ.51.12.B01.1.454.CMB.1.raw
  modified_base (850)..(850): a, c, t, g, unknown or other
  misc_feature (850)..(850): n is a, c, g, or t
tcagcgatcgtatacacgaccggtgctcgatttagtagtgtagattccgcgggggagcatcacccagcaaccacatctgtcctctagacgaaccccctgagacgcccccgctcctcaccatggactggacctggaggatccttcttcttggtggcagcagccaacaagacgcccacctcccaggtgcgaggtggtgcgaggtcgtggggctggagggtggaaggaacggccccggggcctcaggtagaggttcctcctgacaagacctctggactacaccttcgaggtacggaccaaacgtaccgtaccgaacgtgggtcgacccggaccgacggtcccccgtagggaaccgaaggggtcttaggacggtggaaggttgggtaagtttgggtttaacgtcgtaagggtaacgtaacgtcggggtccgaccgtaaacgtaaaagtttagcggacctaaacgggttaaggggttaaccggggttttaccgggggaaccgttagggggttaaccgtaacgttaccgggaagggttaacccgggggaaaccccgggggttaacccgtaacccgggttaacccctaaccggtaaccccggtacccgaaaacccggttaaaaccgtttaaaccgaacggtttaaaccgggtaaacccgttaccggaaacccgttagtttaaccgtaccggttaattacggtttaaccgaccgttaaccggtacccgggtacgtttaccttaacggttaccgtcggttacggaacccgtaagaccgggtaaacgggaccggaaccggtaagtacggtacggttccgttaccggtttaccggttcgggtaaccgtaccgggttacccncccccggttacccgtaacggg

SEQ ID NO: 286439 - DNA, 1059 bp, Homo sapiens
  misc_feature: GYAE6OF01ER7GN.51.12.B01.1.454.CMB.1.raw
tcagcgatcgtatacacgaccggtgctcgatttagtagtgtagattccgcgggggagcatcacccagcaaccacatctgtcctctagacgaaccccctgacgagccccgctcctcaccatggactggacctggaggtactccgttcttcgttgggtgcagacgacaccaacgtaaggccgacccacctcccgaggtcgcgagggttcggtacgctacggtccgtgggggtctagggaggtaacggaacggaaccgggcccggggtctaggaggtacggtaacgttccgtcgtagacgtaacggtacccttcggtacggtacctaaccgtacccgttacggtaaggtaccgaacctaaacccgtaaccggtacccgtacggtcgggtaccgaccggtaccccggacccgggttaccccggaagggaaccggtaacgggtccggttacgggtacgggtcggggtaacggttacggggttacggtttacgggttttaacgttcggtaacgggtaacggttaaccggttacggggttaacggtacccggttaaacggttaaaagttccggttaaccgggtaccgtaacgggttaaccgggggttaacgggggttttacccggggacgtttaacgggggttacccttaacgggttaccgggtaaccgggttaccggggtacccgggttaaaccggtacccggttaccgtaacccggtaacccggttaacccgtaaaccggttaaacccgttaacggtaacggttaaaccggttaaccgaccgtttaacggccggtttaatacccgggttaactttacgggttaaccgtaacccggtaacccgggtacgtacccgtttaaacggttaccttaaccgggtacggttaacccgggacccggttaaacggtaaacccgggggtacggttacccggggtaacccgtaaccgggggttacggtaaccccgggttttacccgggttacccgggttttaaaccgggttccgggtttaacccggtaccggggtttaccccccgtttcccggtaaaccccgggttaaaccgggg

SEQ ID NO: 286440 - DNA, 774 bp, Homo sapiens
  misc_feature: GYAE6OF01C6BA9.51.12.B01.1.454.CMB.1.raw
tcagcgatcgtatacacgaccggtgctcgatttagtagtgtagattcggcggggggtgggtccagggaggcagaactctgggtgtctcaccagtggcctggactccctctacttcctccccctcctcacttctctgcacgtaggctcgtaggcggtcctcctatgagctgacacacgccctaccgttggtcgtcgaggtccgtaccccgagggaccacggcggaccgaggtactccacgttgccttcgtgggatagtcgaccgttagttaccgaaccccgaaacgtagttacgtcgttacgtttaacggttccggtaacgaacgccgaaacgggtaaccggggccccgggaaccggaccggtttcccggttaggttggtttcgggtagttacgttaagtaaaacgtaacgtaccgaggtacggacggtaccggtcctacggacggtacccttccggagacgtacgttacttccgtcgcggtccttaccgagggttacggacggtaccgtaagtctacggtagtcgacctagaccgtgggtacgcgtacggacggacgacgggacggtacgggaacgtaggtaccttagttaacgtttagtctaactaacgtaacactaacgacgtaaccttaggttacgttattacggtacgttacggttacgacgtccggtaacgtaaccgtaccggtaccgtaccggttcgaccgggtaccgaccggtacccctaacggccccaaccgtccgttacttccgtaccgttccccgttaccccgg

SEQ ID NO: 286441 - DNA, 1021 bp, Homo sapiens
  misc_feature: GYAE6OF01DQG5U.51.12.B01.1.454.CMB.1.raw
  modified_base (168)..(168): a, c, t, g, unknown or other
  misc_feature (168)..(168): n is a, c, g, or t
tcagcgatcgtatacacgaccggtgctcgatttagtagtgtagattccggcgggggagcatcacccagcaaccacatctgtcctctagagaacccctgagacgccccgctcctcaccatggactggacctggaggactcctcttcttggtggcagcagccacaagacncccactcccgaggtgcgtagggttggtcgcgtaggtcggtgggggctgggtaagggtaggaaacggaaccgggtccccgggggtaccttcgaagggttacggtaacgggttccttccgtacggaccgtaaacgtacccgttcgtacgggtacttaacccgttacccgtttacgtaacgggtaccgtaaccgtaaaacccggtaaacccgggttaccgtaaccgggtttcgggggtcggaccccggacccccgggtaaccgggtacccccccggggtttaaggggaaaaccggggttaacggggggttcccggtttaaggggtaacggggtttaggggttaaacgggtttgggggttaagggtttttacgggttttaacgggttccgtaaagggtaacgggtaacgttcggggtaccgtaccgtaacttaaaagtttccgaggaaccgtaacgggtacggggtttacggggttcggggaacgtacgggttactacggtaacgtacggtaccgggtaacccgggtacgtaaccgttacccgtacgtacccgtaaccgtaaccgttaaaacgttaccgtaagtaaccgggtaccttaaccgaaccgttacgtaccgttacgtaacgttacgttaaccggaacccgttaaccggtaccggtaccgtttacgttaaccgttttccgtacggtacggtaaccctaacgggtaaaccgggtacgggtaacccgggtacgggtaaaccgggttacgggtttaaaccggggtttacccggttaaccgttttaaccggggtttaccggggtttacccgggaaccccggtttacccggttacccccgtacccccgggttaaggg

SEQ ID NO: 286442 - DNA, 754 bp, Homo sapiens
  misc_feature: GYAE6OF01A1HU7.51.12.B01.1.454.CMB.1.raw
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (650)..(650): a, c, t, g, unknown or other
  misc_feature (650)..(650): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcgaggtggtgcagtcgtggggctggaggtgaaggacgcccggggctcgagtgaggtctcctgcaagacctgtggctacnccttnagtcggacaactaccgtccacgtgggtcgccgaccgtaccgggccccttgggaactaacgggtctttaggaggtggacgtggggtaatttgggtttaacgtcgtaggtaacggtaacgttcggggtcgaccgtaacgtaaatttagcgtaccacggtaaggttacggggtttccggggacgacggggttacacgttacgacgggttaccggggaaccgggtaccgtaccggttacctacgtcccggacctaaacgtaaaccgtttacgacgtacggtaaacctaccggtaaccgtacgttcccgtaagtacgtttactttaacggaaccccggtacggtacccggggttacccttaactttaacggtttaccggtgttaaaccgggngtaaccgtaacggggaacgccggggtaaccgaagggttacgggttacggttccggtttaccgttgggttccggttacggacggtcccctcccgttccgtacggg

SEQ ID NO: 286443 - DNA, 728 bp, Homo sapiens
  misc_feature: GYAE6OF01ASG32.51.12.B01.1.454.CMB.1.raw
  modified_base (215)..(215): a, c, t, g, unknown or other
  misc_feature (215)..(215): n is a, c, g, or t
  modified_base (278)..(278): a, c, t, g, unknown or other
  misc_feature (278)..(278): n is a, c, g, or t
  modified_base (592)..(592): a, c, t, g, unknown or other
  misc_feature (592)..(592): n is a, c, g, or t
  modified_base (600)..(600): a, c, t, g, unknown or other
  misc_feature (600)..(600): n is a, c, g, or t
  modified_base (641)..(641): a, c, t, g, unknown or other
  misc_feature (641)..(641): n is a, c, g, or t
tcagcgatcgtatacacgaccggtgctcgatttagtagtgtagattccgcgggggagcatcacccagcaaccacatctgtcctctagacgaaccccctgagacgccccgctcctcaccatggactcggctggaggacttcccgtcttccgttgggtcggacgacgcacgcccaacgaagacgccctaccgtcccgaggttagcgtaggtggtcgngtagtcggtggggactggaggtacgaacggacggccccgggtcgtacgagtggtacggttccncgtacgacaccgtcctcgtcgactacctaccgttcgacgcgtaaccaactaccgctagtcggtcgccgtccgacccgcccggtacggacgaacggtcgtaggcggtaggacggtaggttacgttaggtttaccgacggtaggtaaccgtcggtttacggaccgtaccgtaacgtaaagtcggtacgtccggtacggtaggtttaccgggtacgggtaacggtaccggtactaacggtccggtaacgggtaccggaccggtaccgaccggtcccgtaactaccccgactaacgtaaataccggacgtacgaccgntaccggtntaccgatagtacgtagccgtacgaccgttcgtattcgtacnggtacagacgtagaccggacgtggtaccggtagtacccggttgtcgtacggtacgttacgtacccggtacctcccgtaacgggtacg

SEQ ID NO: 286444 - DNA, 903 bp, Homo sapiens
  misc_feature: GYAE6OF01AYAG0.51.12.B01.1.454.CMB.1.raw
  modified_base (613)..(613): a, c, t, g, unknown or other
  misc_feature (613)..(613): n is a, c, g, or t
tcagcgatcgtatacacgaccggtgctcgatttagtagtgtagattccgcgggggagcatcacccagcaaccacatctgtcctctagacgaaccccctgagacgcccccgctcctcaccatggactggacctggaggactcccttcttcgtttgggtggcagccgacgacccaacaaacggacgccccacgtcccgaggtgcgtagggtggtgcgtagtcggtggggctaggtagggtaggaacggaccgggtccccggggtcctacgaggtacggtacggttcctaccgtcggacctaacgtacccgttcggtccggtacctaacccgttaccgttcggaacggtaccggtaaccaaaacccgtaaccggtcccgtaacggtcggggtccgccccggtacccggtaccccggtcccggtaacgggtaaccggaccggggtttcgttaggggtagggttacgggtacgggtttaggggttacgttttcgggtttaccggtacgttaacgggtaaccggtaacggttcggggtaccggtaaaccgtaacgttaaagtttcggaaccggtaaccgtagggtaacggggtttacggggtccgggacggttacggtntaacgtcggtaacgggtaccgggtaaccgggtaccgtaccgtaccgtacccgttaccgaaccgtaaccgttaacgtaccggtaacgtaccggtaacctaaccggtaccgtacgttacgtacgttacgttacgtaaccgtaccggtaccggtaccgtttacgtactttacgttacggtcgtacggaacgtacgggaacggaccgggtaacggaccggtaagttacgggtacggttcccggttacggttcggttacggtaccggttaccctcccgttaacccggcgttacgg

SEQ ID NO: 286445 - DNA, 852 bp, Homo sapiens
  misc_feature: GYAE6OF01EVS8Z.51.12.B01.1.454.CMB.1.raw
  modified_base (194)..(194): a, c, t, g, unknown or other
  misc_feature (194)..(194): n is a, c, g, or t
tcagcgatcgtatacacgaccggtgctcgatttagtagtgtagattccgcgggggagcatcacccagcaaccacatctgtcctctagagaaccccctgagacgccccgctcctcaccatggactggactggaggatcctcttcgttggtggcagcagccaacgaagacgcccactcccgaggtgcgaggtggtncaggtcgtggggctggaggtagaaggacggcccggggtcctcgaggtcggaacggttcctccgtagactaacgtccttcgtcggtacctaaccgtaccctttacgaggtcggaaccctaaaccgtaaccgttaccgtacggttcggggtccgcccggtacccggaccggggtcccccgtaaggggaaccggtaacggggttcgtttaggggtaacgggttagggtaagggttggggttaacgttttggggttttaacggtacgtaagggtaacggttaccggttgggtacccgtaaccgtaaacgttaaaagtttcggtaggaaccggtaacgggttaacgggggtttcggggtttaccggggaacggttacgggttactacgtaaccggtaacgggttaccggggaaccccgggtaccgtaccgtaccgtaaccgtacccgaaccgtaactaaccgttaacgaacggtacggaactcgaacctagtacgtacgtacttaacgttacggaacgtaccggtacgtccgttacttaacgttcgtacgtcgaaccggaagaacggtacggaccgggtacgtaaggtaggttaccggttcgtaccggtttaacgggtccgggttaaccggaccggttcccgttaaacccgtcccggtaacgg

SEQ ID NO: 286446 - DNA, 750 bp, Homo sapiens
  misc_feature: GYAE6OF01BWJX7.51.12.B01.1.454.CMB.1.raw
  modified_base (277)..(277): a, c, t, g, unknown or other
  misc_feature (277)..(277): n is a, c, g, or t
tcagcgatcgtatacacgaccggtgctcgatttagtagtgtagattccgcgggggagcatcacccagcaaccacatctgtcctctagacgaaccccctgacgagccccgctcctcaccagtggactggacctggacggatcctcttacgttggtggcagcagccacaagacgcccactcccaggtgcaggtggtgcagtccgtgggctgaggtagaagacggccgggcctacgagtagacgtctccgtgactaagcctgtcggtacctaccaccttnaggcgacaacctaaccgtccacgtgggtcgccgaccgacggtccccgtaggaaccgaacgggtccgttaggaaggttcgggagtaggggtaacgtttagggtttaacgttcgtagaacgtacgttgggtcgacccgataaagtacgtacgacgtacggtaggtgggtttacgggcgtagggttaccaggttccaaggtacgggaaccgggtaccgtaccggtacctaccgtacccgtaaccgtaacctaaaccgttaaccgacgttacggtaaccgtccgtaacgtacgtacgttacgaccgtttaacgttaccgaaccggtacccgtaccggtccgttaacgtttacgttacgttacgtacggacggtaacgtacggtaacggacccgggacggtacgacgggttcggtttaccggtacctttacgggttcggttacggtaccggtccccgtcccggtcccccggtaacggg

SEQ ID NO: 286447 - DNA, 700 bp, Homo sapiens
  misc_feature: GYAE6OF01AI38U.51.12.B01.1.454.CMB.1.raw
tcagcgatcgtatacacgaccggtgctcgatttagtagtgtagattccgcgggggagcatcacccagcaaccacatctgtcctctagacgaaccccctgagagcccccgctcctcaccatggactggacctggaggatcctcttcttggtggcagcagccacaagacgcccacctcccaggtgcaggtggtgctagtcgtgggctggaggagaaggacggcccggggcctgagtgacgtctcgtgcaacgacctctcggactaccaccgtgagtcgacaacgaccgtccacgtggtcgccgccgaccggccccgtaggaacgacgggtcttaggaggtggaggtggtaagttcggttatcgtagaacgtacggtggcgacgtactaaattcgcgacgaacggtaggttcgggtacgggagtacggctacgtagacggtaccgggaccgggactacgtacccgtacgacccgtaaccgaactaaacgttacgaacgttaacccgggtaacctaccggaacccgtaggttccaacgttaccttaggtaaccgaacccggttaccggaccgttaccgttacgtttaaacgtccggtacggaaccgtacggaagtaccggaacgggaccggtacggaacgttacggttacggtccttaacggttggtaccgggtaccgacggttcccctacggtccccgtaagg

SEQ ID NO: 286448 - DNA, 767 bp, Homo sapiens
  misc_feature: GYAE6OF01EQ4FI.51.12.B01.1.454.CMB.1.raw
  modified_base (697)..(697): a, c, t, g, unknown or other
  misc_feature (697)..(697): n is a, c, g, or t
  modified_base (704)..(704): a, c, t, g, unknown or other
  misc_feature (704)..(704): n is a, c, g, or t
  modified_base (721)..(721): a, c, t, g, unknown or other
  misc_feature (721)..(721): n is a, c, g, or t
  modified_base (729)..(729): a, c, t, g, unknown or other
  misc_feature (729)..(729): n is a, c, g, or t
  modified_base (757)..(757): a, c, t, g, unknown or other
  misc_feature (757)..(757): n is a, c, g, or t
tcagcgatcgtatacacgaccggtgctcgatttagtagtgtagattccgcgggggagcatcacccagcaaccacatctgtcctctagacgaaccccctgagagcccccgctcctcaccatggactcggacctggaggatccgttcttcgttgggtgcagcagaccaacgaacgacgccctaacctcccggaggtgccgtaagggtggttcgcgtacggttcggtggggtacgtgggtaagggttacgaaaacgggaaccggggccccgggggtaccttacgggtaggttaacgggtaacggttcccgttaccgtcggaactaaccgggtacccttcggtacgtacccgtaacctaccgttacggacggtacggaccttaaaccgaacgtccgtaagtggtccgccgtacgaccgtcccgtaggacgaggttcaggtaggtaggtacgtgggttaatttggtttaaccgagttacggaacggtcgttagggccgtaaccgtaagtaagtttaacgcgtaacgaacgggtacggttcgggttaacgggcgtaagtacgagttaccgagggtacccggtaacgggacctaccggtacctaccgtaacgaaccgtactaacgtaccgtaaggtaccgattacccggaagttcgttacgactacgttaagtccgaagaccgtcggttaccgtattctacggngtaccgngtaacgacgagcggtanaggtacgngtacttcggtacgtcggtacgccgttcncccgtgtacg

SEQ ID NO: 286449 - DNA, 806 bp, Homo sapiens
  misc_feature: GYAE6OF01CL3IS.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccaacaagagcccacctcccaggtgcgaggtggtgcgagtccgtggggctggagggtaggaaaggaacggccccgggggcctacgaggttggaacggttcctccgttggaccaaaggtaccctcgtcggtacctaccgtacccgttcgaggtcgggaaccaaaccgaaaccggttccgtacggtggggtcgccggcccgaccgggcccccgtagggaacgtaacgggtcgttggaggtggaggttgggtagtttgggtttagtcgtaggtagtaaccgttgggtacgaccgtaactaaagttacgtcgtaacgaacggtagggttacgggtttccgggggacggtacggggtactacggtacgaacgggtaccgggtaacccggggtaacccgtacccggtacccgtaaccggtacccgacccgtaaaccgtaaaccgttaaccgtaacggtacggtaaaccgtaccggtaacccgtacgttacgtacgtaacgtttacgtttaacggaaccggtaaccggtacccgggttaccgttacgttaccgttaacgtggtacggacgtaacgaggaacgggacggacggacgaggttacggtcggttacgttacggttacggttaccggacgtcccgtcccgtccccgtacgg

SEQ ID NO: 286450 - DNA, 768 bp, Homo sapiens
  misc_feature: GYAE6OF01AO7AK.51.12.B01.1.454.CMB.1.raw
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
tcagcgatcgtatacacgaccggtgctcgatttagtagtgtagattccgcgggggagcatcacccagcaaccacatctgtcctctagagaaccccctgagacgccccgctcctcaccatggactggacctggagatcctcttcgttggtggcagcagccaacaagacgccccactcccaggtcgcgagggtggtgctagtcgtggggctggaggtagaacgacggcccgggcctgagtgacgtctccgtgacaacgcctgcgtcctaacctaccgttcacggtcggaccaaccgtaccgtccacggtggtcnccggaccacggccccgtaggacgaggtctggagtggngtcgggtattgggtttacgtgtagaagtacgtggtaccgccgtaacttaaagttcgtacggaccgtaacggtaggggtttacgggtttacccggggacgtttaacgggtacctaacggtccggtaagggtcccgggaaccgggtacctacccggttaccgacgtaccccgtaaccgtaacgttaaaccgtacgtaacgtaacggtaaccgtacgtaacccgtagttacctagtaaccgtttagtaccggaaccggtaccgtccccgggttaaccttaccgttagttaaccgtcggtaaccggcgtaaaccggaacgggtacgggaccgggtacggtaaccgttacgggaccggttttccgttaaccggtttcggtacgggttacccggaacgtccccgtttccccgaccccggttaagg

SEQ ID NO: 286451 - DNA, 890 bp, Homo sapiens
  misc_feature: GYAE6OF01EBV4C.51.12.B01.1.454.CMB.1.raw
  modified_base (450)..(450): a, c, t, g, unknown or other
  misc_feature (450)..(450): n is a, c, g, or t
tcagcgatcgtatacacgaccggtgctcgatttagtagtgtagattccgcgggggagcatcacccagcaaccacatctgtcctctagacgaaccccctgagacgccccgctcctcaccatggactggacctgggacggactccttctttctttgggtggcagccagcccaacaagacgccccaccttacccgaggtcgcgagggttggtgactggtcggtcggggtcgtggagggtagaacgggaacgggccccggggtcctcgtaaggttcggaacggttcctccgtacgacaaacgttcctcgtaggtacctaccttaccttcgaggtcggaaccaaaccctacggtccacgggtggtccgccggtcccgaccgggccccgtacgggaacggtaacgggttcgttagggacggttagggtacggttgggttaagtttggtttaaccgngtaacggaacgtagtcgggtaccgaccgtaattaaaagttgccggtacgtaaaccgggttggggttaccggggtttaacggggggaccttaacggggttacaaccgttccgggaaagggtcccgggtaaacccggggtaccctacccgttaaccgcgtttacccgaaaccccgtaacttaaaccgtaacgtaacggggttaacccgaaacgtttccggaacccgttagtttaacccgtaacggttactttaaccgggttttcggaaacccggtacccgggttcccgtttaaccggttcgtttaaacggttccttggggtacccggaacggtaccggaagggaaccggggaccggtacggacgttacggggttcggttacccggttacgtttacgggtttaccggtaccggtaccgttccccgtccgttcccggttacggg

SEQ ID NO: 286452 - DNA, 1063 bp, Homo sapiens
  misc_feature: GYAE6OF01EYWYX.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccgaggtgcaggtggtgcagtcgtgggggcttaggaggtagaaaggaacggccccgggggtcctaccgaggtgggaaacgggttccttaccgtacggcaaacggtaaccctccgttaggaccttaacctacccgtttcgtaacggttcggggaacctaaacccgtaaacggttcccgtaacggttgggggccgaccccggacccggaccggggtacccccctaagggggaaccccggttaaagggggtaccctttacggggaacgggttggggaaacggtttcgggggtttaagtttacggggtttttaaaccggttcgtaagggtaaacgggttaaaaccgttcgggggtaccggtaacccggtaaactttaaaactttaaggtaccggtaacgttaaaccgggaaggggtttaaacgggggttttccccgggggaacggtttaacggggtaaccttaacgttaccgtaacgggttacccgggggaaaccccgggggtaaccgtaacccgggtttacccgtaaccgttaccccggaaccggttaaaacccttaaaccgggtttaaacccgaacggtttaacggggaaacccgtttacggtaaaccccgtaggtttaacctacgggttaaccttaaacggtttccgggtaaaccccgaaccggggtaaccccgggtttccgttttaaaactttaacccgggtttaacgtacccgggtttacgaaacccggtaaacggtaaaaccgggaaccggggtacccgggggtaaacccgggtacccggtttaaacggggtcgggttttacccgtaaaccgggtttttccggtttaacgggggtacccgaaaccccgggttttccccctaccccggtttaaaccccccggtaaaggg

SEQ ID NO: 286453 - DNA, 843 bp, Homo sapiens
  misc_feature: GYAE6OF01A0WZI.51.12.B01.1.454.CMB.1.raw
  modified_base (56)..(56): a, c, t, g, unknown or other
  misc_feature (56)..(56): n is a, c, g, or t
  modified_base (281)..(281): a, c, t, g, unknown or other
  misc_feature (281)..(281): n is a, c, g, or t
tcagcgatcgtatacacgaccggtgctcgatttagtagtgtagattccgcggggancatcacccagcaaccacatctgtcctctagacgaaccccctgagacgccccgctcctcaccagtggactggacctggaggactccgttactttcgttggtcggcacgcacgccaacgaggacaccctacgtcccgaggtcgacgtagggtcggtcgacgtacggtcgtcggggtcctaggtacggtacgaacggtaccggcccgggcttagagtgaacgtctcgngacaacgtctcgtcgactacaccgttgacgtacggaccaagtaccgtcacggtcggtcgaccgacgtaccgtccggtaggaaccgtacggtccttaaggcggttacggtaacgggttacgtaggtttgggtttaactcgtaaaccggtaggtacgtcgggtacctacgaaacgttaaacttcggaacgtacccgtagggttaacggtcgggtttaccgggacgttacggaccttacgtacggacggtacggaaccggtaccgtcgtaccgtacgtaccgaaccgttaaccgttaacgttacggacgtaacggttaccgtacgtaacctacgtacgttaaccggtacgtttacgtaaccgacccgttaaccggtaccggtttaaccgtaccgttttacgtaacgggttaccgtaccggttaaaccgaaccgggtaaccgtaacggggtaacccggtaacggtacgtttaaccggggtacctttaaacccgggttacgtttaacccggttaacggtacccgggttaaaccgttacccccgtttcggtaaccggttaaacccggg

SEQ ID NO: 286454 - DNA, 158 bp, Homo sapiens
  misc_feature: GYAE6OF02HDZJZ.51.12.B01.1.454.CMB.1.raw
  modified_base (156)..(158): a, c, t, g, unknown or other
  misc_feature (156)..(158): n is a, c, g, or t
tcagcgatcgtatacacgaccggtgctcgatttagtagtgtagattccgcggcacgaccggtgctcgatttagagtgctacgaagggaaagggcagcgtcactctgttcccaccctcctctcgtagcactctgagcgggctggcaaggcgcatagnnn

SEQ ID NO: 286455 - DNA, 174 bp, Homo sapiens
  misc_feature: GYAE6OF02FQ444.51.12.B01.1.454.CMB.1.raw
  modified_base (159)..(174): a, c, t, g, unknown or other
  misc_feature (159)..(174): n is a, c, g, or t
tcagcgatcgtatacacgaccggtgctcgatttagtagtgtagattccgcgggcgacgaccggtgctcgatttagagtgctacgaagggaaagggccagcgtcactctgttcccgccctcctctcgtagcactctgagcgggctggcaaggcgcatagnnnnnnnnnnnnnnnn

SEQ ID NO: 286456 - DNA, 157 bp, Homo sapiens
  misc_feature: GYAE6OF02IGM3U.51.12.B01.1.454.CMB.1.raw
  modified_base (157)..(157): a, c, t, g, unknown or other
  misc_feature (157)..(157): n is a, c, g, or t
tcagcgatcgtatacacgaccggtgctcgatttagtagtgtagattccgcgggcacgaccggtgctcgatttagagtgctacgaagggaaagggcagcgtcactctgttcccaccctcctctcgtagcactctgagcgggctggcaaggcgcatagn

SEQ ID NO: 286457 - DNA, 157 bp, Homo sapiens
  misc_feature: GYAE6OF02HOEWP.51.12.B01.1.454.CMB.1.raw
  modified_base (157)..(157): a, c, t, g, unknown or other
  misc_feature (157)..(157): n is a, c, g, or t
tcagcgatcgtatacacgaccggtgctcgatttagtagtgtagattccgcgggcacgaccggtgctcgatttagctgtgcgtcgagggaaagggcagcgtcactctgttcccaccctcctctcgtagcactctgagcgggctggcaaggcgcatagn

SEQ ID NO: 286458 - DNA, 157 bp, Homo sapiens; identical to SEQ ID NO: 286456
  misc_feature: GYAE6OF02IREYW.51.12.B01.1.454.CMB.1.raw
  modified_base (157)..(157): a, c, t, g, unknown or other
  misc_feature (157)..(157): n is a, c, g, or t

SEQ ID NO: 286459 - DNA, 161 bp, Homo sapiens
  misc_feature: GYAE6OF02HFW68.51.12.B01.1.454.CMB.1.raw
  modified_base (157)..(161): a, c, t, g, unknown or other
  misc_feature (157)..(161): n is a, c, g, or t
tcagcgatcgtatacacgaccggtgctcgatttagtagtgtagattccgcgggcacgaccggtgctcgatttagctacgctctaagggaaagggcagcgtcactctgttcccaccctcctctcgtagcactctgagcgggctggcaaggcgcatagnnnnn

SEQ ID NO: 286460 - DNA, 158 bp, Homo sapiens
  misc_feature: GYAE6OF02G4DR6.51.12.B01.1.454.CMB.1.raw
  modified_base (157)..(158): a, c, t, g, unknown or other
  misc_feature (157)..(158): n is a, c, g, or t
tcagcgatcgtatacacgaccggtgctcgatttagtagtgtagatttcgcgggcacgaccggtgctcgatttagagtgctacgaagggaaagggcagcgtcactctgttcccaccctcctctcgtagcactctgagcgggctggcaaggcgcatagnn

SEQ ID NO: 286461 - DNA, 514 bp, Homo sapiens
  misc_feature: GYAE6OF02IS3NB.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggcaagggcttgagtggatgggatggtttagtctgagaactggtgccgcaaattatgcacgaggagtttcggggcaggggtcatcatgaccgggacacgtccatcgccacaactacatggaactgaccagtctgacattgacgacgacgccgtctattactgtgcgacagagcggcggacagaggttcgcttacgtggttcgaggctcctccccacgg

SEQ ID NO: 286462 - DNA, 529 bp, Homo sapiens
  misc_feature: GYAE6OF02GQO4X.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcaggggtcagtcgatgaccggggacacgtccatcgccacaacttacatggaactgaccagtctgactattgacgacacggccgtctattactgtgcgacagaagcgggcggacaggaggttcgcgttacgtcgggttcgaggtcttccgtcccctacgg

SEQ ID NO: 286463 - DNA, 157 bp, Homo sapiens; identical to SEQ ID NO: 286456
  misc_feature: GYAE6OF02I2CYH.51.12.B01.1.454.CMB.1.raw
  modified_base (157)..(157): a, c, t, g, unknown or other
  misc_feature (157)..(157): n is a, c, g, or t

SEQ ID NO: 286464 - DNA, 157 bp, Homo sapiens; identical to SEQ ID NO: 286223
  misc_feature: GYAE6OF02ILZOO.51.12.B01.1.454.CMB.1.raw
  modified_base (157)..(157): a, c, t, g, unknown or other
  misc_feature (157)..(157): n is a, c, g, or t

SEQ ID NO: 286465 - DNA, 561 bp, Homo sapiens
  misc_feature: GYAE6OF02HYGWS.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatggggatggtttagtctgagaactggtgcccgacaaattatgacacgagggtagtttcggggcaggggtcagtcgagtggaccggggacaccgtccatcgaccacaacttacatcggaactgaccagtctgactatttcgacgaccacggccgtacttacttacgtgtcgacgacaggaacggcggacggacgaaggtacggttacgcgttacgtgggttcgaggtcctaccctcccccgtaacgg

SEQ ID NO: 286466 - DNA, 526 bp, Homo sapiens
  misc_feature: GYAE6OF02JCH25.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaaattatgcacaggagtttcggggcaggggtcatcatggaccggggacacgtccatcgccacaacttacatggaactgaccagtctgactatttgacgacacggcctctattactgtgcgacagaagcggcggacgagaggttcgacgttacgtggttcgaggtctccgtcccctaagg

SEQ ID NO: 286467 - DNA, 574 bp, Homo sapiens
  misc_feature: GYAE6OF02GD8G6.51.12.B01.1.454.CMB.1.raw
  modified_base (353)..(353): a, c, t, g, unknown or other
  misc_feature (353)..(353): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaacgtggtgccgcaaattntgacacgaggtaggtttcggggcgtagggtcagtcgagtcggaccggggactacgtccagtccgaccactaacttacagtacggaactcgacgagtctagactagtttacgacgacgaccggtccgtacttattactgtcgacgacgagacggcggacggacgaggtacggttcgtacgtttacgttcgggttacggacggtcctcccgtaccccgtacgg

SEQ ID NO: 286468 - DNA, 519 bp, Homo sapiens
  misc_feature: GYAE6OF02F4LNG.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacgaggagtttcggggcagggtcatcatgacgggacacgtcatcgcacaactacatggaactgacagtctgactattgacgacacggcctctattactgtgcgacagagcggacggacaggacggttcgcgttacgtggttccgaggtcctcctccccgtacgg

SEQ ID NO: 286469 - DNA, 527 bp, Homo sapiens
  misc_feature: GYAE6OF02GP65L.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaaggcttgagtggatgggatggtttagtctgagaactggtgccgcaaattatgcacaggagtttcggggctagggtcatcgagtgaccgggacacgtcatcgccacaactacatggaactgaccagtctgactattgacgacgacgtccgtacttattactgtgcgacgagaaggcggcggacaggtaggttcgtcgttacgtggttcgaggtctccgtcccctagg

SEQ ID NO: 286470 - DNA, 553 bp, Homo sapiens
  misc_feature: GYAE6OF02GPZB9.51.12.B01.1.454.CMB.1.raw
  modified_base (398)..(398): a, c, t, g, unknown or other
  misc_feature (398)..(398): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacgagggaggtttcggggcaggggtcagtcagtggaccggganacgtcagtcgaccactaacttacatggaactgacctagtctgactatttgacgacgacggccgtactattactgtcgacgacagaacgcggcggaacgaggtacggttcgacgttacggtcgggttacggaggtccgttcccgtaccccgtacgg

SEQ ID NO: 286471 - DNA, 514 bp, Homo sapiens
  misc_feature: GYAE6OF02IOYX8.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggcctcagtgaaggtctcctgcaagacctctggctacaccttcagtggcaacaacgtccactgggtgcgccaggcccctggacaagggcttgagtggatgggatggtttagtctgagactggtgccgcaaattatgcacaggagtttcggggcagggtcatcagtgaccgggacacgtcatcgccacactacatgaactgaccagtctgacatttgacgacacggccgtctattactgtcgcgacagaagcggcggacaggagttcgacgttacgtggttcgaggctcctcccctagg

SEQ ID NO: 286472 - DNA, 545 bp, Homo sapiens
  misc_feature: GYAE6OF02IWLK5.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccggggcctcagtgaaggtctcctgcaagacctctggctacaccttcagtggcaacaacgtccactgggtgcgccaggcccctggacaagggcttggagtggatgggatggtttagtctgagaactgggtgccgacaaattatgacacgaggagtttcgggggcaggggtcagtcagtcggaccgggacacgtccatccgcacaacttacatggaactgaccagtctgactagttgacgaccgacggtccgtcttattacgtgtgcgacagaacgcgggcggacaggaggttcgtcgttacgtcgggttacgacggtcctccgtaccccgtagg

SEQ ID NO: 286473 - DNA, 269 bp, Homo sapiens
  misc_feature: GYAE6OF02FPATT.51.12.B01.1.454.CMB.1.raw
  modified_base (268)..(269): a, c, t, g, unknown or other
  misc_feature (268)..(269): n is a, c, g, or t
tcagcgatcgtatacacgaccggtgctcgatttagtagtgtagattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctgttcccaccctcctctcgtagcactctgagcgggctggcaaggcgcatagnn

SEQ ID NO: 286474 - DNA, 534 bp, Homo sapiens
  misc_feature: GYAE6OF02HKK47.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggttagtctgagaactggtgccgacaaattatgcacgaggtagtttcggggcagggtcatcgatggaccgggacacgtcatcgaccacaactacatggaactcgaccagtctgactattcgacgacgacggccgtactattactgtgcgacgagagcggcggacaggaggttcgtcgttacgtggtacgtacggtccttccgtccccgtacgg

SEQ ID NO: 286475 - DNA, 524 bp, Homo sapiens
  misc_feature: GYAE6OF02HLP79.51.12.B01.1.454.CMB.1.raw
  modified_base (466)..(466): a, c, t, g, unknown or other
  misc_feature (466)..(466): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacagggtagtttcggggcaggggtcatcagtgacgggacacgtcatcgcacaactacatggaactgaccagtctgactattgacgacgacgccgtctacttactgtgcganagaagcggcggacaggaggttcgcttacgtcggttcgagggtcctccgtcccctacgg

SEQ ID NO: 286476 - DNA, 557 bp, Homo sapiens
  misc_feature: GYAE6OF02HLEP1.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggctcagtgaaggtctcctgcaagacctctggctacaccttcagtggcaacaacgtccactgggtgcgccaggcccctggacaagggcttgagtggatggggatggtttagtctgagaacgtgggtcgccggacaaattagtgacacgagggtgtttcgggggctaggggtcagtcgagtcggaccgggacacgtccagtccgcacaacttacatcggaactgaccagtctgacagtttcgacgacgacggccgttactattacgtgtcgcgacagaacgcggaacggacaggtacggttcgacgttacgtcggttcgacggtccttccgtccccgtacgg

SEQ ID NO: 286477 - DNA, 544 bp, Homo sapiens
  misc_feature: GYAE6OF02FJ4UQ.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgcgccacggcccctggacaagggcttgagtggatgggatggtttagtctgagactggtgccgacaaattatgcacgaggtagtttcggggctagggtcatcagtcggaccgggacacgtccagtcgccacaactacagtggactgaccagtctgactattagacgacgacggtccgtacttattactgtgcgacgagacgcgggacggacgaggtacggttcgacgttacgtcggttcgaggtcctccgtccccgtacgg

SEQ ID NO: 286478 - DNA, 525 bp, Homo sapiens
  misc_feature: GYAE6OF02IRUL3.51.12.B01.1.454.CMB.1.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactggtgcgccaggcccctggacaagggcttgngtggatgggatggtttagtctgagaactggtgccgcaaattntgcacaggagtttcggggcagggtcagtcagtgaccggggacacgtccatcgccacaacttacatggaactgacagtctgactattgacgacacgccgtctacttactgtgacgacgagaagcgggcgacgagtaggttcgtcttacgtggttcgaggtctccgtcccctacgg

SEQ ID NO: 286479 - DNA, 549 bp, Homo sapiens
  misc_feature: GYAE6OF02HWU53.51.12.B01.1.454.CMB.1.raw
  modified_base (358)..(358): a, c, t, g, unknown or other
  misc_feature (358)..(358): n is a, c, g, or t
  modified_base (479)..(479): a, c, t, g, unknown or other
  misc_feature (479)..(479): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctcgtggctacaccttcagtggcaacaacgttccactgggtgcgccaggcccctgggacaagggcttggagtggatggggattgggtttagtcgtgagaactggtgccgacaaattntgcacgagggtaggtttcggggcaggggtcatcgagtcggaccggggacacgtccatcgccacaacttacatggaactgaccagtctgactattgacgacgacggccgtctattctgtcgngacagacggacgggcgacgaggcggttacggactttacgtcggtttcggacggtcctcctccccgtacgg

SEQ ID NO: 286480 - DNA, 534 bp, Homo sapiens
  misc_feature: GYAE6OF02FY4G9.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtgcaacaacgtccactgggtgcgccaggcccctggacaagggcttgagtggatgggatggtttagctgagaactggtgccgcaaattatgcacgagggtagtttcgggggctaggggtcagtcgatcggacggggacacgtccgagtcgccacaacttacatggaactcgaccagtctgactatttgacgacgacggccgtctattactgtcgcgacagaggcggcggacaggtaggttcgcgttacgtggttcgaggcctcctccccgtagg

SEQ ID NO: 286481 - DNA, 607 bp, Homo sapiens
  misc_feature: GYAE6OF02HYXNL.51.12.B01.1.454.CMB.1.raw
  modified_base (253)..(253): a, c, t, g, unknown or other
  misc_feature (253)..(253): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaggtctcctgcagctctgctacaccttnagtgcaacacgtccacgtgggtgcgccgaggccccgtggacaagggcttgagtggagtgggattggttagtcgtgaggtaacgtggtcgccgactaaattgtagcacgaggtaggtttacggggcgtagggtcatcgtagtacgggaccggggactaccggtccacgtccgacctaacgtaaccttacgagtacgggaacttacggaacctagttcgtagtactagtttacgaccgacgtaccggaccgttacttacgttacgtgtacgtacgactaggaacggtcgggacggtaacgaggtacggttcgtacgtttacggtgggttaccgaggtcctcccgtccccgtaacgg

SEQ ID NO: 286482 - DNA, 535 bp, Homo sapiens
  misc_feature: GYAE6OF02F2D1I.51.12.B01.1.454.CMB.1.raw
  modified_base (347)..(347): a, c, t, g, unknown or other
  misc_feature (347)..(347): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccactgggtgcgccaggcccctggacaagggcttgagtggatgggatggtttagtctgagaacgtggtgccganaaattatgcacgaggagtttcggggcagggtcagtcagtgaccgggacacgtcatcgcacaactacatgactgacagtctgtactatttgacgacgacgccgtctattactgtgcgacgagaacggcggacggacaggtacggttcgacgttacgtcggttccggacggtccttccgtccccgtacgg

SEQ ID NO: 286483 - DNA, 557 bp, Homo sapiens
  misc_feature: GYAE6OF02JF5ES.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagagccggggctcagtgaaggtctcctgcaagacctctggctacaccttcagtggcaacaacgtccactgggtgcgccaggcccctggacaagggcttgagtggatgggatggtttagctgagacgtggtgccgactaaattagtgacacgagggtagtttcggggctagggtcatcgagtcggaccgggacacgtccacgtcgaccacaacttacagtaggaactgaccagtctagactagttcgacgacgacggcgttactagttactgtgacgacagaaggcggacggacgtacggtacggttcgtacgttacggttcggttacgacggtcctccgtccccgtaacgg

SEQ ID NO: 286484 - DNA, 534 bp, Homo sapiens
  misc_feature: GYAE6OF02I1X8I.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctctggctacaccttcagtggcaacaacgtccactgggtgcgcaggcccctggacaagggcttgagtggatgggatggtttagtctgagaactggtgccgacaaattatgcacgaggtagtttcggggcagggtcatcgatcgaccgggacacgtcatcgccacaacttacatggaactgacctagtctagactatttgacgacgacggccgtctattacgtgtgcgacgagaaggcggcggacaggtacggttcgcgttacgtggttcggaggtcgtcctccccgtacgg

SEQ ID NO: 286485 - DNA, 536 bp, Homo sapiens
  misc_feature: GYAE6OF02I1R8D.51.12.B01.1.454.CMB.1.raw
  modified_base (327)..(327): a, c, t, g, unknown or other
  misc_feature (327)..(327): n is a, c, g, or t
  modified_base (350)..(350): a, c, t, g, unknown or other
  misc_feature (350)..(350): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtgtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagntgagaactggtcgcgctaaattntgacacgaggtagtttcggggcagggttcagttcagtcggaccggggacacgtccagtccgaccacaacttacagtcggaactgacagtctagactattgacacgacgcctactagttactgtgcgatagaagcggcggacaggtagttcgacttacgtggttacgacggtctccgtccccgtagg

SEQ ID NO: 286486 - DNA, 157 bp, Homo sapiens; identical to SEQ ID NO: 286456
  misc_feature: GYAE6OF02IWEOD.51.12.B01.1.454.CMB.1.raw
  modified_base (157)..(157): a, c, t, g, unknown or other
  misc_feature (157)..(157): n is a, c, g, or t

SEQ ID NO: 286487 - DNA, 540 bp, Homo sapiens
  misc_feature: GYAE6OF02FJVTH.51.12.B01.1.454.CMB.1.raw
  modified_base (350)..(350): a, c, t, g, unknown or other
  misc_feature (350)..(350): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccatgggtgcgccaggcccctggacaaggcttgagtggatgggatggtttagtctgagaactggtgccgcaaattntgcacgaggtagtttcggggcagggtcatcatgacggggacacgtccagtcgccacaacttacatggaactgacagtctgtactagtttagacgacacggccgtactattactgtcgcgacagaacgcggacggacgaggaggttcgactttacgtgggttacggacggtccttcccgtaccccgtacgg

SEQ ID NO: 286488 - DNA, 548 bp, Homo sapiens
  misc_feature: GYAE6OF02JBK9Z.51.12.B01.1.454.CMB.1.raw
  modified_base (283)..(283): a, c, t, g, unknown or other
  misc_feature (283)..(283): n is a, c, g, or t
  modified_base (352)..(352): a, c, t, g, unknown or other
  misc_feature (352)..(352): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggcctcagtgaaggtctcctgcaagacctctggctacaccttcagtggcaacaacgtccactgggtncgccaggcccctggacagggcttggagtggatgggatggtttagtctgagaactggtgcgacaaattangacacgaggtagtttcggggcaggggtcagtcagtggaccgggacacgtcactcgccacaactacatacggaactgactagtctgactatttcgacgacgacggtccgtcttacttactgtcgcgacgagaggacggcggactaggacggttcgacgttacgttcgggttacgacggtcctcccgtccccgtacgg

SEQ ID NO: 286489 - DNA, 553 bp, Homo sapiens
  misc_feature: GYAE6OF02HA34W.51.12.B01.1.454.CMB.1.raw
  modified_base (283)..(283): a, c, t, g, unknown or other
  misc_feature (283)..(283): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctctggctacaccttcagtggcaacaacgtccactgggtncgccaggcccctggacaagggcttgagtggatgggatggtttagtctgagaactggtgccgcaaattatgcacaggtagtttcggggcagggtcagtcagtggaccggggacacgtccgatcgccactaacttcattaggaactcgaccagtctgacatttgacgacgacggccgtactacttacgtgtgacgacagaaggcggtcggacgaggtacggttccgtacgtttacgtgggttacggacggtccgttccgtcccccgtaacgg

SEQ ID NO: 286490 - DNA, 589 bp, Homo sapiens
  misc_feature: GYAE6OF02GXWFP.51.12.B01.1.454.CMB.1.raw
  modified_base (362)..(362): a, c, t, g, unknown or other
  misc_feature (362)..(362): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgcgccaggcccctggacaagggcttggagtggatgggattggtttagtctaggagtaacgtggtcgccgactaaattngcaacgagggtaggtttcggggctagggtcatcgagtcggaccgggacacgtccagtccgaccaactaacttacagtcggaactcgacctagtctagactagtttcgaaccgacgaccggtccgtacttacgttacgtggtacgaccgtacacggaacggccgggacggaacgaggtacggttcgtacgttacgtcgggttcggacggtcctcccgtaccccgtagg

SEQ ID NO: 286491 - DNA, 538 bp, Homo sapiens
  misc_feature: GYAE6OF02FQSZT.51.12.B01.1.454.CMB.1.raw
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
  modified_base (493)..(493): a, c, t, g, unknown or other
  misc_feature (493)..(493): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctggagaactggtgccgcaaattangcacaggagtttcggggnaggggtcatcatggaccgggacacgtccagtcgccacaactacatggaactgaccagtctgactatttcgacgtaccgacggtccgtctacttactgtgcgagagaagcggcggacgaggnggttcgacgttacgtgggttacgacggtcttccgtccccgtacgg

SEQ ID NO: 286492 - DNA, 542 bp, Homo sapiens
  misc_feature: GYAE6OF02I2MHC.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacgaggaggtttcggggcaggggtcagtcagtggaccgggacacgtccatcgccacaacttacataggaactgaccagtctgactatttagacgacacggccgtacttattactgtcgcgacgagaacgcgggcggacgaggtaggttcgacgttacgttcggtcgaggtccgtcctccccgtacgg

SEQ ID NO: 286493 - DNA, 565 bp, Homo sapiens
  misc_feature: GYAE6OF02G11AS.51.12.B01.1.454.CMB.1.raw
  modified_base (358)..(358): a, c, t, g, unknown or other
  misc_feature (358)..(358): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgcgccaggcccctggacaagggcttggagtggagtgggattggtttagtctagagaactggtgccgataaattngcagaggtagtttcggggctagggtcagtcgagtcggaccgggacacgtcacgtcgccacaacttacatagaactgactagtctagactagttcgacgacgaccgtccgtacttagttacgtgtacgacgacgaggaacgcgggacggaacgaggtacggttcgtacgttacgttcggttacgacggtcctcccgtccccgtaacgg

SEQ ID NO: 286494 - DNA, 513 bp, Homo sapiens
  misc_feature: GYAE6OF02HTT3Q.51.12.B01.1.454.CMB.1.raw
  modified_base (259)..(259): a, c, t, g, unknown or other
  misc_feature (259)..(259): n is a, c, g, or t
  modified_base (370)..(370): a, c, t, g, unknown or other
  misc_feature (370)..(370): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttnacgtggcaacaacgtccaactgggtgcgccaggcccctggacaagggcttgagtggatgggatggttagtctgagaactggtgccgcaaattatgcacaggagtttcgggnagggtcagtcatgacgggacacgtcatcgcacaactacagtgaactgacagtctgacattgacgacacggcctctattctgtgcgacagagcggacggacaggaggttcgcttacgcgggttcgaggtctccgtccccaacgg

SEQ ID NO: 286495 - DNA, 696 bp, Homo sapiens
  misc_feature: GYAE6OF02IJR01.51.12.B01.1.454.CMB.1.raw
tcagcgatcgtatacacgaccggtgctcgatttagtagtgtagattccgcgggggagcatcacccagcaaccacatctgtcctctagagaaccccctgagacgccccgctcctcaccatggactggacctggaggatcctcttcttggtggcagcagccaacaagacgcccacctcccgaggtgcgaggtggtgcagtcgtggggctggaggtagaaggaacggcccggggcctcgaggtgtaaggtctccgtgacaacgacctcgtcggctacctaccttcagtggaccaacaaccgtccacgtgggtgccgccacggcccctaggaccgaaggggtccttggaggtggagtggggattgggtttagtcgtgagtaacgtggtcgccgataaaattagtgaccacgaagggttacgggtttcggggacgtaggggtctaacgttcgagttacggggacccggggaacacccggtaccgagttcccggacccaaccgtaaacttaaccagttacggtaaaccgtagaaccctagtcctagtaacctgttttacgaacgtaccgaccgggtccgttacttacgtttaacgtggtacgaccgtaacgaggaacggtcgggacggtaacgagggtacggttaccgtacgtttacggttcgggttaccggaacgggtcccttacccgtcccccgtaacgg

SEQ ID NO: 286496 - DNA, 589 bp, Homo sapiens
  misc_feature: GYAE6OF02HZP1F.51.12.B01.1.454.CMB.1.raw
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (532)..(532): a, c, t, g, unknown or other
  misc_feature (532)..(532): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggctcagtgaggtctcctgcaagacctctggctacaccttcagtggcaacaacgtccacgtgggtgcgccacggccccctggaccaagggcttgagtggagtggggattgggtttagtcgtggagtaacgtgggtgccggactaaagttnggcaacgagggtaggtttcgggggntaggggtcaagtcaagtcggaccggggacacggtccacgtcgccaactaacttacgagtacggaactcgaccagtctgactattcgacgaccgacggtccgtactacttcgtgtcgtacgacgagaacggtcggcggacgnggtacgggttccgacgtttacgtcggttaccggtacggtcctcccgtccccgtacgg

SEQ ID NO: 286497 - DNA, 575 bp, Homo sapiens
  misc_feature: GYAE6OF02I0KA4.51.12.B01.1.454.CMB.1.raw
  modified_base (359)..(359): a, c, t, g, unknown or other
  misc_feature (359)..(359): n is a, c, g, or t
  modified_base (553)..(553): a, c, t, g, unknown or other
  misc_feature (553)..(553): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaagcccggggcctcagtgaaggtctcctgcaagacctctggctacaccttcagtggcaacaacgtccactgggtgcgccaggcccctggacaagggcttggagtggatggggatggtttagtctagagaacgtggtgccgactaaattntgcacgaggtaggtttcggggcagggtcagtcgagtcggaccggggacacgtccatccgaccaactaacttacagtaggtaactcgacctagtactgtactagttacgacgacgacgccgtacttacgttactcgttcgcgacgagaaggcgggcggaagacggtaggttcgtacgttacggttcggttacggnggtccgtcccgtccccgtacgg

SEQ ID NO: 286498 - DNA, 566 bp, Homo sapiens
  misc_feature: GYAE6OF02HOJQW.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacacgtccactgggtgccgccacggcccctggacaagggcttgagtggatgggattggttagtctgagaactggtgccgataaattgtgacacgagggtaggtttcggggctaggggtcatcgagtggaccggggacacgtccagtccgccactaacttacagtggaactcgacctagtctagactattcgacgacgacggtccgtacttacttacgtgtgcgacgagacggcggacggacgaggtacggttacgtcgttacgttcggttacggacggtccgttcccgtaccccgtacgg

SEQ ID NO: 286499 - DNA, 531 bp, Homo sapiens
  misc_feature: GYAE6OF02IV1E6.51.12.B01.1.454.CMB.1.raw
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatggggatggtttagtctggagaactggtgccgnaaattntgcacaggagtttcggggcagggtcatcagtgaccgggacacgtcagtcgccacaacttacatggaactgaccagtctcgactatttgacgacgacggccgtctacttacgtgtgcgacagaacggcggcggacgagacggttcgcgttacgtggttcgaggtctcctccccgtacg

SEQ ID NO: 286500 - DNA, 530 bp, Homo sapiens
  misc_feature: GYAE6OF02F8NVL.51.12.B01.1.454.CMB.1.raw
  modified_base (346)..(346): a, c, t, g, unknown or other
  misc_feature (346)..(346): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttctggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatggggatggtttagctgagaacgtggtgccgnaaattatgcacgaggagtttcggggcagggtcagtcatggaccgggacacgtccatcgccacaacttacagtgaactgaccagtctgactatttgacgacgacgccgtctattactgtgcgacagagcgggacggacaggaggttcgcgttacgtggttacggaggtcctccgtccccctacgg

SEQ ID NO: 286501 - DNA, 548 bp, Homo sapiens
  misc_feature: GYAE6OF02I3BH7.51.12.B01.1.454.CMB.1.raw
  modified_base (352)..(352): a, c, t, g, unknown or other
  misc_feature (352)..(352): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggctggagtggatgggatggtttagctgagaactggtgccgctaaagtntgcacgaggtagtttcggggctagggtcagtcagtcggaccggggacacgtaccagtcgccacaactacagtggaactgaccagtctagactattcgacgacgacggccgtctacttcgtgtcgacgacgacgaagcggcggacgagtacggttcgcgttacggtcggttacgaggtccgtccgtccccgtaacgg

SEQ ID NO: 286502 - DNA, 574 bp, Homo sapiens
  misc_feature: GYAE6OF02GOL6M.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgactaaattatgacacgagggtaggttttcgggggacgtaggggtcagtcgagtcggaccgggggacaccggtccagtccgaccactaaacttacatacggaactcgaccagtctagactagtttcgacgacgacggccgtcttattacgtgtcgcgacagaacggcgggcggaacgaggtaggttcgcgttacgttcgggttaccgaggtccttccgtccccgtaacgg

SEQ ID NO: 286503 - DNA, 537 bp, Homo sapiens
  misc_feature: GYAE6OF02FU5Q5.51.12.B01.1.454.CMB.1.raw
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccactgggtgcgccaggcccctggacaagggcttgagtggatgggatggtttagctgagaactggtgccgntaaattntgcacgagggagtttcgggggcagggtcagtcagtggaccgggacacgtccatcgccacaacttacataggaactgaccagtctgactatttgacgacgacggccgtctattactgtgcgacagaagcggcggacgaggtacggttcgtacgttacgtcggttacggacggtctacctccccgtacgg

SEQ ID NO: 286504 - DNA, 560 bp, Homo sapiens
  misc_feature: GYAE6OF02HTU4E.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaaggcccggggcctcagtgaaggtctcctgcaagacctctggctacaccttcagtggcaacaacgtccactgggtgcgccaggcccctgggacaaggggcttggaggtggagtgggagttggtttagtctggagaactggtcgccgacaaattagtcgacacgagggtaggtttcggggcagggtcagtcgagtcggaccgggacacgtcacgtccgaccacaacttacagtggaactgaacagtctgactattgacgacgccggccgttctaactttctgtacgcgagagaaggcgggacggacgaggaggttcgcgttacgtgggttccgaggtcctccgtcccgtagg

SEQ ID NO: 286505 - DNA, 557 bp, Homo sapiens
  misc_feature: GYAE6OF02I5LW4.51.12.B01.1.454.CMB.1.raw
  modified_base (235)..(235): a, c, t, g, unknown or other
  misc_feature (235)..(235): n is a, c, g, or t
  modified_base (246)..(246): a, c, t, g, unknown or other
  misc_feature (246)..(246): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggcctcagtgaaggtctccngcaagacctcnggctacaccttcagtggcaacaacgtccactgggtgcgccgacggcccctggacaagggcttggagtggatgggattggttagtctggagaacgtggtgccgataaattagtgacacgagggtaggtttccggggcgtacggggtctagtcgagtcggaccggggacacgtccacgtccgaccactaacgttacactcggtaactgaccagtcagactagttcgacgacacggccgtactattcgtgtcgcgacagacggcggcggacaggtacgtcgtcgttacgtggtacgcggtctccgtcccgtagg

SEQ ID NO: 286506 - DNA, 789 bp, Homo sapiens
  misc_feature: GYAE6OF02I0EXJ.51.12.B01.1.454.CMB.1.raw
  modified_base (280)..(280): a, c, t, g, unknown or other
  misc_feature (280)..(280): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctgggctgaggtgaagagcccgggctcagtgaaggtctcctgcaagacctctggctacaccttcagtggcaacaacgtccatgggtcncgccacggccccgtggacaacgggcttggacgtggagtgggtatgggtttacgtcgtaggagaaccgttggggtacgcccggtactaaaagttacgttcggacgtaacggaaggggttacgggttttaccgggggggacctaaggggggttcccgaacgtttaccgaagggtttacggggaaccccgggggtaaccgtaacccgggtttaccccgagtttacccggacccgtaaccgtaaaaccgtttaaccgaacgtttacgggaaaccgttacggtaaccctacggttaccgttacgtaaaccgttacgttttaccggaaccggtaccgtaacccgggttaccgttacctttaacgttacgttacggttacggaccgtaacgtacgggaaacggtccggggtaccggtaaccggtaagggtaccgggtttaccggtaaccgttttaaccggtttcggggttaacccgggacggttaccccgtttacccgtaccccccgttaacgggg

SEQ ID NO: 286507 - DNA, 158 bp, Homo sapiens
  misc_feature: GYAE6OF02IN402.51.12.B01.1.454.CMB.1.raw
  modified_base (157)..(158): a, c, t, g, unknown or other
  misc_feature (157)..(158): n is a, c, g, or t
tcagcgatcgtatacacgaccggtgctcgatttagtagtgtagattccgcgggcacgaccggtgctcgatttagtgagtcagtaagggaaagggcagcgtcactctgttcccaccctcctctcgtagcactctgagcgggctggcaaggcgcatagnn

SEQ ID NO: 286508 - DNA, 601 bp, Homo sapiens
  misc_feature: GYAE6OF02IVMF8.51.12.B01.1.454.CMB.1.raw
  modified_base (376)..(376): a, c, t, g, unknown or other
  misc_feature (376)..(376): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtctggggctgaggtgaagaagcccggggctcagtgaaggtctcctgcaagacctcgtggctacaccttcagtggacaacacgtccacgtgggtcgccgccacggccccctgggaaccaaggggtcttaggaggtggagtggggattggtttagctggagtaacgtgggtcgccggataaattgngacacgagggtaggtttcggggcagggtcagtcgagtcggaccggggacaccgtaccacgtcgaccaactaacttacgagtacggaactacgacctagtcgtacgactagttacgacgaccgaccggtaccgtcttacgtttacgtgtcgcgacgagaacggcgggacggacgaggtcggttcgtacgttacgtcggttacggacggtcctcccgtccccgtagg

SEQ ID NO: 286509 - DNA, 579 bp, Homo sapiens
  misc_feature: GYAE6OF02HG4AG.51.12.B01.1.454.CMB.1.raw
  modified_base (355)..(355): a, c, t, g, unknown or other
  misc_feature (355)..(355): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactggtgcgccaggcccctggacaagggcttgagtggatgggattggtttagtctgagaacgtggtcgcgactaaattngcacgaggtagtttcggggcagggtcagtcgagtcggaccgggacacgtcacgtcgccaactaacttacatacggaactcgaccagtctagactagttcgacctacgaccgtccgtacttacttacgtgtacgacgacgtagaacggcgggtacggacgtagggtacggttcgtacgtttacggttcgggtacggtacggtacccttcccggtaccccgtacgg

SEQ ID NO: 286510 - DNA, 721 bp, Homo sapiens
  misc_feature: GYAE6OF02JKOWM.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccgggctcagtgaaggtctcctgcaagacctctggctacaccttcagtggcaacaacgtccacgtgggtgcgcctacggccccgtggacaagggtcttggacgtggatgggattggtttgtctggaagtacgtggtcgccgtactaaaattgtacgctaacggagggttacgggtttccgggggacgtaacggggtacacgttcgtaagtacgggtaacccgggggacgtaaccggttacccgtaacgtacccggtacccgtaaaccgtaaccttaaccgtacgtacggaaaccgttacggtaaccgtaacgtacgttacgtaacgttagttaccggtaaccgtaccgtaaccgggtaccgttaccgtttaacgttaccgttacgtaccggtaccgtaaccgacgtaacgggtaccgggaccgggtaacgtacgggtacggtttaccggtaccgtttaaccggttcgggttaccggtacggttacccgttcccgtacccccgtaacgg

SEQ ID NO: 286511 - DNA, 587 bp, Homo sapiens
  misc_feature: GYAE6OF02HETUO.51.12.B01.1.454.CMB.1.raw
  modified_base (315)..(315): a, c, t, g, unknown or other
  misc_feature (315)..(315): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaacaacgtccacgtgggtgcgccaggcccctggacaagggcttgagtggntgggatggtttagcgtgagaactgggtcgccgacaaattagtgcacgagggtagtttcgggggcaggggtcagtcagtcggaccggggacgacgtccactcggccacgaacttacatggaactcgacctagtctagactatttcgacgacgaccggccgttctaactttacgtcggtgacgacgtaggaacggtccgggacgggaacgaggtacgggttccgtccgtttacgttcgggttaccggtacgggtccttcccgtccccgtaacgg

SEQ ID NO: 286512 - DNA, 543 bp, Homo sapiens
  misc_feature: GYAE6OF02G5EUC.51.12.B01.1.454.CMB.1.raw
  modified_base (352)..(352): a, c, t, g, unknown or other
  misc_feature (352)..(352): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacacgtccactgggtgcgccacggcccctggacaagggcttgagtggatgggatggtttagtctgagacgtggtcgccgacaaattntgcacgtagggtaggtttcggggcaggggtcagtcagtggaccgggacacgtccactcgccacaactacagtggaactgaccagtctgactatttcgacgacacggtccgtactattactgtcgcgacagaacgcggcggacgaggtacggttcgcgttacgtcggttcgacggtcctccgtcccgtacgg

SEQ ID NO: 286513 - DNA, 216 bp, Homo sapiens
  misc_feature: GYAE6OF02GD9QY.51.12.B01.1.454.CMB.1.raw
  modified_base (196)..(216): a, c, t, g, unknown or other
  misc_feature (196)..(216): n is a, c, g, or t
tcagcgatcgtatacacgaccggtgctcgatttagtagtgtagattccgcgggcacgaccggtgactcgactttagtcgagctcctctcgcgggcacgaccggtgctcgatttagagtgctacgaagggaaggctagcgtcactctgttcccaccctctctcgtagcactctgagcgggctggcaaggcgcatagnnnnnnnnnnnnnnnnnnnnn

SEQ ID NO: 286514 - DNA, 633 bp, Homo sapiens
  misc_feature: GYAE6OF02HF30D.51.12.B01.1.454.CMB.1.raw
  modified_base (243)..(243): a, c, t, g, unknown or other
  misc_feature (243)..(243): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgaagtctcctgcaagacctntggctacaccttcagtggacaacaacgtccacgtgggtcgcgcccgacggcccccgtggaccaaggggtccttaggaggtgggtacgtggggtattgggttttaagtcgttggaacggtaacgttggggtacgcccggactaaaatttagtacggacaacggtagggtaggtttcggggacgtaggggtcagtcgagtcggaccggggactacgtccatccgcaactaacttacagtacggaactcgacagtactgactgttcgacgtacgaccggtaccttctacttacgtgtacgaccgtacgacggaggtccgggacggaacacggtacgggttcgtacgtttacggttacgggttccggacggtcccttacccgtaccccgtacgg

SEQ ID NO: 286515 - DNA, 694 bp, Homo sapiens
  misc_feature: GYAE6OF02IUI2O.51.12.B01.1.454.CMB.1.raw
  modified_base (616)..(616): a, c, t, g, unknown or other
  misc_feature (616)..(616): n is a, c, g, or t
tcagcgatcgtatacacgaccggtgctcgatttagtagtgtagattccgtcggggggtagccactcacccaggcgaaccacatcctgtcctcgtacgagaaccccctggagacgccccgctcctcaccagtcggactggaccgtggagggacttccgtcttccttggtcggcacgcagcctacaacgacgcccgactcccaggtgcgaggtggtgtctgtcgtcggggcgtggaggtgaacgaacggccggggcgtcgaggagaaggtctccgtagcaacgacctcgtggcttacgtaccgtttcaaggttcggactaactaacgtccacgtgggtcgcgaccgtacgcccctaggacaagggtcttaggacgtcggacgtagggtacttggtttacgtcgttacggaagaacgtggtacgcgtacgttaaagttcgtacggccgtaacggtagggtacggtttacgggggcttaaggtcgtaagtcggacgttacggaaccggggtaccacggttactacgtcgtaccgttaacgtaacgttactacgtacggtaactacggtacaggtcgtacgacttacgtcggaacgaccgacggtacctagtacgttaccnggttacacgtacgagacggtcggaacgacgtggtacgttccgacgttacggtcgttccgacggccttacgcccgtagg

SEQ ID NO: 286516 - DNA, 584 bp, Homo sapiens
  misc_feature: GYAE6OF02I03IL.51.12.B01.1.454.CMB.1.raw
  modified_base (253)..(253): a, c, t, g, unknown or other
  misc_feature (253)..(253): n is a, c, g, or t
  modified_base (338)..(338): a, c, t, g, unknown or other
  misc_feature (338)..(338): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaacggcccgggggcctcaggtgaacggtctcctgcaagacctntggcctacaccttcagtggccaacaacgtccacgtgggtgccgccacggcccctggacaaggcttgagtggatgggatggtttancgtgagactggtgccgataaattatgcacgaggtacgggtttcggggacaggggtcagtcgaagtcggaccgggacacggtccagtccgccactaactacataggaactgacctagtctagactagttcgaacgtacgaccgggccttacgttattctggtcgacgacgaggaacggcgggacggtacagggtcggttacgtacgtttacgtgggttcgaacggtccttcccgtaccccgtaacgg

SEQ ID NO: 286517 - DNA, 593 bp, Homo sapiens
  misc_feature: GYAE6OF02J1R03.51.12.B01.1.454.CMB.1.raw
  modified_base (351)..(351): a, c, t, g, unknown or other
  misc_feature (351)..(351): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagagcccggggtctcagtgaaggtctcctgcaagacctcgtggctacgaccttcagtggcaacaacgtccactgggtgcgccaggcccctggacaaggcttgacgtggatcgggatggttagtctggagaacgtggtgcccgtanaaattagtgctacgagggaacggtttcggggacaggggttcagtctagtcggaccggggacaccggtaccacgtcgacccagtaaccttacgatcggaacttgacctagtctgactagtttcgaacgcgaccggtccgtacttattacgtgtacgacgtacgacgaaggtccggcggtacgaggtaacggttcgacgtttacgtcggggttaccgagggtccttacccgtccccgtaacggg

SEQ ID NO: 286518 - DNA, 794 bp, Homo sapiens
  misc_feature: GYAE6OF02HR69D.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagcctctggctacaccttcagtggcaacaacgtccactgggtgcgccaggcccctggacaagggcttggagtggatgggattgggtttagtctggagtaactgggtcgccgactaaaatttactggacctaacgaaggggtacggttttccgggggaccgtagggggttaccagtttaccgtaagtacgggaaccccgggggtaaccgtaaccggttacccgaacgttacccggacccgtaaacctaaaccgtttaaccgaacgttaacgggtaaacgttacggaaacccgtaacggttaccttacggtaaaccgttagtttttacggaaacccggtaaccgtaacccgggtacccggtttaccgtttaaccgtttttaaaccgttcggttaacggtacccggtaaccggtaacggaaaccggggtacccggggtaaccggggtaaccggtaaacggggttaacggggtttacccgggttaccgttttaaccggttacggggttttaccgggtaaccggggttccctttaccccggtacccccccgttaacggg

SEQ ID NO: 286519 - DNA, 615 bp, Homo sapiens
  misc_feature: GYAE6OF02GCZJE.51.12.B01.1.454.CMB.1.raw
  modified_base (247)..(247): a, c, t, g, unknown or other
  misc_feature (247)..(247): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagaccctntggctacaccttcagtggcaacaacgtccacgtgggtgccgccacggcccctggacaagggcttggagtggatgggattgggtttagtcgtagagtaacgtgggtcgcccgactaaattagtgacacggtagggtacggttttccggggggactagggggtcacgtcgaagtcgggaaccggggacacggtcccagtccgaccaacgtaaccttacagtacggaactcgaccgtagtctagactagttacgacgtacgaccggtccgttacttacgttacgtggtcgacgacaggaacggcggacggactagggtacggttcgtacgttacgtcggttacggacggtccgttcccgtaccccgtacgg

SEQ ID NO: 286520 - DNA, 584 bp, Homo sapiens
  misc_feature: GYAE6OF02I5NMZ.51.12.B01.1.454.CMB.1.raw
  modified_base (356)..(356): a, c, t, g, unknown or other
  misc_feature (356)..(356): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggagtgggatggtttagtctggagaactggtgccgactaaattngcagaggtaggtttcggggctaggggtcagtcgagtggaccggggacacgtccacgtcgccactaactaccataggaactcgacctacgtctagtactatttcgaccgacgaccggtccgttacttacgtttacgtcgtgaccgacgaggaacgaccgggcggaacgtagggtaacggttcggtacttacgttcgggttccggaaggtccgttccctccccgtaacgg

SEQ ID NO: 286521 - DNA, 726 bp, Homo sapiens
  misc_feature: GYAE6OF02JA4EI.51.12.B01.1.454.CMB.1.raw
  modified_base (401)..(401): a, c, t, g, unknown or other
  misc_feature (401)..(401): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccaacaagagcccactcccaggtgcaggtggtgcagtctggggctgaggtgaagagccgggctcagtgaaggtctcctgcaagacctctggctacaccttcagtggacaacaacgtccacgtgggtgcgccgtacggcccctagggacaaggggtcttggacggttggacgtggggaatttggggtttaagtcgttaggaaggtaaaccgttgggggtacgacccggtaactaaaaagtttacgnggtaccgaacgtaaggggttaacgggttttccggggacgtaaggggttccatttacgaagtacgggtaaacccgggggtacgaaccggttcccgaaacgttcccggaaccgtaacgtaaaaccgtttaacgagttaacgggtaaaccgttacgaacccgtaggtacgttacgaaccttagtttacggaaccgtaccgtaccgtaccgttaccttaacgtttacgtaggtacgacgtaacgacggtaacggacgggtaccgggaactacgggtaacgttccgtacgttaacgtcgggttacggacggtctccccgtacccgtacgg

SEQ ID NO: 286522 - DNA, 623 bp, Homo sapiens
  misc_feature: GYAE6OF02GREOQ.51.12.B01.1.454.CMB.1.raw
  modified_base (385)..(385): a, c, t, g, unknown or other
  misc_feature (385)..(385): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtcgtggggctgaggtgaagaaggcccggggctcagtgaaggtctcctgcaagacctctggctacaccttcagtggacaacaaccgtccacgtgggtgccgccgacggccccccgtagggaaccgaaggggtccttaggaggtggagtgggagttgggtttagtcgtaggagtaacgtggtcgccgactaaattgngcgacgagggttacggtttcggggactagggtcacgtcgacgtcggaccggggacaccggtaccacgtccgaccaactaacttacgagtaggaacgtacgaccgtagtctagactagtttacgacgtacgaccggtcctacttacgttacgtgtacgacgacaggacggcggcggacgaggtacggttccgtacgtttacggtcggttacggacggtccgttcccgtaccccgtacgg

SEQ ID NO: 286523 - DNA, 582 bp, Homo sapiens
  misc_feature: GYAE6OF02F287H.51.12.B01.1.454.CMB.1.raw
  modified_base (285)..(285): a, c, t, g, unknown or other
  misc_feature (285)..(285): n is a, c, g, or t
  modified_base (362)..(362): a, c, t, g, unknown or other
  misc_feature (362)..(362): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtcggcaacaacgtccactgggtncgccaggcccctggacaagggcttggagtggagtgggatggtttagtctaggagtaacgtggtcgccgactaaattntcgacacgaggtaggtttcggggctaggggtcatcgagtcggaccggggacacgtccagtccgaccactaacttacagtggaactcgaccagtctagactattacgacgaccgacggtccgttacttattacgtcgtacgacgacgacgaacggcggacggacgtaggtacggttcgtacgttacggtcgggttaccgaggtccctccgtccccgtacgg

SEQ ID NO: 286524 - DNA, 578 bp, Homo sapiens
  misc_feature: GYAE6OF02GT2XC.51.12.B01.1.454.CMB.1.raw
  modified_base (355)..(355): a, c, t, g, unknown or other
  misc_feature (355)..(355): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccacggcccctggacaagggcttgagtggatgggatggtttagtctgagaacgtggtgccgacaaattntgcacgaggtagtttcggggctagggtcagtcagtcggaccgggacacgtccagtccgaccactaaccttacagtacggaactcgaccagtctagactagtttcgacgaccgtaccggtccgttacttacgttacgtgtcgaccgtacgagaacggcgggacggacgaggtacggttccgtcgttacgttcggttacggacggtccgttcccgccccgtacgg

SEQ ID NO: 286525 - DNA, 532 bp, Homo sapiens
  misc_feature: GYAE6OF02HKZJN.51.12.B01.1.454.CMB.1.raw
  modified_base (284)..(284): a, c, t, g, unknown or other
  misc_feature (284)..(284): n is a, c, g, or t
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtncgccacggcccctggacaagggcttgagtggatgggatggtttagtctgagaactggtgccgacaaattntgacacaggtagtttcggggcagggtcagtcagtcgaccgggacacgtcatcgccacaactacataggaactgaccagtctgactatttgacgacgacggtccgtcttattacgtgtgcgacagagcggcggacaggagttcgtcttacgtcggtcgacggcttcctaccccgtacgg

SEQ ID NO: 286526 - DNA, 618 bp, Homo sapiens
  misc_feature: GYAE6OF02F2X8I.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgcgccaggcccctggacaagggcttgagtggatgggatggtttagtctggagtaacgtggtcgccgacgaaatttgtgacacgtagggtaggttttccgggggacgtaagggggttccacgttcgaagtcggaacccggggaacgtaccggtcccgaacgtccggaccctaaccgtaaaccttaacaacgttacggtaaactcgaacctagtacctgactagtttgaccgtacgaccggtaccgtacttacttactgtgacgacagaacggcggcggacaggtacggttcgtacgttacggttcggttaccggaggtcctccgtacccctacgg

SEQ ID NO: 286527 - DNA, 566 bp, Homo sapiens
  misc_feature: GYAE6OF02HEGFZ.51.12.B01.1.454.CMB.1.raw
  modified_base (355)..(355): a, c, t, g, unknown or other
  misc_feature (355)..(355): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttggagtggatgggatgggtttagtctgagaactggtgccgcaaattangcacgagggtagtttcggggcagggtcagtcgagtggaccggggacgacgtccatccgccacaacttacatggaactgaccagtctgactagtttgacgacgacgggccgtcttaactttacgtgtcgccgtacaggaacggcgggcggacgaggtaggttccgtacgtttacgttcgggttaccgaggtccttcccgtacccccgtacgg

SEQ ID NO: 286528 - DNA, 536 bp, Homo sapiens
  misc_feature: GYAE6OF02IEFUM.51.12.B01.1.454.CMB.1.raw
  modified_base (501)..(501): a, c, t, g, unknown or other
  misc_feature (501)..(501): n is a, c, g, or t
tcagcgatcgtatacacgaccggtgctcgatttagtagtgtagattccgcggggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccggacaaattatcgacacgaggtagtttacggggcagggtcagtcgatggaccggggacacgtccatcgaccgacaacttacactggaactgaccagtctgactattgacgacacgccgtctattactgtgcgacagagcggcggacgaggaggttcncgttacgtcggttcgacggtctcccgtccctacgg

SEQ ID NO: 286529 - DNA, 533 bp, Homo sapiens
  misc_feature: GYAE6OF02JF1OQ.51.12.B01.1.454.CMB.1.raw
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (330)..(330): a, c, t, g, unknown or other
  misc_feature (330)..(330): n is a, c, g, or t
  modified_base (464)..(464): a, c, t, g, unknown or other
  misc_feature (464)..(464): n is a, c, g, or t
  modified_base (514)..(514): a, c, t, g, unknown or other
  misc_feature (514)..(514): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccgggctcagtgaggtctcctgcaagacctntggctacnccttcagtggcaacacgtccatgggtncgccaggcccctggacagggcttgagtggatggatggttagctgagacgtggngcgataaattgtgcaacgaggtacggtttcggggactagggtcagtcaagtcggaccggggacacgtcagtcgacaactacgtacagtgaactgacagctagatagttcgacacgacgtccgtcttatctgcgngacgagaggtcggcggactaggtacggtcgtacctacggtcggttaccgnggtccttcccgtcccaagg

SEQ ID NO: 286530 - DNA, 705 bp, Homo sapiens
  misc_feature: GYAE6OF02IFFJJ.51.12.B01.1.454.CMB.1.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (361)..(361): a, c, t, g, unknown or other
  misc_feature (361)..(361): n is a, c, g, or t
tcagcgatcgtatacacgaccggtgctcgatttagtagtgtagattccgcgggggagcatcacccagcaaccacatctgtcctctagagaaccccctgacgagccccgctcctcaccatggactggacctggaggatcctcttcttggtggcagcagccacaagagcccactcccaggtcgcgaggtggtgcagtctggggctgaggtgaagagccggggctcagtgagtcncctgcaagactctggctacnccttcagtcggctaacacgtaccagtgggtncgccacggcccctggacaagggcttgacgtgagtgggtatggtttatcgtggaagaacgtggtcgccgactaagttangtacacgagggtacggtttcggggacgtagggtacgtagtctaacgtacgggtacccggggaactacccgggtaaccctacggtaccgaccgtaacctaaaacggtttacaacggtacgtaaaccggttgaacccgtacgtaccgtgtaccgttagtttacgaaccgggtacctacccggggtacccgttaccgttaacgtttacccgttaggtaccggtaccgtacggaacgggtaacggtcccggggaacgtaaccggaacgggtaccggtttacgttaccggtttaaccggtcggggtttaacggcccgggttaccgttaccccggtaccccgtaacgggg

SEQ ID NO: 286531 - DNA, 780 bp, Homo sapiens
  misc_feature: GYAE6OF02HRZU9.51.12.B01.1.454.CMB.1.raw
  modified_base (265)..(265): a, c, t, g, unknown or other
  misc_feature (265)..(265): n is a, c, g, or t
tcagcgatcgtatacacgaccggtgctcgatttagtagtgtagattccgcgggggagcgatcacccagcaaccacagtctgtcctctagagaaccccctgagagccccgctcctcaccatggactggacctggaggatcctcttcgttggtggcgagcagccacaagagcccactcccaggtgcaggtggtgcagtcgtggggctgaggtgaagaagcccggggctcgagtgaaggtctcctgcaagacctctggctacaccttnaagtggacaacgaacgtccaagtgggtgccgacccaaggccccctagggacctaaacgggggtccttaggagttcggagtcggggtattggggtttagtccgtaggaacgaacgttgggtcgtacccgaactaaaagtttcgacggacctaacgaggggttacgtttccgggggactaggggttccaagttccgaagttcggaacccggggtaacctaccggttccgaacgttaccggaccctaaaccgtaaaccgttaacgtaaggtacggtaaaccgtacggaacccgtaagttccgttaagtaaccgttaacgttttaccggaaacgtaacccggtaaccggttacccgttaccgtttaaaccgtttaccggtttaggtaccggtacggtaaccgaacgggtaaccggaccggggtaaccggaacccggtagggtaaccggtttaccgtaccgtttaacggttccgggttaaccggaaccgggttcccttacccggttacccccgtaacggg

SEQ ID NO: 286532 - DNA, 560 bp, Homo sapiens
  misc_feature: GYAE6OF02FZ60W.51.12.B01.1.454.CMB.1.raw
  modified_base (247)..(247): a, c, t, g, unknown or other
  misc_feature (247)..(247): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctntggctacaccttcagtggcaacaacgtccactgggtgcgccaggcccctggacaagggcttgagtggagtgggatggtttagtctgagacgtggngccganaaattngcacgagggtagtttcggggcagggtcatcgagtcggacgggacacgtcagtcgaccacaacttacagtcgaactcgaacacgtactgactagtttcgacgacgacggtccgtacttattactgtgcgaacagacggcgggcggaacgagggtacggttcgtacgtttacgtcggttaccggacggtcccttccgcccctaacggg

SEQ ID NO: 286533 - DNA, 606 bp, Homo sapiens
  misc_feature: GYAE6OF02GVCL6.51.12.B01.1.454.CMB.1.raw
  modified_base (243)..(243): a, c, t, g, unknown or other
  misc_feature (243)..(243): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgaggtctcctgcaagacctntggctacaccttcagtggcaacaacgtccacgtgggtgccgccacggcccctggacgaagggcttggaggtggagtgggattggtttagtcgtgaagtactgggtcgccgataattgtgacacgaggtaggtttcggggctagggtcagtcgagtcggaccggggacacggtccacgtcgccaacgtaacttacagtacggaactcgaccagtctagtactagtttacgaccgtaccgtaccggtccgttacgttacgttacgttggtacgtaccgacgacggaacggtccgggacggaaccgtagggtacggttccgtacgtttacggtggttaccggacggtccttcccgtcccgtaacgg

SEQ ID NO: 286534 - DNA, 570 bp, Homo sapiens
  misc_feature: GYAE6OF02I4ECC.51.12.B01.1.454.CMB.1.raw
  modified_base (243)..(243): a, c, t, g, unknown or other
  misc_feature (243)..(243): n is a, c, g, or t
  modified_base (356)..(356): a, c, t, g, unknown or other
  misc_feature (356)..(356): n is a, c, g, or t
  modified_base (429)..(429): a, c, t, g, unknown or other
  misc_feature (429)..(429): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagagccgggctcagtgaaggtctctgcaagacctntggctacaccttcagtggcaacaacgtccacgtgggtgccgccgacggcccctggacaagggtctggagtggatgggattggttagtcgtgagacgtggtcgccgataaattngacacgaggtacggtttcgggacgtagggtcagtcgagtcggaccgggacacgtacagtcgaccaacaactanagtacggaactcgacgtacgtctagacttagttcgacgtacgaccggtccttactacgttcgtgtcgacgtacgagaacggcggcggacgaggtacggttcgacgtttacgtcggttacgacggtcctcccgtcccgtagg

SEQ ID NO: 286535 - DNA, 529 bp, Homo sapiens
  misc_feature: GYAE6OF02G5EX4.51.12.B01.1.454.CMB.1.raw
  modified_base (353)..(353): a, c, t, g, unknown or other
  misc_feature (353)..(353): n is a, c, g, or t
  modified_base (374)..(374): a, c, t, g, unknown or other
  misc_feature (374)..(374): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctctggctacaccttcagtggcaacaacgtccactgggtgcgccaggcccctggacaagggcttgagtggatgggatggtttagtctgagaactggtcgccgctaaattntgcacgaggacgtttcggggnaggggtcagtcagtgaccgggacacgtccatcgccacaactacagtaggaactcgacagtctgactattcgacgacgacggccgtctactactgtcgcgacagacgcggcggacaggacggtcgtcgttacgtaggtcgaggctcctcccgtacg

SEQ ID NO: 286536 - DNA, 576 bp, Homo sapiens
  misc_feature: GYAE6OF02F70ON.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcgagtgaaggtctcctgcaagacctctggctacaccttcagtggcaacaacgtccacgtgggtgcgccaggcccctggacaagggcttgagtggatgggatggtttagctggagaacgtgggtcgaccgactaaattagtgcaacgagggtaggtttcgggggactaggggtctagtcgagtcggaccgggacgaccgtccacgtccgaccactaacctacagtacggtaactcgacctagtctagacgtacgttacgacgaccgacggtccgtacttattcgtgtcgcgacgagacgcggcggacgaggtggttcgtacgttacgtcggttcgaggccttcctccccgtacgg

SEQ ID NO: 286537 - DNA, 658 bp, Homo sapiens
  misc_feature: GYAE6OF02HQG74.51.12.B01.1.454.CMB.1.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (315)..(315): a, c, t, g, unknown or other
  misc_feature (315)..(315): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcgagtgaaggtctcctgcaagacctntaggctacaccttcagtggctaacacgtcaactgggtncgccaggcccctaggacgaagggcttaggngtggagtgggattggtttagctagacgaacgtggtcgccgactaaattagtcgacgacgtaagggtacggtttcgggggactagggtacagttcgaacgtacggaccgggacaccgtaccgacgtccgaccgtaacgtaacttaacgaacgtacggaactacggaacctacgttacgtagaaccgttaatttacggaaccgaaccgtaacggtaccgttacttaacgtttacgtaggtacgacgtaacagggaacggaccgggtacggaaccggaggtaacggttaccgtacgtttacggttcgggttaccggtacggtaccgttacccgtaccccgtaacgg

SEQ ID NO: 286538 - DNA, 714 bp, Homo sapiens
  misc_feature: GYAE6OF02HYHME.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtgggctgaggtgaaggagccgggctcgagtgaaggtctctgcaagacctcgtggctacgaccttcgagtggcaacaacgtccacgtgggtcgcgcccgaacggcccccgtggaccgaacgggtcttggacggtggaagtggggtaagttgggtttaagtcgttaggaggtaaaccgtgggtacgccggtactaaaagttagttacgacaacggtaagggaacggttttccgggggacgttacggggttaccagtaccgtaaggttacgggaacccggggaaccgtaccggttaccgtaacgtccggtaccgtaaaccgtaaaccgtttaacgtaacgtacggaaacgtacgaaccgtacggtactacgtacgtaagtttaccggaacgtacccgtacggtaccttacgttaacgttacgtgttacgaccgtaacgaggaacggtaccgggcggaaccgtaggtaacggttccgtacgttacggttcggttacggacggtccttccgtacccccgtacggg

SEQ ID NO: 286539 - DNA, 599 bp, Homo sapiens
  misc_feature: GYAE6OF02IBMAQ.51.12.B01.1.454.CMB.1.raw
  modified_base (355)..(355): a, c, t, g, unknown or other
  misc_feature (355)..(355): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactccccaggtgcaggtggtgcagtctggggctgaggtgaagaagcccggggcctcagtgaaggtctcctgcaagacctcgtggctacaccttcagtggcaacacgtccatgggtgcgccaggcccctggacaagggcttggagtggatgggattggttagtctgagaactggtgccgataaattangacagaggtaggtttcgggcagggtcagtcgagtggaccgggtacaccggtccatcgaccaactaaacttacagtaggaactcgaccgtagtctagactagtttcgaacgtaccgaccggtccgtagttaacttacgtgttacgacgacgtaaggaacggtcggacgggaaccgtacgggtaacgggtttccgtaccgtttacggttcgggttaccggaggtcccttacccgtcccccgtaagg

SEQ ID NO: 286540 - DNA, 582 bp, Homo sapiens
  misc_feature: GYAE6OF02GRL3N.51.12.B01.1.454.CMB.1.raw
  modified_base (286)..(286): a, c, t, g, unknown or other
  misc_feature (286)..(286): n is a, c, g, or t
  modified_base (504)..(504): a, c, t, g, unknown or other
  misc_feature (504)..(504): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggacaacaacgtccacgtgggtncgccaggcccctggacaagggcttggagtggagtgggattggtttagtctaggagtaacgtgggtcgccggactaaattgtgcaacgagggtaggtttcggggactaggggtcagtcgagtcggaccgggacacgtcatccgcaactaacttacagtcgaactcgacctagtctagactagttcgacgacacggccttactacttcgtgtcgacgtanaggacggccgggacggaactacgggtacggttaccgtacgttacgtgggtttcgacggttcctcccgtaccccgtagg

SEQ ID NO: 286541 - DNA, 551 bp, Homo sapiens
  misc_feature: GYAE6OF02IHKA7.51.12.B01.1.454.CMB.1.raw
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagcctcgtggctacaccttcagtggcaacaacgtccactgggtgcgccaggcccctggacaagggcttgagtggatgggatggtttagtctgagaactggtgccgacaaattangcacgaggtaggtttcggggcagggtcagtcgatcggacgggacacgtccatcgaccacaacttacataggaactcgaccagtctgactatttgacgacgaccggtccgtactattacgtgtcgacgacgagaacggcggacggacaggacggttcgacgtttacgtcggtttcgacggtctcccgtcccctaacgg

SEQ ID NO: 286542 - DNA, 633 bp, Homo sapiens
  misc_feature: GYAE6OF02HCCCW.51.12.B01.1.454.CMB.1.raw
  modified_base (371)..(371): a, c, t, g, unknown or other
  misc_feature (371)..(371): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaagcccggggcctcagtgaaggtctcctgcaagacctctggctacaccttcagtggcaacaacgtccagtggtcgcgccacggcccctggacgaagggtcttggagtggagtgggattggtttagtcgtggaagtaacgtgggtcgaccgactaaaagttncgacacgtagggtacggtttccggggagtagggtcagtcgagtcgggacccggggacacgtccacgtccgaccaactaacttacgagtacggtaactcgaacctgtctacgacttagttcgaacgtacgaccggtccttacgttacttacgtgtacgacgtaacgaggtacggacgggaccgggaactacgggtacggtttaccgtacgtttaacggttcgggtttaccggacggtccccttacccgtacccccgtaacggg

SEQ ID NO: 286543 - DNA, 758 bp, Homo sapiens
  misc_feature: GYAE6OF02ISDXQ.51.12.B01.1.454.CMB.1.raw
  modified_base (244)..(244): a, c, t, g, unknown or other
  misc_feature (244)..(244): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccgggcctcagtgaaggtctcctgcaagacctntggctacaccttcagtggcaacaacgtccactggtgccgccacggcccctgggacaaggggtcttggacggtggagtggggattgggttttagtcgtgagtaacgtggtcgccgataaaattacgtgacctacgtaaggtaagggttttcggggacgtaggggtcaacgttcgacgttacgggacccgggggaactaaccggtccgaacgtcccggtaccgaaaccgtaaaccgtttaccgaaacgttacgggaaacctacggtaaccccgtaaggttaccgttaacggtaaccttaagttttaccgggaaaccgtaaccgaacccggggtccccgtttaacgtttaaaccgtttttaacccggtaggtttcccggaaccgtaacccggtaagggtaaaccgggtccggggtaccggaaaccggtaacgggttaccgggttacccggttaacgttttaccggttacggggttttccggaccggttacccttacccccggttccccctaacgggg

SEQ ID NO: 286544 - DNA, 691 bp, Homo sapiens
  misc_feature: GYAE6OF02H7AJS.51.12.B01.1.454.CMB.1.raw
  modified_base (245)..(245): a, c, t, g, unknown or other
  misc_feature (245)..(245): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtacagtctggggctgaggtgaagaagcccgggctcgagtgaaggtctcctgcaagcctntggctacaccttcagtggacaacaacgtccacgtgggtcgccgccgacggcccctggaacaagggtcttaggaggttggagtggggtattgggtttagcgtaggagtaacgtgggtcgccgtataaaagtttgtcgacaacgtagggtaggtttccggggactaggggtccagtcgagtcggaccgggacgtaccgtaccgacgtccgacctaactaacttacacgtacggaaccgtgaaccgtagtacgtagtacgtagtttacggaaccggtaacgaccgggtacccgttacgttaacgtttacgttacggtacgaaccgtaacgaacggtaacggccgggaaccgggtaacggtaacggttacggttcccggttaccgtttaccggttcgggttaccggtaaccggttccccgtacccgttaccccccggtagttaacccggg

SEQ ID NO: 286545 - DNA, 591 bp, Homo sapiens
  misc_feature: GYAE6OF02GY12Y.51.12.B01.1.454.CMB.1.raw
  modified_base (280)..(280): a, c, t, g, unknown or other
  misc_feature (280)..(280): n is a, c, g, or t
  modified_base (523)..(523): a, c, t, g, unknown or other
  misc_feature (523)..(523): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccgggcctcagtgaaggtctctgcaagacctctggctacaccttcagtgacaacaacgtccactgggtncgccacggcccctggacaagggcttcgaggtggatggggattggtttagtcgtgaggtaagtggtacgccgactaaagttgtagacacgacgggtacggtttcgggggacgtaggggtacatacgagtcgggacccggggacacggtaccacgtccgaccaacgtaacttacagtacggaactcgactacgtctagactagtttgaaccgacgacggccgtacgtacttacgtgtacgacganacggaagccggacggacgtaggacgttcgtacgttacgtcggttcgacggtcgtaccctcccgtacgg

SEQ ID NO: 286546 - DNA, 537 bp, Homo sapiens
  misc_feature: GYAE6OF02FI0GT.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccatgggtgcgccaggcccctggacaagggcttgagtggatgggatggtttagtctgagaactgggtgccgcaaattatgcacgagggaggtttcggggcagggtcatcatggaccgggacacgtccagtcgccactaactacactggaactcgacagtctgactatttcgacgacacggccgtacttattactgtgacgacagaacgcggcggacgaggtaggttacgtcgttacgtcggttcggacggctccgtcccctacgg

SEQ ID NO: 286547 - DNA, 555 bp, Homo sapiens
  misc_feature: GYAE6OF02IPE4P.51.12.B01.1.454.CMB.1.raw
  modified_base (245)..(245): a, c, t, g, unknown or other
  misc_feature (245)..(245): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagcctntggctacaccttcagtggcaacaacgtccactgggtgcgccaggcccctggacaagggcttggagtggatgggatggtttagtctgagactggtgccgcaaattatgcacaggtaggtttcggggctagggtcatcagtgaccggggacacgtccatcgccacaaccttacacgtaggaactcgaccagtctagactatttagaccgacacggtccgtcttattacctgtcgcgacagaaggccgggcggacgaggtacggttcgtacgttacgttcgggttcgtacgggccttaccgtcccccgtacgg

SEQ ID NO: 286548 - DNA, 609 bp, Homo sapiens
  misc_feature: GYAE6OF02JEM3F.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccggggctcagtgaaggtctcctgcaagacctgtggctacaccttcagtggcaacaacgtccacgtgggtcgcgcccgaggcccccgtaggacgaaggggtcttggaggtggagtggggaattgggtttagtcgtagaggaacgtggtacgccgtactaaaattgtgacacgagggttaggtttcgggacgtagggtcatcgtagtcggaccggggacacggtccacgtccgaccactaacttacgagtacggaactacgtaaccgagttctagactagttagaccgtacgacggtccgtacttacttacgtgtacgacgacaggtaacgcgggacgtaacgaggtacggttacgtacgttacgtcggttaccgaggtcccgttccgtacccgtacgg

SEQ ID NO: 286549 - DNA, 544 bp, Homo sapiens
  misc_feature: GYAE6OF02GM7OC.51.12.B01.1.454.CMB.1.raw
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacnccttcagtggcaacaacgtccactgggtncgccaggcccctggacaaggcttgagtggatgggatggttagtctgagaactggtgccgacaaagttctgcacgaggacgtttcggggctagggtcatcagtcgaccgggacacgtccgatcgaccacaactacatggaactgaccagtctgacagtttgacgacgacggccgtactacttactgtcgcgacgagaaggcggcggaacgaggtaaggttcgacgtttacggtggtcggtacggcgttccgccccgtaacgg

SEQ ID NO: 286550 - DNA, 571 bp, Homo sapiens
  misc_feature: GYAE6OF02HK02B.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgaggtctctgcagacctctggctacaccttcagtggcaacaacgtccactgggtgcgccaggcccctggacaagggcttgagtggatgggatggtttagtcgtgagaacgtggtgccgacaaattatgacaacgaggtagtttcgggggcaggggtcagtcagtgaccggggacacgtccagtccgccaactaacttacatcggaactgaccagtctagactagtttcgacgtacgacggtccgttactagttactgttacgcgtacgacgaaggcgggaccggacgacggtacgggttccgacgtttacggtcggttaccggacggtccgttcccgtcccgtaacgg

SEQ ID NO: 286551 - DNA, 737 bp, Homo sapiens
  misc_feature: GYAE6OF02FSCOF.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaagcccggggcctcagtgaaggtctcctgcaagacctctggctacaccttcagtggcaacaacgtccacgtgggtgccgccacggcccctgggaccaaggggccttggaggtggagtggggattgggttttagtcgttaggagtaacgtgggtgaccgactaaaatttgtcgacaacgtaagggtacgggttttcgggggacgtacggggttacagttacgagttacgggaacccggggtaccgaaccggtcccgtaacgtcccgacccaaaccgtaaccgttaacgaggttaacggtaactacggaacctacggttccgtacggtaaccttagttttacggaaccgtaaccgtaccgggtacccgttacctttaacgtttaaccgtggttacgaccggtaacgtaacgggaaacgggacccggggtaccgggaaccgtaaggggtaaccgggtttcggttaaccgttttaccggttcggggtttaaccggaccgggttcccgtttaccccgtacccccgtaacggg

SEQ ID NO: 286552 - DNA, 662 bp, Homo sapiens
  misc_feature: GYAE6OF02F08HG.51.12.B01.1.454.CMB.1.raw
  modified_base (389)..(389): a, c, t, g, unknown or other
  misc_feature (389)..(389): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtagaaggaagccccggggcctcgagtggaaggtcctccgtgcaagaccctcgtcggctaccaccttcaggtcggcaaacaacgtccacgtgggtgccgccgacggccccgtaggacgaagggtcttggaggtggagtgggagttggtttacgtcgtaggagtaacgtggtgaccgataaattntacgcagtaggtacggttcggggcgtagggtctatacgagtacggaccgggctaccgtcctatccgaccaactaacttacagtacgaactcgacctagtcctgtaactgtttcgaaccgaccgtaccggtccgtacttacgtttacgcggttaccgacgtaccgaggtaccggtaccgggccggaacggtacggggttaccggtttccggtaccgttttaccgggttcggggttacccggtaccggtccccgttcccgtacccccggttaagg

SEQ ID NO: 286553 - DNA, 540 bp, Homo sapiens
  misc_feature: GYAE6OF02IUY6Y.51.12.B01.1.454.CMB.1.raw
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctntggctacaccttcagtggcaacaacgtccatgggtgcgccaggcccctggacaagggcttgagtggatgggatggttagtctgagaactggngccganaattntgctacgaggtaggtttcggggcagggtcagtcagtgacggggacacgccatcgccacaacttacactaggaactgaccgagtcgtacgacgtagttgaacgacgtacggccgtactattactgtcgcgactagaagtcggcggacaggacgttcgacgttacgtggtacgacggtctaccgtccctacgg

SEQ ID NO: 286554 - DNA, 763 bp, Homo sapiens
  misc_feature: GYAE6OF02G781F.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaacgcccgggcctcagtgaaggtctcctgcaagacctcgtggcctacaccttcgagtggacaacaacgtccacgtgggtgccgccacggccccgtgggacaacgggcttggaagtggagtgggagttggtttagtcgtaggacgtaacgtgggtcgccgtactaaattgtacgctaacgaggggtacggtttccgggggactaggggtacctaagtcgaacggtacgggaacccggggtaaccgtaccggtacccgtaacggttcccggaccctaaaccgtaaacgtttaaccgaacgttaaccgggtaaaccgttacggtaacccgtaacggttaccgtaacggtaaaccgttaacggttttaaccggaaccgggttacccgtaaccgggttaccccgtttacgtttaaacgtttacccggtggttaccggtaaccggtaaccgacggtaaccgggtaccgggaaccgggaaccggtaagggtacggtttacccggtacgtttacggttcgggttaccggtaccgggtcccttacccgacccccggttacggg

SEQ ID NO: 286555 - DNA, 797 bp, Homo sapiens
  misc_feature: GYAE6OF02I65DM.51.12.B01.1.454.CMB.1.raw
tcagcgatcgtatacacgaccggtgctcgatttagtagtgtagattccgcgggggagcatcacccagcaaccacatctgtcctctagagaaccccctgaggacgccccgctcctcaccagtggacgtggaccgtggaggtactccttctttcgttggtggcagcacgccaacgaagacgcccacctcccgaggtcgcgagggtggtgacgaggtcgtggggctaggaggtaggaaacggaacggcccggggcctcgaggtaggaacggtcctccgtagacgaacgaccctcgtggtacctacctaccttcgtaggtcggtaccaaacgtaaccgtacctacggtggggtcgccgaccgaccggtccccgtacggacgacgggtcgtggacgtggagtgggtagttggtttagtcgtaggaacgtacgttggtaccggaccgtaacttaaagttacgtcgacgtaaacgggtacggggttacgggtttcggggacggtaacggggtactacgtacgacggtttacgggggaaccccgggtaccgtaacccgttccgtaaccggaccccgtaacccgtaaaacgttaaacccgtttaacgaacggttaccgggtaaactacccggaacgtacgtcgttaaccgtaacgtttagttaccgaccgtaaccggtaccgttaccgttattaaccgttagtcggtacgaccgtaacgaggaacggtccggacggtaacgagggttaccgtttccgagttttacggtgggttaccgaaccggtccgtaccccttaccggtaacgg

SEQ ID NO: 286556 - DNA, 582 bp, Homo sapiens
  misc_feature: GYAE6OF02G8O4V.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgaggtggatgggatggtttagctgagactggtcgcgacaaattagtgacacgaggtaggtttcggggctaggggtcagtcagtcggaccgggacacgtccatccgccacaacttacagtcggaactgacctagtctacgactagtttcgacgtacgacggccgttacttacttacgtggttacgacgtaacgaggaacggccgggcggaacgtaggtcggttacgtcgttacgttcggggttacgtacgggtcccttacccgtccccgtaacgg

SEQ ID NO: 286557 - DNA, 572 bp, Homo sapiens
  misc_feature: GYAE6OF02IR8AE.51.12.B01.1.454.CMB.1.raw
  modified_base (247)..(247): a, c, t, g, unknown or other
  misc_feature (247)..(247): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctcctgcaagacctcnggctacaccttcagtggcaacaacgtccactgggtgcgccaggcccctggacaagggcttgagtggatgggatggtttagtctgagacgtggtgccganaaattntgcagaggagtttcggggctagggtcagtcagtcggaaccgggactacgtcctacgtcgaccaacaacgttaccaagtacgggaactcgaaccctagtctacgtactagttcgaccgacgacggtccgttacgtattactggtacgcgaacgagaaggcggacggaacaggtacggtcgtcgttacgtcggttacgacggtcttacccgtccccgtaagg

SEQ ID NO: 286558 - DNA, 650 bp, Homo sapiens
  misc_feature: GYAE6OF02JE4BV.51.12.B01.1.454.CMB.1.raw
  modified_base (287)..(287): a, c, t, g, unknown or other
  misc_feature (287)..(287): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctgggctgaggtgaagaagcccggggcctcagtgaaggtctcctgcaagacctctggctacaccttcagtcggcaaacgacgtccacgtgggtcncgccacggcccctggacaagggcttgagtggagtgggattggtttacgtcgttagacgtaaccgtgggtcgacccgtataaaacgttagtcgacgacgtaagggttacgggtttacggggacgtaacgggtcagtcgtagtcgggaaccgggtactacggtacccacgtccgaccaacgttaaccttacgacgtacggtaactcgaacctagtccgtagacttagtttacgacgttaccgaccggttccgtacttaacgtttcgtacggtcgacgtacgtacgacggccggtaccggaagtaggtacggttccgtacgttacggttcggttaccgtaggtacccttaccccgacccctaacgg

SEQ ID NO: 286559 - DNA, 789 bp, Homo sapiens
  misc_feature: GYAE6OF02J09KO.51.12.B01.1.454.CMB.1.raw
  modified_base (261)..(261): a, c, t, g, unknown or other
  misc_feature (261)..(261): n is a, c, g, or t
  modified_base (266)..(266): a, c, t, g, unknown or other
  misc_feature (266)..(266): n is a, c, g, or t
  modified_base (415)..(415): a, c, t, g, unknown or other
  misc_feature (415)..(415): n is a, c, g, or t
  modified_base (454)..(454): a, c, t, g, unknown or other
  misc_feature (454)..(454): n is a, c, g, or t
tcagcgatcgtatacacgaccggtgctcgatttagtagtgtagattccgcggggagcatcacccagcaaccacatctgtcctctagacgaacccctgacgacgccccgctccctcaccatcggactggacctggagactcctcttctggtgcagcagaccagaagtcgccccacgtcccaggtgcgaggtgtcgaccgtaggtccgtggggcctggagggtacgaaggaccgggcccggtctagtaggtacgaacgttccncggtnacgaacgtcctgtccgactaccacctatacggtcggaccaacgtaaccgtccgtacggttcgggtcgcccggacctttaacgggaccccccgttggaagtaacgggtcctaggtaagggtgtagggtagggtacgttggttagttacgnggtaacgaccgttggacgtccgtaacgtaagtttaaccncggacgtaccgggtaaggttcggggttacgcggacgtcgtatacgagtaccggaccggaccgtccgttaccgacgttaccgaccgaacgtttaaccgacgtacggtaccgtaacgtaccgtaccgggaacttccggtactaacgttaccggttaacgaaccccggtaccggttacccgttacccgttaaccgggtttaattccggttaacggccggttaaccggacccgtaggtaaccgggtccgggtacccggtacggttaccggtacggtttaccggttacccgttaagggtcccgttccgggaaccgtttcccgaccccggtttcgaaccgg

SEQ ID NO: 286560 - DNA, 725 bp, Homo sapiens
  misc_feature: GYAE6OF02ITVPO.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagacgcccgggcctcgagtgaaggtctccgtgacaagcctcgtggctacctaccttcgaggtggaccaaacaaccgtccacggtgggtcgccgccgacgggtccccgtagggaccgaaggggtccttagggaggtgggagtggggtattgggtttagtcgtaggacgtaacggtgggtaccgccgtaaattaaacgtttgacggacaacggtagggttacggggtttcggggacgtacggggtactagtacggtacggtacgggaacccggggtactaaccggtaccacgtccgaacctacgtaaaccttacgaggttacggaacgtacgaccgtagtcgtacgtacgttagttacgaaccgtacgtaccggtaccgttacttacgttacgtcggtaacgaccgaagacgggaaccggtacgggaacgggtaacggtacgggttaaccggttccgttaccggtttaccgggttcgggttaccggtaccggtccccgttaccccgtaccccgtaaggg

SEQ ID NO: 286561 - DNA, 766 bp, Homo sapiens
  misc_feature: GYAE6OF02J0F3U.51.12.B01.1.454.CMB.1.raw
  modified_base (252)..(252): a, c, t, g, unknown or other
  misc_feature (252)..(252): n is a, c, g, or t
  modified_base (287)..(287): a, c, t, g, unknown or other
  misc_feature (287)..(287): n is a, c, g, or t
tcagcgatcgtatacacgaccggtgctcgatttagtagtgtagattccgcgggggagcgatcacccagcaaccacatctgtcctctagagaacccctgagagccccgctcctcaccatggactggacctggaggatcctctttcttggtggcagcagccacaagagcccactccccaggtgcaggtggtgcagtctggggctgaggtgaagacggcccgggcctcgagtgaaggtcctcctgccaagacctntggctacaccttcagtggcaacaacgtcactggtncgccaggcccctggaccaagggctggagtggatgggattaggttagtcttggacgaacgttgggtgccgacgtaaattagtcgacacgtagggagttttacggggcgtacggggttacgacgttccgtaagtcggacccggggtaacgtaacccggttacccgacgtacccggtacccgaaaccgttaaaccgtttaaccgaacgttacgggtaaaccctttacgggaaacccgtaggttaccctttaggaaaccgttaacgtttttccggaaccggaccgttaaccggggacccgtttcgttaaaccgtttaccgttaacggttcgggtaacccgttaacggacggtaaacgggttacccggggacggggaaacctaacgggtaacgggttacccgggttaccgtttttaaaccgggttcgggtttaaaccggtaccggggtacccgtttaccccggtaccccccggtttaaaccggg

SEQ ID NO: 286562 - DNA, 583 bp, Homo sapiens
  misc_feature: GYAE6OF02FWQ8A.51.12.B01.1.454.CMB.1.raw
  modified_base (364)..(364): a, c, t, g, unknown or other
  misc_feature (364)..(364): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccacgtgggtgccgccacggcccctggacgagggcttggagtggatggggattgggtttagtcgtggagaacgtggtcgccgataaattntgacacgagggtagtttcggggctagggtcagtcagtcggaccgggacaccgtcagtccgccactaacctacagtagaacgtgaccgagttcctgaactagtttacgaaccgacgaccggtccgtacttacgttactggtacgcgacagaacggcgggacggacgaggtacggttcgacgtttacgtcgggttacgacggtcctcccgtaccccgtagg

SEQ ID NO: 286563 - DNA, 688 bp, Homo sapiens
  misc_feature: GYAE6OF02F5GIA.51.12.B01.1.454.CMB.1.raw
  modified_base (245)..(245): a, c, t, g, unknown or other
  misc_feature (245)..(245): n is a, c, g, or t
  modified_base (372)..(372): a, c, t, g, unknown or other
  misc_feature (372)..(372): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctctgcaagacctntggctacaccttcagtcggacaacaaccgtccacgtgggtgcgccacggcccctgggacgaagggcttggaggtggagtgggattgggtttagtcgttggacgtaacgtggtcgccggataaattgngacacgtagggtcgtttcggggacgtagggtcagtcgagtcggaaccgggacacggtccacgtccgaccaactaacgtttacagtacggtaactacggaccgtaagttccgtacgtacgttaacgtttcggaacccggtacggtaacccgggtccgttaccgttacgtttaaccgtcggttacggaccggtaacgaggaaccgggtaccggggaccgggtaacggtaacgggttaaccgggtttccggtaaccggttttaaccgggttcgggttaccgggtaacggtccccgtttaccccgttcccccgtaacggg

SEQ ID NO: 286564 - DNA, 690 bp, Homo sapiens
  misc_feature: GYAE6OF02GYBU4.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaaggcccgggcctcagtgaaggtctcctgcaagacctctggctacaccttcagtggacaacgaacgtccacgtgggtgccgaccgacggccccctagggaccgaacgggcttggaggtggagtggggtagttgggtttagtcgtaggaacggtacgtgggttacggccgtaactaaaagttagtcgacgtaacggtaggggttacggtttacgggggcgtaaggggttacctagttacgtaacggtacgggaacccggggtaaccgaaccggtaccgacgtccgaccgaacgtaaccttacgtacgtacgtaacgtacgaccgtacgtcctgtaactacgttacgaaccaccggggggggtacctccgtacgttacgttacgttagtcgacgacgacggaacggacggcggaacgtacggtacggttacggtaccgttacggttcggttacggtccggtaccgtcccgtaccccgtacgg

SEQ ID NO: 286565 - DNA, 651 bp, Homo sapiens
  misc_feature: GYAE6OF02IQHKG.51.12.B01.1.454.CMB.1.raw
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (377)..(377): a, c, t, g, unknown or other
  misc_feature (377)..(377): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaagcccggggctcgagtgaaggtctcctgcaagacctntggctacaccttnagtggcaacaacgtccacgtgggtgcgccacggcccctggacaacgggcttggacggtaggagtaggggtatgggtttacgtcgtgaagtaacgtggtacgccgtactaaaatttnagcaacgtagggtacggtttccggggctaggggtactaagtcgagtaggaccggggacgacgtccgacgtaccgacctaacgtaactaacgtagtacggaacgtacgactacggtactagactacgtttacgacgtaccgaccggtccgttacgttaactttacgtaggtacgtacgacgtacggaaggaccgggacgggtaacgacggtaacggttacggtaccgttacggttcgggttaccggtacggtaccgttcccgtaccccgtaacgg

SEQ ID NO: 286566 - DNA, 169 bp, Homo sapiens
  misc_feature: GYAE6OF02FWGCR.51.12.B01.1.454.CMB.1.raw
  modified_base (157)..(169): a, c, t, g, unknown or other
  misc_feature (157)..(169): n is a, c, g, or t
tcagcgatcgtatacacgaccggtgctcgatttagtagtgtagattccgcgggcacgaccggtgctcgatttagagtgctacgaagggaaagggcagcgtcactctgttcccaccctcctctcgtagcactctgagcgggctggcaaggcgcatagnnnnnnnnnnnnn

SEQ ID NO: 286567 - DNA, 654 bp, Homo sapiens
  misc_feature: GYAE6OF02IGWZS.51.12.B01.1.454.CMB.1.raw
  modified_base (252)..(252): a, c, t, g, unknown or other
  misc_feature (252)..(252): n is a, c, g, or t
  modified_base (342)..(342): a, c, t, g, unknown or other
  misc_feature (342)..(342): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (499)..(499): a, c, t, g, unknown or other
  misc_feature (499)..(499): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagacgcccactcccgaggtgcgaggtggtgcagtcgtggggctggaggtgaaggagcccggggctcgagtgaaggtctccgtgcaagacctntggctaccacttcgagtggacaacgaccgtcacgtgggcgccgtcgacggcccctaggacaggcttgaggtgagtgggtacttggtttancgtaggagaacgtggtacgccgtaanaaatttgngacgtaacggagggttacgggttcgggacgtaagggttcacgttcgaacgcggtaaccgggacgtaccgtcgacgtacccgactaacgtaacgtactagaacggtaactccggaactcgtacncgattagttcggaacgacgtaccggtccgtaccttagttacgtgtacgacgtaacgacgtaacggccgggacgtaacgtacgggtaacgggttaccgtacggttttaccggttcggttaccggacggtacccttaccccgggtaccccgtaaggg

SEQ ID NO: 286568 - DNA, 698 bp, Homo sapiens
  misc_feature: GYAE6OF02J0YMO.51.12.B01.1.454.CMB.1.raw
  modified_base (245)..(245): a, c, t, g, unknown or other
  misc_feature (245)..(245): n is a, c, g, or t
  modified_base (278)..(278): a, c, t, g, unknown or other
  misc_feature (278)..(278): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtgggctgaggtgaagagccggggctcgagtgagtctcctgcaagacctcgngcacaccttcagtgcaacacgtccacgtggtcncggccacggccccgtaggacgaacgggcttggaggtcgggtagtggggtattcgggtttaacgtccgtaggaacggtaacgttcggggtcgtaccggaacgttaaaatttacgtagacgaacggtacgggttacggggtttcggggacgtaacgggggttcaagttaccgtaggtacgggtaacccgggaccgtaccggttacccgaagtccccggacctaaaccgttaaaccgttaacgtacgtacgggtaaccgtacgacccgttaacgtccgtagtaaccgtttacttacggaaccgttacggaaccgtccggttacttactttacgtcgtagacgtacaggaacggccggacggaacagggtacggtttcgacgtttaccggttacggttacggccgtccttcccgtaccgtaacg

SEQ ID NO: 286569 - DNA, 680 bp, Homo sapiens
  misc_feature: GYAE6OF02F0UAN.51.12.B01.1.454.CMB.1.raw
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (354)..(354): a, c, t, g, unknown or other
  misc_feature (354)..(354): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaaggaagcccggggcctcagtgaaggtctcctgcaagacctcgtgctacacctcagtggcaacacgtccactggtncgcncggcccnggacagggctgngtggagtgggattggtttagtctgagaacgtggtcgccgataaattgngcgaacgagggtacggtttcggggacgtaggggtactacgtcgaaggtcggggacccggggtaccacggttacccgagttccggacccaacttaaaccttacgaagttacggtaaaccgtcgaaccgtagttctagtaaccgttagtttacggaccggtaaccgtacccgggtccgttacgtttaacgttaccgttggtacgtaccggaaccgtaacgggaacggccgggaaccgggtaaccgaacgggttacggttacccggttaaccgtttacggttcggggttaccggtaccgggtcccttaccccggttacccccgtaacgg

SEQ ID NO: 286570 - DNA, 637 bp, Homo sapiens
  misc_feature: GYAE6OF02HU0X1.51.12.B01.1.454.CMB.1.raw
  modified_base (390)..(390): a, c, t, g, unknown or other
  misc_feature (390)..(390): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagccggggctcagtgaaggtctcctgcaagacctctggctacaccttcagtggacaacaacgtccacgtgggtgcgccacggcccctgggacaaggggcttggagtggagtgggacttgggtttagtctggagtacgtggtgccgtactaaagttatgacaacgagggtaggtttcggggntaacggggtccagtcagtcggaccgggacgtaccgtaccagtccgaccgaactaacttacgagtacggaactacgacctacgtcgtcgtactacgtttacgaacgaccgtacggtccgttaccgttattacgtacgtcggtaccgagacggtaacggaccgggacgggaacgtacgggtaacggttacggtacgtttaaccggtcgggttaccggtaaccgggtcccgttcccgtaccccgtaacgg

SEQ ID NO: 286571 - DNA, 566 bp, Homo sapiens
  misc_feature: GYAE6OF02F3CXN.51.12.B01.1.454.CMB.1.raw
  modified_base (355)..(355): a, c, t, g, unknown or other
  misc_feature (355)..(355): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggcctacaccttcagtggcaacaacgtccactgggtgcgccaggcccctggacaagggcttgagtggatgggatggttagtctgtagaactggtgccgactaaattntgcacgaggtagtttcggggactagggtcagtcagtcggaccgggacacgtccgacgtacgccactaacttacagtacggaactgaccagtctgactagttcgacgacgtacggtccgtacgttattacgtgtcgacgaacgagaggacggacggacgaggtacggttcgtacgttacgtacggttccgaggtcctccgtaccccgtacgg

SEQ ID NO: 286572 - DNA, 658 bp, Homo sapiens
  misc_feature: GYAE6OF02JIG3N.51.12.B01.1.454.CMB.1.raw
  modified_base (234)..(234): a, c, t, g, unknown or other
  misc_feature (234)..(234): n is a, c, g, or t
  modified_base (387)..(387): a, c, t, g, unknown or other
  misc_feature (387)..(387): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagacgcccggggctcagtgaagtctcngcaagccctgtggctacacctcagtggcaacgaacgtccacgtgggtcgcgccgtacggccccgtagggaccgaacggggtccttaggacggtgggagtggggtagttgggtttagtcgtagaggtaacgtgggtacgccggactaaacttgngtacacgagggtaggttcggggacgtagggtacagtacgagtacggaccgggacgacgtaccgcgtccggtaccaccgtaaacttaccgacgttacggaactacggaccgtagtaccgtagacgttagttacggaccgaaccggacggtcccgtacgttaactttaccgtgtacgacgtaaccgtaggaacggccggtaacggacgtacggtacggttccggtacttacgggttcggttacgtacgggtccttacccggtaccccgtacgg

SEQ ID NO: 286573 - DNA, 615 bp, Homo sapiens
  misc_feature: GYAE6OF02G98Q2.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttggagtggagtgggatggtttagtcgtgagtaacgtggtcgccgactaaattagtgacgacgtagggtaggttttaccggggacgtaggggttcagtcgagtacggaccggggtacacggtaccacgtccgccaactaactaccgagtacggtaacgtacgacctagttacgtacgactacgtttcgaccgtacgaccggtccgtcttacgtttacgtcgtcgacgacgaggaacggccgggcggaccgaggtacggttccgtacgttacgttcgggttaccggtacggtcctcccgtccccgtacgg

SEQ ID NO: 286574 - DNA, 784 bp, Homo sapiens
  misc_feature: GYAE6OF02JJYM8.51.12.B01.1.454.CMB.1.raw
tcagcgatcgtatacacgaccggtgctcgatttagtagtgtagattccgcgggggaggcatcacccagcaaccacatctgtcctctagacgaacccctgagacgccccgcctcctccaccatggactggacctggaggatcctcttcttggtggcagcagccaacaagacgcccacctcccaggtcgcgtaggtggtgcaggtcgtggggctggagggtagaagaacggcccggggcctagacggtagaacgggtcctaccgtgaccaacgaccctcgtcggacctacctacccttacgaggtcggaccaaaccgtaaccggtcctacggtaggggtcgccgacccgacgggtcccccgtagggaaccgaaggggtccttagggacgtgggagtcgggagtttggtttaacgtcgtaggagaaccggttgggccgacccggtaacttaaagtttacgtacgtacgaaaccggtaggggttacggggttttacggggaccggtaaggggtccctaagtcaacgggtcgggtaacccgggggaccaccgggttacccgacgttaccgacccgtaaactaaaccgttacgaaggttacgaaccgtacgaaccgtgttaccgtagtacttacggtacgaaccgaccgtaccggtaccgttacgttacgttaacgtcgtacggacgtaccggaggtaacgggtcgggaccggtaacgacggtaccggttaccgtacggtttaccggttacgggtacggttacggtacccgttcccgtaccccgtaacgg

SEQ ID NO: 286575 - DNA, 742 bp, Homo sapiens
  misc_feature: GYAE6OF02JVVJR.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccacgtcccgggtgaccgtaggtggtacgcagttcgtggggctaggaggtgaaaggacggcccgggctcagtgaacggtctccgtgacaagccttcgtggacctacctccttacgagtcggaccaaaccgtaaccgtccacggttgggcgccgccgacgccccgtaggaacgacggtcttggaggtcggagtggtagttggttacgtcgtaggagtacgtggtccgacgtaactaaatttcgacgcgaacggtacgggttacgggttcggggacgtagggtacctacgtacgtacgggtaccgggtaaccggggtacctacccggtaccgtaaccggtacccgaccctaaccgttaaacgttaccgtaaggtaccggtaaccacggtacccgtaacgtcgttaacgtaccttaaggtttaccgaaccgggacccaccgggtttacccttagttaccgttttaacgcggtacggtaccgaacgaacggtacggacgggtacggaacgtggttaccggttacgttacgttcggttccggtacggtacggcccctttccccggaccgtttaggtacgg

SEQ ID NO: 286576 - DNA, 638 bp, Homo sapiens
  misc_feature: GYAE6OF02GN8UA.51.12.B01.1.454.CMB.1.raw
  modified_base (374)..(374): a, c, t, g, unknown or other
  misc_feature (374)..(374): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccacgtgggtagccgccgacggccccctgggaccaaggggtccttggagtggagtggggattgggtttagtcgtggaagtacgtgggtcgccgtataaattntgacacgagggtacggtttcggggctagggtcagtacgagtcggaccgggtacacggtcacgtccgaccaacgtacttacgagtacggtaactcgaccacgtctacgtactagttacgacgtaccgaccggtccgttacttacgttacgtcggtacgtaccgaacgacgggacggtacccgggacggtaaccggtacgggtacggtttaccgtacgttacggttcgggttaccgaccggtcccgttacccgtaccccgtaacgg

SEQ ID NO: 286577 - DNA, 725 bp, Homo sapiens
  misc_feature: GYAE6OF02GUD29.51.12.B01.1.454.CMB.1.raw
  modified_base (285)..(285): a, c, t, g, unknown or other
  misc_feature (285)..(285): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccggggcctcagtgaaggtctcctgcaagacctctggctacaccttcagtggacaacaacgtccacgtgggtncgccaggccccgtggacaagggcttgagtggatggggattggtttatgtagagtaactgggtcgccgtacgtaaattatagacaacgtaaggggtagggttttcggggggactacgggggttacacgtttacgaagttacgggaacccgggggtaacccgtaaccgggtacccgtaacggtcccgacccgaacctaaaccgtttaaccaacgttacggtaaacccgtcggaaccgtaacgtactacggaacttagttttacggaacccggtaaccgtaccgggtcccgttacgttaacgtttaccgttacgtacggtaccgtacgtaacggaacgggtaccggggaccggtaacgaacgggtacgggtttaccggttaccgtttacgggttacgggtttaccgggtaacggtcccgttaccccgttacccccgtaacggg

SEQ ID NO: 286578 - DNA, 648 bp, Homo sapiens
  misc_feature: GYAE6OF02GX8UN.51.12.B01.1.454.CMB.1.raw
  modified_base (579)..(579): a, c, t, g, unknown or other
  misc_feature (579)..(579): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagaacggcccggggcctcgagtgaaggtcctcctgcaagacctgtggcctactaccttcagtcggacaacaaccgtccacgtgggtcgccgccgacggccccgtggacgaagggctggaggtggagtgggtagttggtttagtcgtaggagtaacgtgggtcgaccgactaaattacgtgacgtaacggtagggtacggtttccggggacgtacgggtcgtagtcgaacggtcgggaaccgggaaccgtaccgtccacgtaccgaccaacgtaacgttacgtagtacggtaacctacggaccagttcgtagtacttagttacgaccgtaccgtaccggtccgttacgttacgtttacgtcgtcgacgtanacggacgacgggacgaacgtaggtacgttcgtacgttacgtcggtacgacggtcctcccgtacccgtag

SEQ ID NO: 286579 - DNA, 725 bp, Homo sapiens
  misc_feature: GYAE6OF02GCQDG.51.12.B01.1.454.CMB.1.raw
  modified_base (248)..(248): a, c, t, g, unknown or other
  misc_feature (248)..(248): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctgaggtgaagaagcccggggctcagtgaaggtctcctgcaagacctntggctacaccttcagtgcaacacgtccacgtggtgccgccgacggtccccgtggaccgaaggggtccttaggacggttgggagtgggggtattcgggttttagtcgttaggaaggtaacgttcggggtacgacccggtactaaaagtttcgtacggacctaacggtacggggtacgggttttcgggggactaaggggtccaacgttacgaacggttacgggaacccggggaactaccgggtaccaacgtcccggaccctaaacgtaaaccttaaccgtaacgtacggaaaccgtacgaccgtaacgtccgtacgtaactaacgtttggaaccgaccgaaccgggtacccttacgttaacgttaccgtgttaccgacgtaacgtacggacggacggaaccggaacgtaacgggtacggttacgttaccgtttacggttacgggttaccggacggtaccttaccccggtaccccgtagg

SEQ ID NO: 286580 - DNA, 933 bp, Homo sapiens
  misc_feature: GYAE6OF02JL06R.51.12.B01.1.454.CMB.1.raw
  modified_base (393)..(393): a, c, t, g, unknown or other
  misc_feature (393)..(393): n is a, c, g, or t
tcagcgatcgtatacacgaccggtgctcgatttagtagtgtagattccgcggggagcgatcacccagcaaccacatctgtcctctagagaacccctcgacgagccccgctcctcaccatggactggacctggaggatcctcttcttggtggcagcagccacaagagcccactcccaggtgccaggtgtgcagtctgggctgaggtgaagaagccggggcctcacggtgaaggttcgtccgtgcaagacctcgtggcctacgaccttcagtcggacaacgaacgtccaccgttgggtcgccggccgacggcccctggaccaagggtcgtcggagttcggagtgggacgttggttacgtcgtgtaacgtacggtggtacgtcccgactaaagttntacggacaacggtaacgggttggtttacgggggaccgttaggggtaccgtagtacgtacggtacgggtaacccggggtaccggtaccgggtaccgtacccgtaccggtacccgtaaccgtaaacccgtttaaccgtaaacggttaaccggtaacgttaacccggaacccggttaccgttacgggttacggtaaccgtttacgtttaaccgggttaacccggaaccgggttacccgggtacccggtttaacccgtttaccggtttaaccggtttacgggtttaacccgtaaccggttaaaccggggtaaccggtaaacgggggtaccccggggtacccggggtaaaaccggggttaccggggttaaacccggggggttttaccccggtttaacccggggttttttaaacccccgggggtttttacccgggggggtttttaaacccggggggtttaaaaccccccgggggggtttttccccccggttttaaacccccccggggtttacccccccccccggggtttttaaaaacccggggggg

SEQ ID NO: 286581 - DNA, 687 bp, Homo sapiens
  misc_feature: GYAE6OF02HUXBY.51.12.B01.1.454.CMB.1.raw
  modified_base (298)..(298): a, c, t, g, unknown or other
  misc_feature (298)..(298): n is a, c, g, or t
tcagcgatcgtatacacgaccggtgctcgatttagtagtgtagattccgcgggggagcatcacccagcaaccacatctgtcctctagacgaaccccctgagacgccccgctcctcaccatcggactggacctggagatcctcttcttggtggcagcagccaacaagacgcccactcccgaggtgcgaggtggtgcagtcgtggggctgaggtgaagaacggcccgggcctcgagtggaaggtctccgtgacaagacctcgtggctactaccttcagtgcaaacaacgtccagtgggtncgcgacggccccgtggaacaaggggcttggacggtggagttgggattggttttagtcgtagaagaacgttggtcgaccgactaaaatttcgacgtccgaagtaaggggttggtttaccggggcgtaagggtcaacgtccaagtccggaacgggaccgaccgtaccacgtaccgaccaaacgtaaaccttaacgaacgttacgggtaaactacggtaaccgtaacgtacgttacgaacttagttacgtaacccgacgaaccggtccgttaccttaactttacgtagtcgtacgacgtaggaacggccgggacggaacggtaacggcggtttaccggttacgttaacggttcgggttacggtaaccggtccgttaccgtcccccgtaacgg

SEQ ID NO: 286582 - DNA, 667 bp, Homo sapiens
  misc_feature: GYAE6OF02IQ0IM.51.12.B01.1.454.CMB.1.raw
  modified_base (274)..(274): a, c, t, g, unknown or other
  misc_feature (274)..(274): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccaacaagagcccactcccaggtgcaggtggtgcaggtcgtggggctggaggtgaagaacggcccggggctcgaggtgaaggtcctccgtgacaacgtacctcgtcggctacaccttnagtgactaacaaccgtccagtcgggcgcgcccgacggccctaggacagggctgagtggaagtggagtggttacgtntaggaacgtacgttgggnccggtanaaattgtcacgacgtaggtaggtcgggacgagggttcagtacacgtacgggaccgggacggtacgttaccgacgtaccgaccgtaaccgtaaacgtaaccgtaacggttaaggaacccgttagaaccgtacgttacgttacgacttaacgttacggaccgaaccggtaccggtacccgttcgttaactacgttaggtacggacgtacgtagaacgggacggacggaacgtacggtaacggttcgtacgttacggttcggtacggtacggtcccgtaccgtaccccgtaacgg

SEQ ID NO: 286583 - DNA, 622 bp, Homo sapiens
  misc_feature: GYAE6OF02JP86H.51.12.B01.1.454.CMB.1.raw
  modified_base (152)..(152): a, c, t, g, unknown or other
  misc_feature (152)..(152): n is a, c, g, or t
  modified_base (169)..(169): a, c, t, g, unknown or other
  misc_feature (169)..(169): n is a, c, g, or t
  modified_base (245)..(245): a, c, t, g, unknown or other
  misc_feature (245)..(245): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (312)..(312): a, c, t, g, unknown or other
  misc_feature (312)..(312): n is a, c, g, or t
  modified_base (379)..(379): a, c, t, g, unknown or other
  misc_feature (379)..(379): n is a, c, g, or t
  modified_base (442)..(442): a, c, t, g, unknown or other
  misc_feature (442)..(442): n is a, c, g, or t
  modified_base (468)..(468): a, c, t, g, unknown or other
  misc_feature (468)..(468): n is a, c, g, or t
  modified_base (555)..(555): a, c, t, g, unknown or other
  misc_feature (555)..(555): n is a, c, g, or t
tcagcgatcgtatacacgaccggtgctcgatttagtagtgtagattccgcgggggagcgatcacccagcaaccacatctgtcctctagagaaccccctgagagccccgctccctcaccactggactggacctggaggactcctcttcttggnggcagcagccacaagancccactcccgaggtgcaggtggtgctagtccgtggggctggaggtgaaagacggcccgggctcgagtgaggtctcngcagcctcngctacactcngtgcaacacacncgtcgtgcgccgcgcccgtgacgacggctgagtggngtggagtcgtttagcgtagagaacgttgacgtcgactaaattgacgcacgtggtacggtttacgggngtacggtcagtcacggtacggaccgggaacgtacgtaccacggtacaccgtaacaaccgttanacgtaggactaacgacctagtcgtanacgttagttaccgacgacgtaccggacgttacgttaacgttaccgtaggttccgaacgtacggtacgtaacgggccgggtaaaccgngtaacggtccgggttcgtaaccgttcgttaacggggtcttacgggccttccccgttaacccgtacgg

SEQ ID NO: 286584 - DNA, 663 bp, Homo sapiens
  misc_feature: GYAE6OF02JAWPM.51.12.B01.1.454.CMB.1.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (279)..(279): a, c, t, g, unknown or other
  misc_feature (279)..(279): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggcctcagtgaaggtctctgcaagcctnggctacnccttnagtggcaacacgtccactgggtncgccaggcccctggcaagggcttgagtggagtggggattggtttagtctaggagtaacgtgggtcgaccgactaaagttgtggtacagtagggtacggtttcgggggactaggggtcagttcgagtacgggaacccgggggtaccaaccgtccgtactccggtaccgaactaaaccgttaccgaacgtacgggtaacgttacggtacccgtagtccgttagaaccgttagtttacggaaccgtaccgtaaccggtccgttacttacgtttaacgtacggtacgtacgacgtaaggaacggaccgggaaccggacgaacggtacgggttacgtaccgttacggttcgggttaccggtacggtaccgttcccgtcccccgtaacgg

SEQ ID NO: 286585 - DNA, 588 bp, Homo sapiens
  misc_feature: GYAE6OF02GEV7R.51.12.B01.1.454.CMB.1.raw
  modified_base (190)..(190): a, c, t, g, unknown or other
  misc_feature (190)..(190): n is a, c, g, or t
  modified_base (284)..(284): a, c, t, g, unknown or other
  misc_feature (284)..(284): n is a, c, g, or t
  modified_base (321)..(321): a, c, t, g, unknown or other
  misc_feature (321)..(321): n is a, c, g, or t
  modified_base (369)..(369): a, c, t, g, unknown or other
  misc_feature (369)..(369): n is a, c, g, or t
  modified_base (465)..(465): a, c, t, g, unknown or other
  misc_feature (465)..(465): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagctcactcccaggtgcaggtggtgcngtcgtggggctgaggtgaagacggcccgggctcaggtgaaggtctcctgcaagccctctggcctacaccttcagtggcaacacgtccactgggngcgccgacggcccctggacaagggtcttggaggtggngtgggagttggtttagtcgtgagtaacgttggtgccgactaaattagngacacgagggtggtttcggggacgtagggtcatcgagtacggaccgggacaccggtcacgtccgaccaacgtaactacacgtacggaactcgaccngtactcgtacgttattacgacgtacgacgtccgttataacttcgtgtcgacgagaacggaggcgggacgaacgaggtacggttcgacgtttacggtcggttacgcggttccctcccgtacccg

SEQ ID NO: 286586 - DNA, 680 bp, Homo sapiens
  misc_feature: GYAE6OF02GFUS6.51.12.B01.1.454.CMB.1.raw
  modified_base (596)..(596): a, c, t, g, unknown or other
  misc_feature (596)..(596): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcgagtcgtggggctgaggtgaagaagcccggggctcagtgaaggtctcctgcaagcctcgtggctacaccttcgagtcggacaaaccaacgtccacgtgggtcgccgccacggccccgtaggacgaacgggtcttaggacgtggtagtgggtattgggtttaacgtcgtagaacgaaacgttgggtacgaccgtactaaaacgtttagcgacccaaggtacgggttaacgggtttccggggggacgtacggggtacctaagttcgaaggttcgggaaccggggacctacgtaccacgtaccgaccaaaccgtaaactacgtacgtacggtaacctagaaccgtagtctacggtacttagttacggacgtaaccgacgtccgttactaacgttacagttacgacgtaanacggaacgtccggaacggaacgagggtaggttaccgtacgttacgttacggtacttacgggacggttccctacccgtaaccccg

SEQ ID NO: 286587 - DNA, 667 bp, Homo sapiens
  misc_feature: GYAE6OF02GXHOO.51.12.B01.1.454.CMB.1.raw
  modified_base (222)..(222): a, c, t, g, unknown or other
  misc_feature (222)..(222): n is a, c, g, or t
  modified_base (243)..(243): a, c, t, g, unknown or other
  misc_feature (243)..(243): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (312)..(312): a, c, t, g, unknown or other
  misc_feature (312)..(312): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcngtgaaggtctcctgcagcctngctacncttcngtgcaacacgtcacgtgggtncgccacggccccgtggacaagggtcttggaggtcggngtgggattgggtttagtcgtggagtaacgtgggtcgaccgactaaattcgagtcaacgtagggttacggtttaccgggggctaggggttacagtcaaggtcggaccggggactcggtaccacgtccgaccaactaacgttacgagttacggaactaccgacctagttcgtacgacttacgtttacgacccggaaccgtaccgggtacccgtttacttaacgttacgttcggtaacgtaccgaacggtaggaacgggtccgggaacgggtaaccgtacgggtaacgggtttaccgtaccggtttaccgggttacgggttaccggacggttcccggttccccgtaccccgttacggg

SEQ ID NO: 286588 - DNA, 802 bp, Homo sapiens
  misc_feature: GYAE6OF02JB39T.51.12.B01.1.454.CMB.1.raw
  modified_base (260)..(260): a, c, t, g, unknown or other
  misc_feature (260)..(260): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaaggaagcccggggcctcgagtgaaggtctcctgcaagacctctggcctacnccttcagtggcaacacgtccacgtgggtgccgccacggcccctggacgaagggcttggaggtggagtggggattgggtttagtcgtgagaacgtggtgccgactaaattgtgacacgtagggtaggtttcggggacgtacgggtacacgtacgtacgtacggggacccggggacgtaccggtacccgtaacgtcccggaaccgtaaccgttaaaccttaaccgtaacgttaacgggtaaaccgtaaccgtaaccgtacggttaccgtaacggtaaccgttaacgttttaccgggaaacccgtacccgggtaaccgggttacccggttaaccttttaacgttttaaccgttacgggtttacgggaacccgttaacggtaaacgggaaccggggtacccgggggaaccgggtaaaccggttaaggggttaaaccccggggttttaccggttaacccggtttttaaaccggggttttccgggggtttacccggggttaacccgggttaccccggttaccccccgttaacccccccggtaacgggg

SEQ ID NO: 286589 - DNA, 665 bp, Homo sapiens
  misc_feature: GYAE6OF02HSPCJ.51.12.B01.1.454.CMB.1.raw
  modified_base (343)..(343): a, c, t, g, unknown or other
  misc_feature (343)..(343): n is a, c, g, or t
  modified_base (357)..(357): a, c, t, g, unknown or other
  misc_feature (357)..(357): n is a, c, g, or t
tcagcgatcgtatacacgaccggtgctcgatttagtagtgtagattccgcgggggagcatcacccagcaaccacatctgtcctctagacgaaccccctgagacgccccgctccctcaccatggactggacctggaggactccttctttcgttgggtggcagcacgccaacaagacgcccacctcccgaggtgcgaggtggtgcgagtcgtggggctggaggtagaagacggcccgggctcgagtgacgtctcgtgacacgacctgtggactacgaccttgagtgacaacgtacgtccgagtgggtcgccgccgacgccccgtaggacgaaggtctagagtggngtggattggtttancgtagagtacgtggtcgcgtaataaattgacgacgaagtagggttacggtttcggggactagggctagtcgaggtacggacgggacacgtcacgtcgacactactagagtacgacgttacgactacgtctatacgttacgttacggaaccgtaccggtaccggtacccgttagtttaaccgtttaccgttaggtaccgaaccgtaacggaacggtaccgggaccggtacggacgtagggtaccggtttaccgtacggtttacggttcgggtaccgtaccgggtcccttacccgtaccccggttaaggg

SEQ ID NO: 286590 - DNA, 641 bp, Homo sapiens
  misc_feature: GYAE6OF02F14Y8.51.12.B01.1.454.CMB.1.raw
  modified_base (248)..(248): a, c, t, g, unknown or other
  misc_feature (248)..(248): n is a, c, g, or t
  modified_base (368)..(368): a, c, t, g, unknown or other
  misc_feature (368)..(368): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaacgcccggggcctcagtgaaggtctcctgcaagacctntggctacacctttcagtggacaacaacgtccagtgggtgccgcacgggcccctggacaagggtcttaggagtggagtgggattggtttaagtctagagtacgtggtacgccgataaattntcgacacgtagggtaggtttcggggacagggtcacgttcgagtcgggaaccgggaccgtacgtaccgtagtacccgaccaacctaactaccgagtacggtaacgtacgaccgagtctagtactagtttacggaccgacgtaccggtaccgttacgttacttacgtcgttacgacgtacgaggaacggaccgggtaacggacgtaacggtaacggtttaccgtacgtttacgttacgggttaccggtacggtaccgtcccgtaccccgtaacgg

SEQ ID NO: 286591 - DNA, 625 bp, Homo sapiens
  misc_feature: GYAE6OF02H17R7.51.12.B01.1.454.CMB.1.raw
  modified_base (349)..(349): a, c, t, g, unknown or other
  misc_feature (349)..(349): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtctggggctggaggtgaagaacggcccgggctcgagtgaaggtctcctgcaagtacctctggactacaccttcagtggcaacaacgtccacgtgggtgcgtccgaggccccgtggaacgaaggggcttaggagtggagtgggagttcggttagttcngacgtaactggtcgccgactaaaattagtggacacgtaggtaggtttcgggacgagggtcagtcgagtcggaccgggtacgacgtccacgtccgaccaacaaacttacagttacggaactcgaccacgttctagactattcggaacgtaccgaaccggtccgtaccgtttaattaccgtagtacggccgaacgacggacgaccgggtacggacgaacgggtcggttacgaccgtttacgtcgggttaccgtacgggtcctcccgtccccgtaacgg

SEQ ID NO: 286592 - DNA, 687 bp, Homo sapiens
  misc_feature: GYAE6OF02HQOU2.51.12.B01.1.454.CMB.1.raw
  modified_base (286)..(286): a, c, t, g, unknown or other
  misc_feature (286)..(286): n is a, c, g, or t
  modified_base (374)..(374): a, c, t, g, unknown or other
  misc_feature (374)..(374): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctgaggtgaagagcccgggctcgagtgaaggtctcctgcaagacctctggctacaccttcagtggcaacaaccgtccacgtggtancgccacggcccctggaacagggtcttgagtggagtgggtattgggtttagtcgtaggagtaacgtgggtcgcccgtaataaaagttgngacaacgagggtacggtttcggggacgtaagggtcaacgtcgaacgtacgggaacccggggaccgtaaccggtacccaacgtacccgaccaaaccgtaaccgttaacgacgtaacggtaacctacgaaccgtacgtacgtcgtaacttacgttacggaaccgtaaccgtaccggtaccgttacgttaacgttacgtcgtacgaccggtaacgacggaacgggacgggaaccggtaacggtacggtacggttccgtaaccgtttacggttacgggttaccggaaccgggtcccgttacccgtaccccgtaacgg

SEQ ID NO: 286593 - DNA, 683 bp, Homo sapiens
  misc_feature: GYAE6OF02G9237.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctgaggtgaagaggcccgggcctcgagtgaggtctcctgcaagacctcgtggcctactaccttcagtcggacaaacaccgtccagtgggtcgccggccgacggccccgtaggaacgaacgggtcttggacggtggagtggggtattgggtttagtcgtaggtaacggtaacgttgggtacgacccggtaacttaaaagttgcggaacaacggtaggggttagggtttccggggagtaaggggtctagtcgtaaggtacgggaaccgggactaccgtcacgtacccgacaactaactacgagtacggaactcgaacctacgtcgtacgtacttacgttacgaaccgtaccggtaccggtaccgttacttaacgttcggtacgtcgaacgaacgaggaacggccgggaacacgggtacggtacgggttccgttacggttacggttacgggttaccggaccggtccgtaccccgtacccgtaacgg

SEQ ID NO: 286594 - DNA, 748 bp, Homo sapiens
  misc_feature: GYAE6OF02JR2T8.51.12.B01.1.454.CMB.1.raw
tcagcgatcgtatacacgaccggtgctcgatttagtagtgtagattccgcgggggaaagcatcacccagcaaccacatctgtcctctagagaaccccctgagagcccccgctcctcaccatggactggacctggaggatcctcttcttggtggcagcagccacaagacgcccactcccaggtgcgaggtggtgcagtcgtggggctgaggtgaagacggcccgggctcgagtgaaggtctctgacaagcctcgtggctacgccttcagtcggacaacacgtcacgtgggtcgcgccgtacggcccctaggacgaagggccttaggaggtcggagttcgggtattgggtttagtcgtaggaacgtaacgtggggtacgaccgtaacttaaagtttacgacggacgtaaacggtacgggttacgggttttccggggggacgtaacgggggttctaacgttaccgaacggtaccggggtaacccggggtaacgaaccggtaacccgtagtacccggaaccgaaccgttaaccgttaacgacgtagggtaaccttacgaaccgttacgtcgtacgtaccgttagtttacggaaccggtaccgtaccggttccgttacgttacgtttaacgtcggtaccggaagtaaccgtagggtaaccggccgggaaccggtacggaagggttaccggttaccgtttaccgttcggttacggttaccggaccggtcccgtttaccccgaccccggttaagg

SEQ ID NO: 286595 - DNA, 755 bp, Homo sapiens
  misc_feature: GYAE6OF02ID01M.51.12.B01.1.454.CMB.1.raw
  modified_base (403)..(403): a, c, t, g, unknown or other
  misc_feature (403)..(403): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtctggggctggagggtgaaggaacggcccggggcctcgaggttggaaggtcctcctgacgaacgaccgtctggcctactacccttcaggtggcaacacgtccatgggtgcgccgacggcccctggaccgaacgggtcttggacggtggacgtaggggtagttgggttttagtcgtaggacggtaacgtgggtcgccgtacgaaagtttagngtaccgaacggtaagggttacggggttttccggggacggttaagggtccgaagttacgaacggtacgggtacccgggaacgtaccggttaccgtaacgtaccgtacccgtaacctaaaccgtttacgaacggttacggtaacgtaccgtaaccgaacgttcgtacgttaacgtaacgtttacggtaaccggaaccgaccgggtacccgttacttaaccgttaacggttcgtaaccggacggtaaccgaggtaacgggaccgggaacggtaacccggtagggttacggttacccggttacgttacggttacggttaccgggtagtaccccgttacccgtacccccgtaacggg

SEQ ID NO: 286596 - DNA, 625 bp, Homo sapiens
  misc_feature: GYAE6OF02FUM1A.51.12.B01.1.454.CMB.1.raw
  modified_base (390)..(390): a, c, t, g, unknown or other
  misc_feature (390)..(390): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcaggtctggggctgaggtgaagagcccgggctcgagtgaaggtctcctgcaagcctctcggctacaccttcagtggcaacaacgtccacgtgggtgccgccacggcccctggacgaagggcttggagtggagtgggagttggtttagtcgtggagtaacgtggtcgccgtataattagtgtacagtagggtacgttcggggntagggtcagtcacgtcgggaaccgggctacggtccgtactccggaccacgtaacttaccgagtacggtaacgtacgacctagtcctagactagtttcgaacgtaccgtaccggtaccgtacttaacgttactgtacgacgtacgagtaccgggacggtacgggtaacgtacgggtaccgggttacgttccggttacgtgggttaccggtcggtacctcccgtaccccgtaacggg

SEQ ID NO: 286597 - DNA, 681 bp, Homo sapiens
  misc_feature: GYAE6OF02GCMK1.51.12.B01.1.454.CMB.1.raw
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (336)..(336): a, c, t, g, unknown or other
  misc_feature (336)..(336): n is a, c, g, or t
tcagcgatcgtatacacgaccggtgctcgatttagtagtgtagattccgcgggggagcatcacccagcaaccacatctgtcctctagacgaaccccctgagacgccccgctccctcaccatggactcggacctggagggactccttcttcttggtggcagcagccaacaagacgcccacctcccgaggtgcagggtggtgcagtcgtggggctaggaggtgaagacggcccgggctcgagtgaacgtctcctgcaacgcctgtcgctacnccttnagtcgacaactacgtccacgtgggtacnccgaccgaccggcccgnggacgagggtctgagngagtggatggtttgcgtagagtacgtggtcgaccgagtaaattgcgtacacgtaggtacggttcgggacgtagggtcaaggtactacggtacggaaccgggacgtaccgtaccgtacggtccgtaccgaacgttaaccgtaaccgtacgtaaccgtaacgtaccggtaccgtaacgtacgtacggtacgtaacgtttacggacgtaaccggtaccggtacccgttacgttacgttaccttacggtcgaccgttaccgaaggacgaccgggtacggaacgtacgggtacgtttacgtaccgttacgttacgggttacggtacggtcccgtaccgtccccgtaacgg

SEQ ID NO: 286598 - DNA, 642 bp, Homo sapiens
  misc_feature: GYAE6OF02FMEDR.51.12.B01.1.454.CMB.1.raw
  modified_base (433)..(433): a, c, t, g, unknown or other
  misc_feature (433)..(433): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcagggtggtgcagtcgtggggctggaggtgaagaacggcccggggctcgaggtgaaggtctcctgacaacgcctcgtggctacaccttcaggtcggacaaacgaaccgtccacgttggggtcgccgccgacggcccccgtgggaaccgaaggggtcttggaggtggagtggggtagttgggttttagtcgtaggaagtaacgtgggtcgccgtataaattcgtacgacgaacggtaggtacgggtttcggggntacgggtcagtcgagtcgggaccgggacaccgtccagtccgacctaactaactacgagtacggaactcgacgtagtctagactagttcgaccgtaccgcggtccttacgttacgttacgtggtcgaccgacgaggacggcgggacggaacgtaggtacggttcgtacgttacggtcggttaccggacggtcccttcccgtacccgtagg

SEQ ID NO: 286599 - DNA, 845 bp, Homo sapiens
  misc_feature: GYAE6OF02II4KP.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgacgtagtcggtgggctggaggtagaaaggaccgggcccgggctacgaggtaggaacggttcctccgtcgaacgaaccgtacctcgtcggtacctaaccgtacccttgacggtcggaaccaaaccgtacccgtaccgtacggttggggtcgcccgacccggacccggtcccccgtaggaaccggtaacgggttccgttaggacgggttaggacgggttaggggttaggttttagggttttaacgttcggtaaggaaacggttaacgggttcgggtcccggtaccgtaaaacgtttaaaagttcggtaccggaacgtaaacgggtaaggggtttacgggggtttacggggacggttacgggtactaacgtcggtaacggtacccgggggtaacccgggtaaccgtacccggttacccgtaaccgttcccggaaaccctaaaccgttaaaccgttagacggtaacggtaacccgtacgaaccgtacgtacgtacgaacctttagttaccggaaccgaccggtaccgtaccttaacgttacttaccggtagtaccgacgtaacgacgggtaacggccggaacggtagtaacgggtaccggttccgtaacgtttcgggtaacggtccggtaaccgtccctttaccccgacccggttaacgg

SEQ ID NO: 286600 - DNA, 612 bp, Homo sapiens
  misc_feature: GYAE6OF02HXD5M.51.12.B01.1.454.CMB.1.raw
  modified_base (332)..(332): a, c, t, g, unknown or other
  misc_feature (332)..(332): n is a, c, g, or t
  modified_base (378)..(378): a, c, t, g, unknown or other
  misc_feature (378)..(378): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgacaaggaccctctggctacaccttcgagtggccaaacaacgtccacgtgggtcgcgccacggcccctggacgaagggcttggaggtggagtgggnttaggtttagtcgtggaagtaacgtgggtcgccggactaaattagngacaacgagggtacggtttcgggggactagggtacagtcgtagtacgggacccgggtacaccggtccagtccgacctaacgaacttacgagtacggactcgaacctgtacagtacctagttacgacgaccgtaccggtctacttacgtttcgtgtcgacgacgagaggccgggacgtacgaggtacggttcgtcgttacggtcggttaccggacgtccgttcccgacccgtagg

SEQ ID NO: 286601 - DNA, 812 bp, Homo sapiens
  misc_feature: GYAE6OF02GKZE7.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggactcctcttcttggtggcagcagccacgaagacgcccactcccgaggtgcaggtggtgcgagtcgtggggctgaggtgaagaggcccgggtctcgagtgaacggtctacctagacgaacgaccctcgtcggactaccgtaccttcgaggtcggaccaaccgtaaccgtcctaacggttggggtacgacccggtacccgtaccggtcccccgtagggaaccggtaaggggtcccttagggaacgggttagggtacggttaggggtacgtttcgggttttaaggtccgttaaggtaacgtaaaccggtttcggtacggtacccgtaaagttaaaacgtttacgtacggaacccgtacggtaacgggtaacgggtttccgggggaacgtacgggttaccagtttaccgaacggtttaccgggaaacccgggttacctaaccgggttacctaaccggtacccgtaccttaaaccgtaaccgtttaaccgacggttaacggtaaccgtacggtaaccgtacgtcgtacgtactacgttacgaccgtaccgacgtccgttaactagttaccgtgtaaccgcgtaacgtaggtaaccgtccgggaacgtaaccgtacgggtaccgtttccggtacgtttaacggttccgggtaaggtcccgttaccgtcccgtacccgtacggg

SEQ ID NO: 286602 - DNA, 764 bp, Homo sapiens
  misc_feature: GYAE6OF02GYCL8.51.12.B01.1.454.CMB.1.raw
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaggcccgggctcagtgaggtctcctgacagacctntggctacnccttnagtggacaacaacgtccactgggtcnccgccgacggcccctgggacgaagggtccttggaggtggacgtggggtattcggggttttagtcgttggaacggtaacgttgggtcgacccggtaataaaacgtttacgtcggaccaacggtaacggggttaacgggttttaccgggggggacttaggggggtacctaacggtttccgaacggttcgggggtaaccccggggtacctaaccgggttacccgtaacgtcccggaccctaacgtaacctttaaccgagtacggtaacgtcgaacctagttacgacgtacttagttcggaaccgtaccggtaccgggtaccttaccgttaacgtttacccgtggtaccggaccgtaacggacgggtaaacggtcccggggaaccgtaacggaacgggttaccgggtttaacccggttaccgttttacgggttacggggtttaccggaacgggtttcccctacccggtttacccccggaacggg

SEQ ID NO: 286603 - DNA, 656 bp, Homo sapiens
  misc_feature: GYAE6OF02JENVO.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaacgcccggggcctcgagtgaaggtctcctgcaagacctctggcctacaccttcagtggaccaaacaaccgtccacgtgggtcgccgcccgacggccccccgtaggaccgaacgggtccttaggaggtggacgtggggtagttgggtttagtcgtggaggtaacgtggtacgccgactaaagttatcgctacgagggtaggtttcggggcgtagggtcagtcaggtcggaccggggactaccgtaccacgtccgacctacgtaacttacgagttaggaactagacctagtctacgacgtattcgaacgtaccgaccggtaccgtacttattacgttcgacgacgaacgtaggaacggtaccgggacgggtaacgtaagggtaccggttaccgtacgtttaccggttcgggttaccggaccgggttaccctcccgtacccccgtaagg

SEQ ID NO: 286604 - DNA, 724 bp, Homo sapiens
  misc_feature: GYAE6OF02HZ0NU.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtctggggctggaggtgaagaacgcccggggctcgagtgaaggtctcctgcaacgcctctggctactaccttcagtggacaacacgtccacgtgggtgcgccacggcccctaggacgaagggtctggacgttgggagtgggattagggtttgtacgtggaagtaacgtgggtacgccgaactaaagtttgacgacgaacggtaaggggtcgggttttaccgggggacggttaggggttaccagtttccggtaagtacgggaacccggggtaactacccggtaccgtacgtaccgacccgaacctaaaccgttacgtaacgtaccggtaaccgtacgaacccgtacggttacgtacggaaccttagtttaccggaaccgtaacggtacccgggtaccgttacttaaccgtttacgtaggtacggtaccgaacggtaggaaccggccgggaacggaacgtacgggttaaggttccgtaccggtttacggtacgggttccgggtaacggtcccgttaccccgttacccgtaacggg

SEQ ID NO: 286605 - DNA, 774 bp, Homo sapiens
  misc_feature: GYAE6OF02GG3PA.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggagggatcctcttcttggtggcagcagccacaagacgcccacctcccaggtgcgagggtgtgcagtcgtggggctggaggtgaaaggaacggcccggggcctcgaggtggaacggtctcctgacaacggacctcgtggaccttacaccttcgaggtcggacaaaccgtaacgtcccgacgtcgggtcgccggaccgacggtcccccgtagggaaccgaacgggggtcctttaggagggtcgggtaagtacggggtagttttacggggtttacggttacgtaggtaacggtaaaccggttggggttaccggaacccggtaagttaaaacgttacgtaccggtaccgaaaccgggttagggtaaccggggttttccgggggaaccggtaggggttaccgtaagtccgtaaggtacggggaacccggggtaacctaccgggtaccgtacgtccggaaccaaccgttaaacgtaccgtaagtacggtacctacgaaccgtacgtcgtacacgttagttacgaccgaccgacggttacctagttacttacgtacgtcgacggacgtacggacgtacggtacggaacgtacggtacgttcgtacggttacgtacggtttaccggacggttaccgttcccgtacccgtacgg

SEQ ID NO: 286606 - DNA, 591 bp, Homo sapiens
  misc_feature: GYAE6OF02G9AQ4.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtctggggctggaggtgaagaagcccggggcctcgagtgaaggtctcctgcaagacctctggctacaccttcagtggacaacaacgtccagtgggtgcgccaggcccctggacaagggcttgagtggatgggtatggtttagctagagacgtggtcgccgataaattatgacacgaggtaggtttcggggcagggtcagtcagtacggaccggggacaccggtcacgtccgaccaacgtaaccttacgagtacggaaccttgaacctagttctagaccttagttagaaccgtacgaaccggtccgttaccttaacgttacgtgtacgacgaacgagaacggcggacggacgaggtacgtcgtacgttacgtggttaccgaggtcccgttccacccgtagg

SEQ ID NO: 286607 - DNA, 670 bp, Homo sapiens
  misc_feature: GYAE6OF02F0P8E.51.12.B01.1.454.CMB.1.raw
  modified_base (248)..(248): a, c, t, g, unknown or other
  misc_feature (248)..(248): n is a, c, g, or t
  modified_base (367)..(367): a, c, t, g, unknown or other
  misc_feature (367)..(367): n is a, c, g, or t
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagacgcccgggctcagtgagtctcgtgcagcctctgctacnccttcgagtcgcaacaacgtccagtcgggtgccgcgacggccccgtggacgaagggtcttaggaggtcggagtggggtattggttttagcgtggagtagtggtcgccgactaaagtttnggacacgtagggtacggtttcggggctaggtcatcgagtcggaaccgggctacgtcacgtcgaccacgtaacgttacncgtacgtacncgacgtacgttcgtacgtacgttacgtttcgaaccgtaccgacccgggttaccgttagtttaccgtttacgtcggttcgaaccggtaacgacgggtaacgggcccgggtaacgggaacgttaccgggttaacgggtttcccgtaaccggtttttacggttaccggggtttaccgggtaacccggcccggttttcccccgtaaccccggttaccgg

SEQ ID NO: 286608 - DNA, 625 bp, Homo sapiens
  misc_feature: GYAE6OF02H3Y7H.51.12.B01.1.454.CMB.1.raw
  modified_base (259)..(259): a, c, t, g, unknown or other
  misc_feature (259)..(259): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaggccggggcctcagtgaaggtctcctgcaagacctctggctacaccttnagtggcaacaacgtccacgtgggtgcgccgacggccccgtggacgaacggggcttggaggtgggagtggggtagttgggtttagtcgtaggagtaacgtgggtcgccgataaagttatgacgtacgagggtacggtttcggggcgtagggtcagtcgtagtacgggacccggggacaccgtccacgtcgaccaactaacttactagtacggaactacgactagtctagacttagttacgaccgacgtaccggtccgtacttattacgtcggtacgacgtacgacggacggcgggacggaacgtagggtacggttcggtacgtttacggttcggttacggacggtcccttacccgtaccccgtaagg

SEQ ID NO: 286609 - DNA, 667 bp, Homo sapiens
  misc_feature: GYAE6OF02JLCBC.51.12.B01.1.454.CMB.1.raw
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtgcagcagccacaagacgcccactcccaggtgcgaggtggtgcagtcgtggggctgaggtgaaggacgccgggcctcgagtgagtctctgacagacctcgtggctacaccttgaggtcggacaacaccgtccacggtggtcgcgcacggccctggacagggctggagtgagngggagttggttancgtagaagacgttggcgacgactaaattgcggtcaacggtaggggttacggttcgggggacgtagggttaccacgtcgtaacggtaccgggaccgggtaccgtaacccggtccaacgttccgaccgaacctaacgtaacgtaggtacggaacgtacgaccgtacgtacgtacgtaccttagtaccggtacggaccctaccgggtccgttaaccttagttacccgtgtaccggacgacgtacgggacgggacgggtacgggaacgttaggtaaggggtttccttaaccgtttcggtacgggttaccgtccgggaccttacccgtacccggtaacgg

SEQ ID NO: 286610 - DNA, 638 bp, Homo sapiens
  misc_feature: GYAE6OF02FT24Z.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctgggctgaggtgaagagcccggggctcagtgaaggtctcctgcaagacctgtggctacaccttcagtcgcaacacgtccactgggtgcgccacggcccctggacaagggtcttggacgtggagtgggattggtttagtcgtggaagtaacgttgggtacgtcccgactaaaatttcgtcgacgaacgtagggtacggtttccgggggcgtacggggtcaagtcgacgtcgggaacccggggtaccaaccgtaccacgtcgaccctaactaaaccgttaacgaacgttcggtaaacctcgaaccgtagtcctcgaacttacgtttacgaaccgtacgaccggtccgttacgttacttacgtggtcgacgaacgacggaggcggtacggaacgtacggtacggttcgtcccgttagtcggttacgcggtcctcccgtacccgtacgg

SEQ ID NO: 286611 - DNA, 909 bp, Homo sapiens
  misc_feature: GYAE6OF02JLB3Z.51.12.B01.1.454.CMB.1.raw
  modified_base (206)..(206): a, c, t, g, unknown or other
  misc_feature (206)..(206): n is a, c, g, or t
tcagcgatcgtatacacgaccggtgctcgatttagtagtgtagattccgcggggagcatcacccagcaaccacatctgtcctctagagaacccctgagagccccgctcctcaccatggactggacctggaggatcctcttcttggtgcagcagccacaagagcccactccacggtcgcaggtcggtgcagtcgtggggctgtaggngaagacgcccggggactcaggtgaaggtcctccgtagccaacgaccttcgcggtcctacaccttcgagtcggacaacaacgtccacgtaggtcgcggtacccacggtcccccgtaggaccgaaacggggtcctttacggaaggtacgggtacgtcggggtagttacgggttttacggtaccgttaggacgtaaacgttcgggttacgccggtaaactaaaacgtttacgttaggacctaacggttaacgggtacgggtttttacccggggggacctaaaggggttacctaagttaccggaacggttaacccgggaaacccgggggtacctacccgggttaaccccgtacgttacccggaacccaaccgttaaacccgttaacgaacgttaacgggtaaccgttaacggacccgttaaccgttccgtaacggtaaccttacggttaacccggtaaccgaaccggttaacccggtacccgtttaaccggtttaacgttttaacccgggttacgttacccggggtaacgttaacccgggtaacgggttaaaccggggacccgggtttaaaccgggggtaacccgaaaggggtttaaccccggggttttaaacggcccgggtttttaacccccggggtttacgggggttaacccggtaacccgggggtttaaccccttcccccggggtttaacccccgttaacgggg

SEQ ID NO: 286612 - DNA, 576 bp, Homo sapiens
  misc_feature: GYAE6OF02HNWPZ.51.12.B01.1.454.CMB.1.raw
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
tcagcgatcgtatacacgaccggtgctcgatttagtagtgtagattccgcgggggaggcatcacccagcaacccacatctgtcctctagagaaccccctgagagccccgctcctcaccatggactggacctggaggatcctcttcttggtggcagcagccacaagagcccactcccaggtgcagggtggtgcagtcgtggggctggaggtgaagaacgcccggggcctcgagtgaaggtctcctgcaagacctntggctacacctttnagtggcaacaacgtccactgggtncgccaggccccnggacagggcttggngtggngtgggatggtttagctgagactggtgcgataaatntgacacgaggtgtttcggggcagggtcattcgagtcggaccggggacacgtccatccggaccaacgtaacttacagtacggaactcgactagtctagactagtttcgacgtaccgaccggtaccgttcttaacgttaccgttgtcgtacgacgaggtaacggcgggacgacgaggtacggttcgcgttacgtggttcgacggtcctccgtcccgtagg

SEQ ID NO: 286613 - DNA, 751 bp, Homo sapiens
  misc_feature: GYAE6OF02JSKCV.51.12.B01.1.454.CMB.1.raw
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
tcagcgatcgtatacacgaccggtgctcgatttagtagtgtagattccgcgggggagcgatcacccagcaaccacatctgtcctctagagaacccctgagagccccgctccctcaccatggactggacctggaggatcctcttcttggtggcagcagccacaagacgcccactcccaggtgcaggtgtgcaggtcgtgggcctggaggtgaagacggccgggcctcgngtgaggtctccgngcaacgacctcgtggacctactaccttcgaacggttcggacaaacgtaaccggtccaacggtgggtcggccgacccgaccgggccccgtgggaccgtaacgggccttaggagttgggaggtacggggtagttacgggttttacggtcgttaggaaacggtaacggtggttacgaccgggtactaaaaggttcgtacggacctaggtagggtacgggtttcggggacgtacggggtacataccgaggtcgggaaccgggtacaccgtaccgtaacgtcggacctaacgtaacgttacgagtaacggactcggactaacgtcgtaacggacgttaagtttacggacccgtaacgggtaccccgggtacgtttacgttaaccttaacgggtcggttacgacccggtaacgagggttaacccggacgggtcccggttaaaggagggtttaaccggttcggttaacgtttcggtgggtttaacccggcggtaccctttccccgacccgggttaag

SEQ ID NO: 286614 - DNA, 875 bp, Homo sapiens
  misc_feature: GYAE6OF02GHG5S.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaacgcccggggcctcgagtgaaggtctccgtgcaagacctgtggctaccaccttcagtcggacaacaaccgtccacgtggggtcgcgcccgacggccccgtggacgaagggtcttggagtggacgttgggattggtttagtcgtggaacgtaacgtggtcgacccgtacgtaaaagtttcgacgtaccgtaacggtaacgggttagggttttccggggggaccgttaacgggggtacctacggttaccgtaagggttaccggggtaaaccccggggggtaaccgtaccccgggttaacccgtaaccggtttaccccgggaacccctaaaacccggttaaaacccggttttaaaccgtaccggtttaaacgggaaaccccgtttaccgggtaaccccttaaagggttccgttaaccgtacgtttaacgtttacgggaacccgtaacccggtacccggggtaccctttaaccgtttaaaccgtttaaccggttacggtaccggtaaccgtaacggtaacgggtaaccggggtacccgggtaacgggtaacccggtaacggggttacccgggtttacccggtttaccggttttaaaccggggttcggggtttaacccgggtacccgggttccccgtttaccccccggtaccccccggttaaaccgggg

SEQ ID NO: 286615 - DNA, 658 bp, Homo sapiens
  misc_feature: GYAE6OF02F2NAO.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagccccggggcctcagtgaaggtctcctgcaagaccctctggctaccaccttcagtggcaaacacgtccactgggtgcgccaggcccctggacaagggcttggagtggatggggattggtttagtcgtgagtaacgtggtgaccgcaaaatttgtgccaagtagggtaggtttccgggggactacggggtctaagtcgtagtcgggaacccggggacgtaccgtcccgtagtcccgtacccaacctaaccttaccagttacggaacctgaaccgtacgtaccgtacgacgtatttcggaaccgaccgtaccggtcccgttacttacgttaccgtggtagaccggaacgacggaacggaccgggaccggaacgtacgggtaacgggttaccgtacgtttaccggttcgggttaccggacgggtccccttacccgtaccccccgtaacgg

SEQ ID NO: 286616 - DNA, 846 bp, Homo sapiens
  misc_feature: GYAE6OF02I3KPQ.51.12.B01.1.454.CMB.1.raw
tcagcgatcgtatacacgaccggtgctcgatttagtagtgtagattccgcgggggagcatcacccagcaaccacatctgtcctctagacgaaccccctgagagccccgctcctcaccatggactggacctggaggatcctcttctggtggcagcagccacaagacgcccactcccaggtgcaggtggtgccagtccgtggggctggagggtgaaggacggtcccggggcctagaggtggaacggttcctccgaggaccaagggaccccttcgtacggtaccttaacctaccgtttacgcggttacgggaccaaaaccgtaacccggttccctaacgggttgggggtacgaccggtccccggaaccggtccccccggtaggaaaccggtaaacggggtcgtttacggaacggttgggaacggttcggggtaagttcgggtttttacggcgttaacggaacggtaaccggttgggtaaccggacccggtaaccgtaaaagtttcggtacggaccgaacgtaacggggtaacgggtttcgggggacgttacggggtactacgttacggtaacgtcgggtaaacccgggggtactaaccggggtacccgtaacgtcccgaaccctaacgtaaaccgtttacgacgtaacgtaacgtacgtaaccgtcggtacgtacgtaacgttcgttaacggaccgtaaccgtccggtacgttacctaagttaccgttcggtacggtaccgtaacgtggaaacggtcccgggaaggtaccggtaacgggttaacggttcggtaccgtttaccgggtacgggtttacccggaggttaccccgttcccgaccggttaacgg

SEQ ID NO: 286617 - DNA, 855 bp, Homo sapiens
  misc_feature: GYAE6OF02HQQPM.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtggggctggaggtgaaggaacggccccggggcctcgaggtgacggtctccgtgacaacgtacctcgtcggactacctaccttcgaggtcggaccaaacgaaccgtccacgtggggtcgccgacccgacgggccccctaggaaccgaacggggtcttaggagtagggaggttggggtattggggttttacgtcgtaggaacggtaaccgttggggtcggacccgtaattaaaacgtttcgacggaccgtaacggtaaggggtacgggttttaccgggggacgtacgggggttccaacgttcgtaacggtaccggggtaacccggggtacgttaacccggtacccaacgttacccgaacccttaaacccgttaaaccttaccgtaaagttaccgggtaaaccgttaccggaacccttacggttacccgtaacgtaccgttaacgttttacggaacccggtaacccggtacccgggttacccgtttaaccgtttacgtttaccggtcggtaaccggtaaccgtaaccggaacgggaccgggtacccggggaaccggtaaaccggtaacggggtaccgggttttacccgtaaccgggttttacggtaccggggtttacccggtacccgggttacccctttacccccggtaccccggttaacggg

SEQ ID NO: 286618 - DNA, 631 bp, Homo sapiens
  misc_feature: GYAE6OF02HY1F1.51.12.B01.1.454.CMB.1.raw
  modified_base (266)..(266): a, c, t, g, unknown or other
  misc_feature (266)..(266): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagaacggcccgggcctcagtgaaggtctccgtgcaacgcctcgtggctactccttnagtcggacaacacgtccacgtgggtcgccgccgacggcccctggacgaacgggtcttaggacgtggagtgggtatttcgggtttagtcgtaggaacgtaacgtggtacgccgtaataaattgcgacgacgagggttacggtttcggggactacgggtacagttacgacgtacgggaccgggactaccgtacgacgtccgaccaactaacgttacgacgtacgtaacgtcgaccgtagtcgagtacttacgttcgaaccgtcgtaccgtccgtacttacttcgtagtcgacgaacgagtacggacggtacgacgtaggtcgttaccgtgttacggtcggttcgtacggcctttacccgacgtacgg

SEQ ID NO: 286619 - DNA, 744 bp, Homo sapiens
  misc_feature: GYAE6OF02IJ6DH.51.12.B01.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
  modified_base (293)..(293): a, c, t, g, unknown or other
  misc_feature (293)..(293): n is a, c, g, or t
tcagcgatcgtatacacgaccggtgctcgatttagtagtgtagattccgtcgggggtaggccatcacccagacaaccacatctgtcctctaggtagaacccccctgagagccccgcgtccctcacccatggacttgggaccttggacggatccgtcttcttggtggcaggccgagccacaaggagcccacttcccgaggtcgnacggtgtcgcagtcctggggctgaggtgaagacgccggggcctcgagtgtaacgttcnccgtagcgaagcctgtcggactacgaccgttnagtaggccaagtaccgtcacgtcgggtgccgaccgaggtcccccgtaggaaccaagggttccttaggacgtggagtacgggtagttagggtttagtcgttacggaagtaacgtggtcgtacccgactaaattaacgtgaccgtaacgaagggttaccggttttacggggactaaggggtaccaagtttcgaacgttcggaacgggtacgaccgtcgacgttccgaccgaacgttaacgtttagtacgtcggtaaacttacggaacgtacggttacctaagtaccgttaagtttcggaaacgtttaccggaccggttccttacgtttaaccttaccgtaggtccgtacggtacggacgggtaaccggcccgggtacgggacgtaaggggtaaccggttaccgtacggtttacggcggttacccggacgttcctaccccggtcccttaacggg

SEQ ID NO: 286620 - DNA, 784 bp, Homo sapiens
  misc_feature: GYAE6OF02GU0ST.51.12.B01.1.454.CMB.1.raw
  modified_base (192)..(192): a, c, t, g, unknown or other
  misc_feature (192)..(192): n is a, c, g, or t
tcagcgatcgtatacacgaccggtgctcgatttagtagtgtagattccgcgggggagcatcacccagcaaccacatctgtcctctagacgaaccccctgagagccccgctcctcaccatggactggacctggaggatcctcttcttggtggcagcagccacaagacgcccactcccaggtgcgaggtggtgnagtcgtggggctggaggtgaagacgcccgggctgagtgagtctctgcaagcctgtgctacgacctttcgagtcggaccaacgtaaccgttccgaacgtggggtcgccggacccgtacgggcccccgtagggaaccgaacggggtctttacgggaggttacgggtaggttggggttatttcggggttttagtccgtaaggggtaacgtaacggttcgggtacggtaacccggtaacgttaaaagtttacgtacggaaccgtacggtaacggggttagggtttacccgggggactagggggtacccaagttccgtaaggtaccggggaaacccggggtaccgtaacccggttaccgtaacgttcccgaacctaaaccgttaaaccttaaccggaacgttaacgggtaaacctcggtaaacccgtaggtttacgtacgtaaccttaggttaccggaaccgtaccggtaccggttacccgttacgttaccgttacgtcggtacgccgtaacggtacggacgggacccggtacggacggtacggtacgttaccgtacgttacgtaggtaccgtacggtaccctccgtaccccgtagg

SEQ ID NO: 286621 - DNA, 705 bp, Homo sapiens
  misc_feature: GYAE6OF02IRAPZ.51.12.B01.1.454.CMB.1.raw
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccgaggtcgcgaggtggtgcagtcgtggggctggaggtagaaaggaacggcccgggcctcgagtgaaggtctcctgacaagcctcgtgctaccaccttnagtggcaacacgtccacgtgggngccgccgacggccccgtggacgaagggtcttaggacgtggagtgggtagttggtttagtcgtggaagtaacgtgggtcgaccgaactaaattagtcgacgtaacgagggttacggtttcggggacgtacgggtctagtcgtacggtacgggacccgggaacgtccggtaccacgtcccgacctaaacgttaaccgttacgaacgtacggtaaccgttacgaccgtagttaccgtagtaacttacgtttacgaaccgtaaccgtcccggttacgttaaccgtttaacgttcgttcggacgtaccgtacgaacgggacggtccgggaacggtaccgtagggttaaccgttaccggtaccgtttaggttcgggtaccggtaccgtcccggttaccccgtaccccggtaacgg

SEQ ID NO: 286622 - DNA, 622 bp, Homo sapiens
  misc_feature: GYAE6OF02I44Q9.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaaggacgcccactcccaggtgcaggtggtgcgagtcgtgggctgaggtgaagaacggcccggggcctcgagttgaaggtcctccgtgacaagacctcgtggccttaaccaccttacgaggtcggacaacaaccgtccgacgtgggtcgccgccgacgccccgtggaacgaaggtcttgaggtggagtgggattggtttagtcgtagacgtaacgtggcgtaccgactaaagttgaggcacgtaggtaggttcgggactagggtcagtcagtcggacccgggactacgtctacgaccgctaactaactacagtagactacgacgtacgtcgtacgcttagttacgacgtacgacgtaccgtacgttacttacgtgacgcgtacgacggtacgacgggacgaagtacggtaacggtccgttattccggttacggttacgacggttaccctaccgtacccgtacg

SEQ ID NO: 286623 - DNA, 595 bp, Homo sapiens
  misc_feature: GYAE6OF02GFU57.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgaggtctcctgcaagacctctggctacacttcagtgcaacaacgtccacgtgggtcgccgccgacggcccccgtggaaccaagggcttggaggtggagtgggattggtttagtctagagtacgtggtcgccgtactaaattagtcgacgacgagggtacggtttcgggggactaggggtacagtcgtacgtcggaccgggaccacgtccacgtccgaccgtaactaaacgttacgacgtacggtaactacgacctagtctagtactattacgacgacgtaccggtccgtacttattacgtgtgacgacgagaggcggacggacgacggtacggttcgtacttacgtggttcgacggtcctccgtccctacgg

SEQ ID NO: 286624 - DNA, 634 bp, Homo sapiens
  misc_feature: GYAE6OF02IJHOG.51.12.B01.1.454.CMB.1.raw
  modified_base (256)..(256): a, c, t, g, unknown or other
  misc_feature (256)..(256): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagaagcccgggctcagtgaagtctcctgacaagctctgctacaccttnagtggcaacacgtccagtggtgcgccacggccccgtaggaaccgaagggtcttggagtggagtgggattggtttagtctagagtaacgtggtcgccgactaaattacgtgacaaggtagggtaggtttcggggacgtaggggtacagtcgaggtacgggaccggggacaccggtccagtccgaccaacgtaacttacgacgtacggtaaccgtacgaccgtagtacgtagtaccgttaagtttaccggaacgtaccgtaccggtccgttacttatttaccgtgtaccgtacgacgacggaacggccggaacggtaacgaggttaccggttacgtacgttacggttacggtaccgtacggtcccttcccgacccgtagg

SEQ ID NO: 286625 - DNA, 696 bp, Homo sapiens
  misc_feature: GYAE6OF02HNP2O.51.12.B01.1.454.CMB.1.raw
  modified_base (255)..(255): a, c, t, g, unknown or other
  misc_feature (255)..(255): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagcgatcgtatacacgaccggtgctcgatttagtagtgtagattccgcgggggagcatcacccagcaaccacatctgtcctctagagaaccccctgagagcccccgctcctcacccatggactggacctggaggatcctcttcttggtggcagcagccacaagagcccactcccaggtgcaggtggtgcagtctggggctgaggtgaagagccggggcctcagtgaaggtctcctgacagacctctggctacnccttcagtggcaacacgtccacgtgggcncgcacggccccnggacaagggcttggagtggatggggattggttagctagaggtaactggtcgccgtanaaagttncgacacgtagggtacggtttcggggacacggggttacacgtacaggttcgggaacccgggggtacaccgggtaccacgttacccggacctaaccgtaaaccgttaacctaacggtacggtaaacccgttacggaaccctaggttcctaacggtacctttaaggttttacggaacccggtaccgaaccgggttcccgttagttacttaccgtggtacgtaccgaacgaacgggtacggaccgggtacggaaccgtagggtaaccgggttcccggttactttaccgggttcgggttaccgggtaacgggtaccccttccccggtacccccgtaagggg

SEQ ID NO: 286626 - DNA, 567 bp, Homo sapiens
  misc_feature: GYAE6OF02HOVO1.51.12.B01.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (335)..(335): a, c, t, g, unknown or other
  misc_feature (335)..(335): n is a, c, g, or t
tcagcgatcgtatacacgaccggtgctcgatttagtagtgtagattccgcgggggagcagtcacccagcaaccacatctgtcctctagagaacccctgagagccccgctcctcaccatggactggacctggaggatcctcttcttggtggcagcagccacaagagcccatcccaggtgcaggtggtgcagtctggggctgngtgaagagcccggggctcagtgaaggtctcctgcaagacctctggctacacctttcagtggcaacaacgtccactgggtncgcaggcccctggacaagggcttgagtggatgggatggttagctgagactggcnccgcaaattcgtgcacgaggtagtttcggggctagggtcagtcgagtcgaccgggtacaccgtactactccgaccaactacttacagtacggaactcgaccgtagtctagacctagtttacgacgacgacggtccgtacttacgttacgtgtacgtcgagtacgagcgggtacggacgaggtacggttacgcgtttacgtcgggttccggacggtcctaccgtcccctacgg

SEQ ID NO: 286627 - DNA, 873 bp, Homo sapiens
  misc_feature: GYAE6OF02HCR1B.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgccccactcccaggtgcgagggtggtgcaggtcgtgggggctggaggtagaaacggacggccccgggggccctacgaggtagaacggtctcccgtgacaacgaccctcgtcggcctacctacctttcgaaggtcggaccaaaccgaaccgtccacggtgggtcgccggccctacggcccccgtagggaaccgaaggggtcgttaggagggtagggtacggttaggggtaagtttcggggttttaagtccgttaaggaacggtaacggttgggtaccgtacccggttaactaaagtttagtacggtacccgaacggttaagggggtacgggttttccgggggacggtaaccgggggttacaacgtttacggtacggtacggggtaacccggggtaaccgtaacccggtacccgtaaccggtacccgacccgtaaacccgtaaccgttaaccgtaaacggtaacgggttaaccttaacggtaacccgtacggttaccgtacggtaaccgttaacgttttaccggaacccgggttaaccggacccgggttacccggttaccgtttaaacgtttacgttaccggtacggtaccggaaccggtaacggaacgggaccgggtaaccggaacggtaacgggtaccgggtttaccgtacgtttacgggttcgggttaccggtaccgggtacccgttacccgtacccccgtaacggg

SEQ ID NO: 286628 - DNA, 737 bp, Homo sapiens
  misc_feature: GYAE6OF02I692E.51.12.B01.1.454.CMB.1.raw
  modified_base (464)..(464): a, c, t, g, unknown or other
  misc_feature (464)..(464): n is a, c, g, or t
tcagcgatcgtatacacgaccggtgctcgatttagtagtgtagattccgcgggggagcatcacccagcaaccacatctgtcctctagagaaccccctgagagccccgctccctcaccatggactggacctggaggatcctcttcgtggtgcagcagccacaagacgcccacctcccgaggtgcgaggtggtcgctacggtccgtggggctggacggtagaacggaacggccccggggctcggaggtagacgtcctccgtcgaccgaacgacctcgtcggacctaccgtaccttcgaggtcgacaaccgtaccgtccgtaggtgggtccgccgacccgacggcccctagggacgagggtcttggaggtggagtggtagttggttacgctagacgacggtggtacgaccgtataaagttgaccgactaacgggtaggttacggggtttacgggaggtcgggtaacncgtacgtacggtaccggggaacccggtaacgtaccggtaccgaccggtcccaccgtaaacgttaaccttcggaacggtaccgtaaacgtcgaacccgttagtcccgtaggaactttacggtacgaaccggacccggtaccgtacgttacctagttacggtcggtaaccgcgtaagtacggaacgggtcccgggaaacgtaggtaccggtaggttccgtttaccgtaacggtttcgggaccggtaccgtacccgttaccccgacccggttacgg

SEQ ID NO: 286629 - DNA, 754 bp, Homo sapiens
  misc_feature: GYAE6OF02H33LB.51.12.B01.1.454.CMB.1.raw
  modified_base (153)..(153): a, c, t, g, unknown or other
  misc_feature (153)..(153): n is a, c, g, or t
  modified_base (196)..(196): a, c, t, g, unknown or other
  misc_feature (196)..(196): n is a, c, g, or t
  modified_base (246)..(246): a, c, t, g, unknown or other
  misc_feature (246)..(246): n is a, c, g, or t
  modified_base (263)..(263): a, c, t, g, unknown or other
  misc_feature (263)..(263): n is a, c, g, or t
tcagcgatcgtatacacgaccggtgctcgatttagtagtgtagattccgcgggggagcatcacccagcaaccacatctgtcctctagacgaaccccctgagacgccccgctcctcaccatggactcggacctggaggactcctcttcgttggnggcagcagccacaagcgcccactcccgaggtgcgagggtggcncgagtcgtggggtctaggaggtgaacgacggcccgggctgagtagagtcnccgtgacaacgtctcgnggtcctacgtacctttcgaggtcggaccaaacgaaccgtccgacgtgggttccgcgcccgtacggtccccgtaggaaccgtaacgggtcttaggagtggtaagtagggtagttcggtttacgcgtagaacgtaacgtgggtacgacccggaacttaaaattcgtacgacgaaccggtaggggttacgggtttccgggagtaacgggtcctaagtcgacggtacggaccgggtaactcccgtaactaacgtcggaaccctaaacgtaacgttaacgtacggtaacggtaacgttaaccggaaccttaccggtacgttacgaacgtttacgtttaccggaaaccgttaccggccgttaacccggtttacttacgttaacgtgtaccgaacgaagacggtaccggcgggtaacgtaccggtaagttacggtttacccgcgttttacggtacggtttaccggaaccggtttcccgtaccccgtacccgtaacggg

SEQ ID NO: 286630 - DNA, 785 bp, Homo sapiens
  misc_feature: GYAE6OF02IMIE1.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggagatcctcttcttggtggcagcacgccaacaagacgcccactcccgaggtgctagggtggtgctaggttcgtggggtctaggtacggtagaaaggaacggccccgggggcccttcgaagggttacggaaacggttcctacccgttagaccgaaacgtcccttacgtcgggtacctaccgttacccgttcgtagtccggacctaaaaccgaaccgttccgtaggttcgggtacggcccgtcccgaaccgggtccccgttaacgggaacgtaacggggtccttaggtacgggtaggtggtagggtacgtttggttacgttctaggtaaggtaccgtggtcgcggtaacttaattacgtacacgacgtaacgggtggttaccgggagtacggttactacgtacgacggtacgggaacccgggtacctacggtcctaccggtacgtcccgtaaccttaaactaccgtagtaacgggtaactaccgactacggttactacgacgttacgttaagacccgttaaccggtcggtaccgtttacttaaccgtttaggtacggtccgtaacgaacgacggtacgggtacccgggaagggtactaagggtcccgtttagaccgtttacgttcgggtacggaccgttcctacccgtccgtaacgg

SEQ ID NO: 286631 - DNA, 772 bp, Homo sapiens
  misc_feature: GYAE6OF02FVZAH.51.12.B01.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtgggntgaggtgaagaagcccggggctcgagngaaggtcctcctgacgaagacctctggcctacaccttcagtggacaaccaacgtccacgtgggtgcgccccccgaggccccgtgggaacaagggcttggagtcgggatggggagttgggtttagtcgtaggaagaacgttggggtacgaccggtactaaatttacgtaggacccgaagtagggttacggggtttaccgggggacgtacggggtactacgtctaacggtacggggtaacccggggtacacccggttacccgaagttacccggaaccccgtaacgttaaacccgttaccgtaaagttaccgggaaaccttaccggaaaccgtcggttacccgttagtaaccgttaacgttttacggaaccggttaaccgcccggggttaacccgttaccgtttaacgttacccgttacggtaccgtaaccgaacggtagaacgggtacccgggtaacgggaaccggttagggtaaccggttaccggttaccgtttaccgggttcgggttaaccggaccggttcccgttaccccgtacccccggtaagg

SEQ ID NO: 286632 - DNA, 855 bp, Homo sapiens
  misc_feature: GYAE6OF02G4296.51.12.B01.1.454.CMB.1.raw
  modified_base (540)..(540): a, c, t, g, unknown or other
  misc_feature (540)..(540): n is a, c, g, or t
tcagcgatcgtatacacgaccggtgctcgatttagtagtgtagattccgcgggggagcatcacccagtcaacccacatacctgtcctctacgagaaccccctgagagtccccgcttccctcaccacgtacgtcgtacgtccgtacggaagtaccttccttcctttcgttgggtacgaacgcgtacgaccgaccaaactaagtacccgtaccccttacccacccggtacggtaccgacggtagggttggtcgaccgtacggtggggtaacggtcgtacggtacggtaacgaacggaccgggcccggtaccgtacggtagtaacggtacgtccgttcgtacgaacgaaccgtaccttcggtacgtaccctaacccttacgtaccgagggtacctaaccgaaaccggttaaccgtaccgtcgggttacgggaccgccccgtaacggtaccccggtacccgtacgggtaaacggtacggttttacggaacggttacggaaccggttaacgggtacggtttaacggtttttacgggttttaaccncgggttaagtaaaaccggttcgggttcggtaccggaccgtaaaacgttttaaagttcggccgtaacgaacgggtacggggtttcggttacggaccgttacggactaacgtagtacggtaccgggaacgaccgttacgacgtacgtacccgaataacttaacgtcgagttaaccgtagttaccgtaacgtcgtactagtaacttacgtaagacctacggccgttactacgttaactcggtgacgacgtagaggcgacgtacgaagtcggttacgtacctcgttaggtcggtacgtcctacgtaccccgtagtacgg

SEQ ID NO: 286633 - DNA, 774 bp, Homo sapiens
  misc_feature: GYAE6OF02GVSWK.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtcgcaggtcgtgggggctggagggtgaaggaacggcccggggctcgaggtgaaggtctctgacaacgcctgtagctactaccttcgagtcggacaacgacgtccacgtgggtcgccgccgacggccccgtagggaaccgaaggggtccttaggacggtacgggtagtggggtagtttacgggttttagtccgttaggaacggtacggttcggggtacgacccggtaaacgtaaagtttcgtacggacctaacggtagggttacggtttaccgggggacgtaacggggtacctaggttaccgtacggtaccggggtaacccggggactaccggttaccgtacgtacccggaaccgtaaccgtaaaccgttaaccgaggttaacggtaaccgtaccggaaccgtagttaccgtacggtaacttacggtttacgaacccgtacgtaccggttaccttacgttaacgtttacgtacgtacggaccgtaacgacggtacgggaccgggtacggaaacggtcggttaacggttccgttacgtttacggttccgggttaccggtaccggtcccttacccggtaccccgtacgg

SEQ ID NO: 286634 - DNA, 773 bp, Homo sapiens
  misc_feature: GYAE6OF02H6UMG.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttgggtggcagcagccacaagacgcccactcccaggtgcgagggtggtgcagtcgtggggctggaggtgaaggaacggcccgggctcgaggtgaacggtctcctgacaacggtacctcgtggaccttacctaccttcgaggtcggaccaaaccgaaccgtcctaacggtcggggtcgccggacccgaacgggtccccccgtaaggaaccggtaaacggggtcgttacggtaggtcggagggttacggggttagtttaggggtttacgtcggtaggtaacggtaaacgttgggtacggtaccgtaacgttaaattacgtacgaccgtaacggtaacgggttacgggtttacggggacgtaacggggtctaacgttacgtacggtacggggtaacccgggtaacctaccggtaaccctaccgtacccggaaccgtaaccttaaaccgttacgtaacggtaaccgtaaccgtacgtaaccgtagtcgtaacgtacttacgttacgaaccgtaccgaccgttcgttacttaacttacgtgacgtacgtaacgaggacggcggtacggaacgtacgggtacgttacgtacgtttcggtacggttaccggtacggtcccttacccggtaccgtacgg

SEQ ID NO: 286635 - DNA, 874 bp, Homo sapiens
  misc_feature: GYAE6OF02F7G5B.51.12.B01.1.454.CMB.1.raw
tcagcgatcgtatacacgaccggtgctcgatttagtagtgtagattccgcgggggagcatcacccagcaaccacatctgtcctctagacgaaccccctgagagccccgctcctcaccatggactggacctggaggatcctcttcttggtggcagcagccaacaagacgcccactcccaggtgcaggtggtgcagtcgtggggctggaggtagaagaacggcccgggtcctcgagtagaacggtctccgtagacaacgaccctcgtacggtacctaacctaaccctttacgaggttacggacaaaccgtaaaccgtccgaaccgttggggtacgcccgacccgaaccggggtccccctaggggaaccgaaggggtcctttaggacgggttagggaaggttggggaagtttggggttttaacgtccgttagaacggtaacgttgggggtacgaccggtaaactaaagttacgacggaacaacggtaggggttaccgggtttaccggggggctaacggggtctacgttacgaacggttaccggggaaccggggtacctaaccggtccgaaacggttcccgtaacccgtaaaccgttaaaaccgttacgtaaacggttacgggtaaacccgttcgggtaaacccttcggttaccgtaacggttaaaccgttacgtttacgggaacccggtaacggtaacccgggttacccgtttaactttaaccggttaacggttcggtaaccggaccggtaacggaacgggtaacgggacccgggtaaacgggtaacgtaacgggggttacggtttaccggtaccgttttaacgggtccgggtttacgggaaccggtttcccctttaccccgtaccccggttaacgg

SEQ ID NO: 286636 - DNA, 763 bp, Homo sapiens
  misc_feature: GYAE6OF02HGA92.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtgggctgaggtgaagacgccgggctcagtgaaggtcctctgcgaagacctctggctacaccgttcaggtcggctaaacgtaaccgtccacgttggggtcgccgtacccgacggcccccttagggaacctaaggggtcctttacggagttcgggaagtcgggggtaagttacgggttttagtcgtacggtaaacggtaacgttgggtacggtcccgaacgtaaagtttaccgagttacccgaaacgtaggggtaagggttttccgggggaactacggggttacgtaactaccggtaaggtacgggtaacccgggggtaacctacgggttaacccgtaccggttaccgacccgtaacgtaaaccgttaacgaacgttaacggtaacgtccggtaaacgtacgttacgtacgtaacgtaagtttaccggaacgtaacccggtaccgtaccccggttaacgttaatttaccgtcggtacgaccggacgtaacggaacggttccgggacggaaccgtagggaacgtttaccgtacgttaccgtgggttcgaccggtctcccggtaccccgtacg

SEQ ID NO: 286637 - DNA, 658 bp, Homo sapiens
  misc_feature: GYAE6OF02HOKVV.51.12.B01.1.454.CMB.1.raw
  modified_base (272)..(272): a, c, t, g, unknown or other
  misc_feature (272)..(272): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcgaggtggtcgacagtccgtggggctggaggtagaagaacgcccggggcctcgagtggaacggtctcctgacaagacctctggactacaccttnagtcggacaacaccgtccacgtgggtcgcgccgacggccccgtggacaagggcttggacgtggagtgggtattggtttacgtcgtaggagtaccgttgggacgaccgataaagtatcgactaggacggtacggtttcggggctaggggtcagtccgaggtacggaaccgggtactacgtccgtacgtaccgacctaactaaccgtaacgacgtacgtaacgtacgaccgtagtcgtagtaacgtacgttacgacgaccgtaccgtaccgtacgttacttacgtcgtacgacgaacgtacggtacggaccggtacggtacgtacggtacggttaccgtacgtttacggtcggttacggtaccggtaccgtacccgtaccccgtacgg

SEQ ID NO: 286638 - DNA, 743 bp, Homo sapiens
  misc_feature: GYAE6OF02H7XFH.51.12.B01.1.454.CMB.1.raw
  modified_base (551)..(551): a, c, t, g, unknown or other
  misc_feature (551)..(551): n is a, c, g, or t
  modified_base (571)..(571): a, c, t, g, unknown or other
  misc_feature (571)..(571): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccaacaagacgcccactcccaggtgcgaggtgtgcagtcgtgggctggaggtgaagacgcccgggctcgagtggaagtctccgtgacaagtaccctcgtggacctaacgtaccctttacgaaggttcggaaccaaaccgtaacggtaccctaacggtcggggtcgaccggacccaccggtcccccgtaagggaacccggtaacgggggtcgttacggaggttacgggacgttaggggtacgtttacgggttttagtacgtaggaacgtaacgtgggtcgaccgtagtaaagttagtcgactacggtaaggtacgggtttcggacgtacgggtacagtcgtagtcgggaaccggggtaactaccggttacacgttaccgaccaactaaaccgttanaggttacgtaactcggaacngttacgtagaacctagtttcgaaccgtacgtacccgggttacttacgttaacgttacggtaccggtacgtacgaacgacggtaacgggacgggtaacggaacggtaaggtacggtttaccgtacgttaccggttcgggtaccgtacggtacccgttccctaccccggttagg

SEQ ID NO: 286639 - DNA, 632 bp, Homo sapiens
  misc_feature: GYAE6OF02FGX1W.51.12.B01.1.454.CMB.1.raw
  modified_base (244)..(244): a, c, t, g, unknown or other
  misc_feature (244)..(244): n is a, c, g, or t
  modified_base (279)..(279): a, c, t, g, unknown or other
  misc_feature (279)..(279): n is a, c, g, or t
  modified_base (623)..(623): a, c, t, g, unknown or other
  misc_feature (623)..(623): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttctggtggcagcagccacaagagcccactcccgaggtgcaggtggtgcagtctgggctgaggtgaagagcccggggctcagtgaaggtctcctgcaagacctntggctacaccttcagtgacacacgtccatggtgcnccacggccctggacagggcttgacggtggagcgggattaggtttagtcctaggacgaacgtgggtacgaccgtactaaaagtttgtacgaccgaagttagggtacgggttttaccggggacgtaggggtacctagtacgagtacgggaccgggaccgtaccggtacctacgtcccggacctaaaccgtaaccgttaaccgtaacgttacggtaacgtacgaacccgtagttctaggtaactacgtttacgacgtaccgtacggtccgtcttaacgttctgtcgacgagacgaggccggcgacggaggtacgttcgtacgttacggtcgtacggacgtcgttccncccgtacgg

SEQ ID NO: 286640 - DNA, 857 bp, Homo sapiens
  misc_feature: GYAE6OF02GXT39.51.12.B01.1.454.CMB.1.raw
  modified_base (301)..(301): a, c, t, g, unknown or other
  misc_feature (301)..(301): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtcgtgggctgaggtgaagacgcccgggctcgagtgaggtctccgtgacaacgacctcgtggcctaccgtaccttcgaggtcggaccaaacgtaccgtccacgtggggtnccgtaccgaccggccccgtagggaaccgaaggggtccttagggaacggttgggacgttggggtagtttcgggttttagtaccgtaggtaacgtaacggttggggtaccgtccggtaaacttaaaagtttcgtacggacccgttaacggggtaacggggtttacggggttttacccggggggaacgttaacgggggtacctaagttaccggtaaccggttaccggggggaaacccccgggggtaaccgtacccgggtttacccgaaccggttaccccggaacccgttaaaccgttaaacccgtttaacgaacggtttaacgggaaacccgttaccggtaaccgttacggttaccgttacggtaaccgttaacggttttaccggaaaccccggtaccggtaacccggggttacctttaaccgttttaacggtttaccgttcggtaacgaccccggtaagacggggtacggtccggggtacgaaagggttaccggtacggtttccgtaacgtttacggttcggtaccggacggttcccctccccgtaccggttaacggg

SEQ ID NO: 286641 - DNA, 617 bp, Homo sapiens
  misc_feature: GYAE6OF02H3VKI.51.12.B01.1.454.CMB.1.raw
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (552)..(552): a, c, t, g, unknown or other
  misc_feature (552)..(552): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggcaaacaacgtccagtgggtcgcgccacggcccctggacaagggcttgngtaggagtgggtagttggttagtcgtagaagtaacgtggtcgcccgataaattancgacacgaggtacggtttcggggacgtagggtcaagtcgagtacggaaccggggtacaccggtactacgtccgaccaacgtaaaccttacgaagttacggtaaccgtacgaacctacgtacgtacgaactaacgtttacgaacgtaccgaccggtacccgtctttaacttacgtagtcgacgtanagacggcggacggtacgagtacggttccgcgttacgtcggttcgcggtcctcccgtacccgtagg

SEQ ID NO: 286642 - DNA, 891 bp, Homo sapiens
  misc_feature: GYAE6OF02GENJ1.51.12.B01.1.454.CMB.1.raw
tcagcgatcgtatacacgaccggtgctcgatttagtagtgtagattccgcgggggagcatcacccagcaaccacatctgtcctctagacgaaccccctgagagccccgctcctcaccatggactggacctggaggactcctcttcttggtggcagcagccaacaagacgcccactcccaggtcgacgaggtggtgcagttcgtggggctggagggtgaaacggaacggccccgggggctcgaggtaggaacggttcctccgtgacgaaacgtcccgttcgtaggtcctaaccgtaccgttcgaggttcggacctaaaaccaaccggtccctaacggtggggtacgccggtacccgaacggtcccccgtaggaccgtaaggggtccttagggaggttcggaaggttaggggtacgtttagggttttaggtcttaacgggggtaacgtaaaccggtttggtaacccggtacccgtaagtttaaaaacgtttcggttaccggaaaccggtaaaaccggttggggggttaaacgggtttttcccggggggaaacgtttaccggggtacgttaaaccggtcgttaaacggttaacccgggggttaaaccccgggggaaacctacccggggttaccccggtacgttacccggaaccccgtaaaccggttaaaccgttaaaccgtaacgttaacgggtaaaccttaaccggtaaccgttaacgttacgttaaccggttaacgttaacgtttaccggaccgttaccgaaccgggttaccgttaccgttaacgttacgtacggtacgtaccgaagtacggtaaggacccgggtacggaacgtacggtacgttaccgttacgtacgtacggttaccggcggtaccctcgtaccccgtaacg

SEQ ID NO: 286643 - DNA, 658 bp, Homo sapiens
  misc_feature: GYAE6OF02HVFKJ.51.12.B01.1.454.CMB.1.raw
  modified_base (260)..(260): a, c, t, g, unknown or other
  misc_feature (260)..(260): n is a, c, g, or t
  modified_base (405)..(405): a, c, t, g, unknown or other
  misc_feature (405)..(405): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtgggctgaggtgaagaagcccggggactcagtgaaggtctcctgcaagcctctggctacaccttnagtcggacaacaaccgtcccaagtgggtacgcgccgacggcccccttagggaaccgaaacggggtcctttggaggtcgggagttacggggatttaggggttttagtcgtggtaagaacgttgggtacgccgtaacaaaatttagngacgtagagggttacggtttcgggactagggttccaagttcgaagtacggaccgggacgtaccgtaccgacgtccgacctaacgtaaccttacgatacgggaaccttacgaaccgtacgttctacgtactagtttacgaccgacgtaccgaccgttacgtaattacgtagtcgtacgacgagtacggcgggacggactaggtacggttacgccgtttacgtcggttacggccggtctcccgtaccccgtacgg

SEQ ID NO: 286644 - DNA, 539 bp, Homo sapiens
  misc_feature: GYAE6OF02F5D9P.51.12.B01.1.454.CMB.1.raw
  modified_base (351)..(351): a, c, t, g, unknown or other
  misc_feature (351)..(351): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccggggctcagtgaaggtctcctgcaagacctctggctacaccttcagtggcaacaacgtccactgggtgcgccaggcccctggacaagggcttgagtggatgggatggtttagtctgagaactggtgccgacaaattngcacgaggtaggtttcggggctaggggtcagtcagtcggaccggggacacgtccatccgaccacaacttacatggaactgaccagtctgactatttgacgacgacggtccgtctattactgtgcgacagacgcggcggacgaggtaggttcgcgttacgtcggttcgaggtcctccgtccccgtacgg

SEQ ID NO: 286645 - DNA, 1158 bp, Homo sapiens
  misc_feature: GYAE6OF02GYLQM.51.12.B01.1.454.CMB.1.raw
tcagcgatcgtatacacgaccggtgctcgatttagtagtgtagattccgcggggagcatcacccagcaaccacatctgtcctctagagaaccccctgagagccccgctcctcaccatggactggacctggaggatcctcttcgttggtggcagcagccacagacgcccactcccaggtcgcgaggtggtgcgagtcgtggggctggacggtggaacgaacggccccggggtcctacgaggttacgaaacgggttccttcccgtaggaccgaacggtacccttcgtacggccttaacctacccgttttcgaacggttcggaccaaaccgtaaccggttacccgtaaccggttggggtaccggtcccggtacccgaccgggtacccccccgttagggaaccggtaaaaccggggtccgtttacggaacgggttacgggtaacgggttcggggggtaagtttttacgggggtttttaaccgttacccggttaaggtaaaaccggggtttaaacggttccgggggtttaccggtaaacccccgggtaagtttaaaaaaccgttttcgtaacggtacccgaaacggttaacggggggttaccggggtttttacccggggggaccgggtttaaccggggttctaaaccggtttaccgggaaacgggtttacccggggaaaccccggggggttaaccgtaaaccccggggtttaccccctaaaccgggttacccccggtaaccccgttaaaacccggttaaacccgtttaaacccggttaacgttaaccgggggtaaacccttaccgggaaacccggttaacccgggtttaaaccgttaaccggggtaaaccctttaaccggttttttaaacccgggaaacccgggtttaaaccccgggtacccggggtttaaccccccgggttttacgttttaaaaaccccgggttttttaaccggttacgggtttaaacccggggttaaccggtaaaccccgggtttaacggggaaaccggggttaccccgggggtaaccggggttaaaccggttaaacggggtttaccccgggggttttaaccgttttaccccgggtttaaccgtttaccgggggttacccgggtaaccggtttcccccgtttaccccggttaccccccggtttaaaccggg

SEQ ID NO: 286646 - DNA, 823 bp, Homo sapiens
  misc_feature: GYAE6OF02HM4VW.51.12.B01.1.454.CMB.1.raw
  modified_base (335)..(335): a, c, t, g, unknown or other
  misc_feature (335)..(335): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggagactcctcttcttggtggcagcagccacaagacgcccactcccaggtgcgaggtggtgacagtcgtaggggctaggaggtagaaggaacggcccggggcctacgtaggtacggaacggttcctccgtggaccaacggaccttacgttggcctacctacctttcgaggtcggacaaaccgtaccgtccgtacgtcggggtacncccgtacccgaacggggtccccccttaggggaaccgtaacggggtcgttacggtacgggtagggtaacggtcggggtttaagttcggggtttttaaacggtccgttaagggtaaccggtaaaccgggttttcggggtaccggtaccccggttaaattaaaacggtttacgtaccggtaacgtaaaccggggtaagggtttaacggggtttttacccgggggacgttaaggggttcctaaaacgtttccggaacggttccggggaaaccccgggggtacctaaccccgggttacccgtaacgttcccggaaaccctaaaccgttaaaccgtttacggaaacgttcggttaaaaccgttcgacccgttaagtccgttagaacgtttacgttacggaaccgtacgacgtctacttacgtcgtgtacgacaggagacggtcggacgacgagtacgttcgagttcggtacggtcgacgtcctacctaccgtcg

SEQ ID NO: 286647 - DNA, 686 bp, Homo sapiens
  misc_feature: GYAE6OF02FV2UR.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcaggtggtgcagtctggggctggaggtgaagagcccggggctcagtgaggtctcctgcaagacctcgtggacctaccaccttcaggtggaccaacaaccgtccacgtggggtcgccgacccgacggccccctagggaaccgaacggggctttacggaggtacgggagttggggtatttggggtttttacggtacgttaggacgtaaacgttcggggtacgccgtaactaaagtttactggaccgaacggtagggtacgtttcgggggactagggtcacgtcgagtacggaccggggacacgtaccgagtccgacctaaccgtaacttacgagtacggaacgtcgacagtacgtacgtacgtactttacggaccgtacgacggtacccgtacttacgttactggttacacggtacgacggaacggccgggtacggaacggtcggtacggttaccgtacgtttacggttcgggttaccggaccggtccttaccccgtacccgtaacgg

SEQ ID NO: 286648 - DNA, 731 bp, Homo sapiens
  misc_feature: GYAE6OF02GRXEZ.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcgttggtggcagcagccacaagacgcccactcccaggtgcaggtggtgcagtcgtggggctggaggtgaagaaggcccgggcctcagtgaggtctcctgcaagcctcgtggctacaccttcagtgacaacacgtccacgtgggtgccgaccgacggccccgtagggacgtaacgggtccgttaggaggtcgggtagtggggagttggtttaggtcgtaggagtaacggtggtcggccgtactaaagttcgcgtacaacggtagggttacgggtttccgggggaacgtacgggtaccgtatcggtaaggtaccgggaacccggggtaccgtacgttaccgaccgtccggaccctaaccgttaaacttacgaagtaccggtaactaccgtaaccgacggttacacgttaagtacgtttacggaaccggtaaccgaccggttaccggttactttacgttaacgttcggtaacgtccgaacgtacgggtaacggacgggtaacccgggtagtaacgggttacggtttacgttaccggtttaacggtttccgggttacgaccggggtttacccttccccgtaccccggtaacgg

SEQ ID NO: 286649 - DNA, 1091 bp, Homo sapiens
  misc_feature: GYAE6OF02H2ON2.51.12.B01.1.454.CMB.1.raw
tcagcgatcgtatacacgaccggtgctcgatttagtagtgtagattccggcgggggagcatcacccagcaaccacatctgtcctctagacgaaccccctgagacgccccgctcctcaccatggactggacctgggaggactcctcttcgttggtcggcagcacgccacaagacgcccactcccgaggtgcgagggtcggcgcgacggttcgtacgggggctaggacggtggaaacggaaccgggccccgggggtcctacgaggtacggtaacggttcctaccggtacgaccgaacggaccgttccgtacggtaccttaacccgtacccttttcgaacgggttccggaaccctaaaaccgtaaccggttaccccgaaccggtttggggggtacccgaacccggaccccgtaaccggggtcccccccgttaaagggaaccgggtaaacggggttccgttagggtaaccgggttaggggtaacgggttacggggggtttaagttttacgggggtttttaaccgaaccggttaagggggtaaaccgttaaccggggttggggtacccgggtaaaccccgttaaacgtttaaaagttacggtaaccgtaacggtaaaacggggttaccggggttttaacccgggggttaccgggggggtaacccgttagggggtaaaccgttacccgggtttacgggaaccggggttaacccggggggtaaaccccggggtaacccggtaacccgtttaccccggaaaccggttaaccccggtaaacccttaaacccgtaaaccggttttaaacccggtaacggttacccgggttaaaacccgtaacgggtttacccaaacgggtttacccgtaaaccggtttaccggttaaccggttttaaaccgggaacccggtaacccgggtttaaacccgttacccggtttaaacgtttaaaccgttcggttaaccgggttacggaacgtaccggggagggtaccgggtaccgggacggtaacggaacggggtttaccgttaccgtaaaccggtttcggtttaacgggtaccggtacccggtttaccccgttaccccggaccggttaacggg

SEQ ID NO: 286650 - DNA, 756 bp, Homo sapiens
  misc_feature: GYAE6OF02F7KWC.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaaggaacgcccggggcctcgagtgaaggtctcctgacgaagaccctgtcggctaccaccttcgagtggacaacaaccgtccagtgggtcgccgccacggcccgtaggacgaagggtcttaggtaggtggagtgggtgtttagggtttacgtgtaggtaacgtacggtcggtcgaccgtaagtaaacttagcgacgaggtaggttacgggttcgggacgtaggtcacgtgaggtacgggaacccgggtacgaccgtcgtactacccgacctaaacttaacctacgtagtaacggtaccgtacgtaaccgtcgttaccgtacgtacgtttacgttaaccggaccgtaccgtacccgggtacccgtttacttaacgtttaccggtacggttaccgaccgggtaacggtacgggaaccgggtacccggggtaaccgggtaaacggttaaccgggtttacgggggtttaacccgttacggttttaaccgggtttacggggttaacccgggtacccgggtccccttttaccccccggaccccggtttaaccgggg

SEQ ID NO: 286651 - DNA, 670 bp, Homo sapiens
  misc_feature: GYAE6OF02HAWMC.51.12.B01.1.454.CMB.1.raw
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (521)..(521): a, c, t, g, unknown or other
  misc_feature (521)..(521): n is a, c, g, or t
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagacgcccactcccaggtgcaggtgtgcagtcgtgggctgagtgaagacgcccgggcctcgagtgaacggtctccgtgctaagacctcgtcggcctaaccgtccttgagtcgaccaaacctacgtaccaccgtgggtcgcgtccgaaccggccccgtaggaccgaagggtcttggnggtggngtacggggtagttcggtttacgtcgtgaacggtacgtggtcgacgacgtaaattgtcgacacggacggttagggttcgggacgtacgggtaccatacgtaggtaccgggaaccgggtacctaccggttacgaccgttaccgaccctaaacgtaacttaaccgtacgtaacggttaaccncgtaaccgtgtacgtcgtaaccgtagtacgaccacggtaccgttacgctttaacgtcgtacgtcgtacgacgacggtacgacgggacggtagtaacggtacggttcgtactttccgggttggtaccggacgtcctacccgtaccctagg

SEQ ID NO: 286652 - DNA, 588 bp, Homo sapiens
  misc_feature: GYAE6OF02GEUQZ.51.12.B01.1.454.CMB.1.raw
  modified_base (286)..(286): a, c, t, g, unknown or other
  misc_feature (286)..(286): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaaggcccggggcctcaggtgaaggtcctcctgcaaggcctctggctacaccttcagtggcaacaacgtcacgtggncgccacggcccctggacaagggtctgaggtggagtgggagttggtttagtctggagtaacgtggtgccgtagtaaattatagctacggaggtagggtttcgggacgagggtacagtcagtcggaacgggacacgtcagtccgactaaccaactacacgtaggaactacgacgacgtctagtaactagtttacggacgaccgtcggtaccgttcttaattcgtcgtcgaaccgagacggaggtccgggagacgacggtacggttcgacgtttcgtgggtacgcggtccttcccacccgtacgg

SEQ ID NO: 286653 - DNA, 851 bp, Homo sapiens
  misc_feature: GYAE6OF02HY4S4.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagcgcccactcccgagggtgcgtagggtggtgactaggtcgtgggggctggaggaggtaaaggaaccggcccggggtcctgacggtagaaggtcctccgtagacaacgtacctcgtcggtactacctaccgtttcgaacggtcggaccaaaccgtaaccggtccctacgggtacgggtcgccggaccccgacggtcccccgtagggaaccgtaacgggggtctttgggacggtagggagggttcgggtaggttttaacgggttttaacggttcgtacgggtaacggttaacggttggggtaaccgaccccggtaaacttaaaactttacggtaccgtacgtaacggtaacggggttacgggttacggggggtaccgtaaggggttacctaacgggtacgtaacggtacggggtaacccggggaccttaacccggtaacccaccgtaccggtaacccaaccgttaaaccgttaaccgtaacggtaacggttaaaccgtacggaaccttacgttacgtagaaccgttagttaaccggaacgtaccgggtacccggtacgttccgttaacgtttacgtaggtaccgacgaaacgtacggggaaccggaccgggtacggaacgttcgggtaaccgggttcttacgttacgggttacgttccgggaccggttaccctcccggtaccccgtaaggg

SEQ ID NO: 286654 - DNA, 776 bp, Homo sapiens
  misc_feature: GYAE6OF02G9BAY.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaaggaacggcccggggctcagtgaacggtctcctgacaagcctcgtggacctacctaccttcaggtcggaccaaactaacgtcccacgtgggtcgcgccgaccggccccgtggaaccgaagggcttaggaggtggagttgggagttgggttactcgtaggaacgtacgtggtcgtccgaactaaagttcgtcgaccgtaacggtaaggggttacgggtttcgggggacgtacgggtacaacgttacgtacggtaacgggaacccggggtacctaaccggttaacccgtaacgtaccccggaccgtaaaaccgtaaaccgtttaacgaacggttacggaaaccttacgtaaccgtacggttacctacgtaaccgttatttacgggaacccggtaaccgtacgggttcccgtttaacgttaacgtttccgttacggtacggtaccgaaccggtaggtaacccgggaccggggtaacggaacggttaacgggtacgggttacccgtttacggtttaccggttacggggtttcccgaaccgggtccccgttaccccggtaccccggtaaggg

SEQ ID NO: 286655 - DNA, 650 bp, Homo sapiens
  misc_feature: GYAE6OF02FT0KG.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctccctcaccatggactggacctggaggatcctcttcttggtggcagcagccacaagagcccactcccaggtgcaggtggtgcagtctggggctggaggtgaaggaaggcccggggcctgagtgaacggtcctccgtgacaagaccctcgtggcctaccaccttcgagtggaccaaactaaccgtccgacgtgggtcgccgccgacggccccctagggaaccgaacgggtccttggacggtcggagtcggggtaattgggtttagtccgtaggaacggtaacgtggtcgccgtactaaagtttgtagcacgtagggtacgtttcggggactagggtcatcgagtcggaccgggtacgaccgtacgacgtccgaccacgtaacttacagtacggaaactcgtaaccgacgttctacgactacgtttacgaccgacgtaccggtaccgttacgtacgttaccgtgtacgacgtaacgacgacggcggaccgtacgacggtacgttacgtagttacgtcggtacgacggtcctaccgtccctacgg

SEQ ID NO: 286656 - DNA, 646 bp, Homo sapiens
  misc_feature: GYAE6OF02G7RRP.51.12.B01.1.454.CMB.1.raw
  modified_base (167)..(167): a, c, t, g, unknown or other
  misc_feature (167)..(167): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
tcagcgatcgtatacacgaccggtgctcgatttagtagtgtagattccgcgggggagcatcacccagtcaaccacatcctgtcctctagagaaccccctgagagccccgctcctcaccatggactggacctggaaggatcctcttcttggtggcagcagccacaagngcccactcccaggtgcaggtggtgcagtctggggctgaggtgaagacgcccgggctcagtgaacggtctcctgcaagtacctntgctacnccttnagtggccaacacgtccagtggtncgccacggccccgtggacgaagggtcttacggaggtcggagtgggtagttgggtttacgtcgtcggtaacgtaacgttgggtacgtaccgtactaaattcgtacgacaacgtagggtacgtttaccggggacgtacggggtctagtcgtaggtacgggacccgggtacgtaccggtcacgtcgaccaacgtaacgttacagtacgaacgtacgtaccgagtcgtacgacgttacgttcgaccgtaccgtaccggtaccgttacttacgttcgtacggtcgacgtacgacgacggtcggacggaccgaggtacggttcgtcgtttacggtcggtaccgtacggtcctccgtaccccgtacgg

SEQ ID NO: 286657 - DNA, 723 bp, Homo sapiens
  misc_feature: GYAE6OF02FN5XQ.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagagcccgggctcagtgaaggtctctgacagacctcgtggcctacaccttcagtcggcaacaacgtccagtgggtcgccggccgaccggcccccgtagggaccgaaggggtccttggaggtgggagtggggtagttgggtttagtcgtaggaacgtacgtgggtacgtaccgacgtaaattacgtacgacgaacggtaggttcggggtttacgggggacgtaggggtctaacgtcgtaacggtcgggaaccggggacctaccggtaccacggttacccaccgtaacttaaaccgttacgaacgtacgggtaaaactcggtaaacccgtagttaccgtcgtaacttacgttacgacggtaacctcccggggttaccttaccgtttaacgttacgttcggtacggtaccgaacgtagggaacggacccgggtacgaacccggaaggttccggtttaccggtaccgtttacggttacgggttaccggacggttccccctaccccggtacccgtacgg

SEQ ID NO: 286658 - DNA, 822 bp, Homo sapiens
  misc_feature: GYAE6OF02HTH61.51.12.B01.1.454.CMB.1.raw
  modified_base (192)..(192): a, c, t, g, unknown or other
  misc_feature (192)..(192): n is a, c, g, or t
tcagcgatcgtatacacgaccggtgctcgatttagtagtgtagattccgcgggggagcatcacccagcaaccacatctgtcctctagagaaccccctgagacgccccgctcctcacatggactggacctggaggatcctcttcttggtcggcagcagccaacgaagagcccactcccaggtgcaggtggtcncagtcgtggggctaggaggtagaagaacggcccgggcctcaggtcgaaggtcctcctgactaacgacctcgacggactaaccgtacccttcgaggtacgacctaaaacgtaaccgtaccgacggtacgggtacgaccgaccgacccggtacccctacgggaacgtaaacgggtcgttacggtacggttgggaacggttagggtagttacgggttttacgtcgtaacggtaacgtaaccgtggggtccgtacgtaaacgtaaattacgcgaacggttaaacgaggggttacggttcgggaccgtaagggtacctagtaacgacggtaacggaccgggtaacaaccgttcgaaccgtccggaacctaaaccgtaaaccgttaacgtaacggtaaccggtaactacggaaccgttacgtaaaccgtgtaaaccgttacgtttaacgaaacggtacccgtaacggtacccgttaacttaaagtttaccggtgtaaccgtaacgaacggtaacggaacccgggtacggtaacccgtaacggtacgggttaaaccgttacccggttaacgtttaaccgggttaccgggttaaccggtaacccgtttacccggttaccccgtaccccgtaaaccggg

SEQ ID NO: 286659 - DNA, 651 bp, Homo sapiens
  misc_feature: GYAE6OF02F5P4K.51.12.B01.1.454.CMB.1.raw
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttctggtggcagcagccacaagagcccactcccaggtgcaggtggtgcagtctggggctgaggtgaagacggcccggggcctcgaggtgaaggtcctccgtgacaagtacctcgtggtactacctaccttcaggtagaccaactaacgtccacgtaggtgccgtccgacggtcccctagggacaagggtcttgaagtggaagtgggattggttacgtgtgagaacgtggcgccgacaaagttnatcacgtagggtacggttcgggngtagggtctagtcgtagtacggaccgggtacaccgtcgtacgtacgtaccctaacgtaacttaacgactacggaactacgaaccagtacagtactaagttcgaacgacgtaccggtaccgtacttaacgttcgtaggtacgtcgaaccgtaggaacggaccgggaacggtaacggtacggtaacggtttcggtactttaccgggttacggttcggtaccgtaccggttacccgtaccccgtacgg

SEQ ID NO: 286660 - DNA, 655 bp, Homo sapiens
  misc_feature: GYAE6OF02G6FXP.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagagcccgggctcagtgaggtctcctgcaagcctctggctacaccttcgagtgacaactaccgtcacgtgggtgcgccgacggcccctggacgagggctaggagtggagtggagttggttacgtgtaggagtactggtcgaccgtataaattgtcgacgaggagggtacggttcggggacgtagggtacgtacgtacgacggtacgggaaccgggtacctaccgtacaccgtccggaacctaaccgtaacttaccgacgtaacggtaccgttacggaaccgtcgtacgtacgtagtttaacgttaccgaccggtaacggtacccggtcgttacctttaacgttacgtacgtacgtacggacgtaggacggtccgggaacggtaaccgtagggtacgttcgtacggtttacgtacgggttccgaccggtcctaccccgtacccgtaagg

SEQ ID NO: 286661 - DNA, 673 bp, Homo sapiens
  misc_feature: GYAE6OF02HZ2RJ.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctgaggtgaagaagcccgggctcagtgaggtctcctgcaagcctctggctacaccttcagtggccaacaacgtccacgtgggtcgcgccgacggcccccgtggaccgaaggggcttggagtggatggggagttggtttagtcgtgaggtaacgttggtcgccgactaaattagtcgactagacgggttaggtttcggggctaacggggtcagtccgtaagtcgggaaccggggactaccggttccaacgttccggaccctaacgtaaccttaacgtagtaccggtaaacgtcgaacccgtaggttacctacgaccgtttaagtttaccggaaccgtaacccggtaccgggtacccgtttaacttaacgtttaccggtggtacgtaccgacgtaggaacggccgggacggacgagggttacggttaccgtcgttacggtcgggttccggacggtcccttcccgtacccctaggg

SEQ ID NO: 286662 - DNA, 611 bp, Homo sapiens
  misc_feature: GYAE6OF02HM0P6.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggctcagtgaaggtctcctgcaagacctctggctacaccttcagtggacaacaacgtccacgtgggtgccgccacggccccgtgggaccaagggcttggagtggagtggggattgggtttagtcgtaggaacgtaacgtggtcgaccgactaaagttcgtggactacgagggtacggtttcgggggactagggtcagtcagtcggaccgggacgacgtaccagtccgaccactaactacgactacggaactcgacctagtctacgtactagttacgacgtaccgaccggtccgttacttacttacgtcgtacgacgacgacggacggcggacggacgaggtacggttccgtacgttacgtcgggttaccgacggtccttaccgtaccccgtagg

SEQ ID NO: 286663 - DNA, 656 bp, Homo sapiens
  misc_feature: GYAE6OF02FHOGX.51.12.B01.1.454.CMB.1.raw
  modified_base (102)..(102): a, c, t, g, unknown or other
  misc_feature (102)..(102): n is a, c, g, or t
  modified_base (167)..(167): a, c, t, g, unknown or other
  misc_feature (167)..(167): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (275)..(275): a, c, t, g, unknown or other
  misc_feature (275)..(275): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
tcagcgatcgtatacacgaccggtgctcgatttagtagtgtagattccgcgggggagcatcacccagcaaccacatctgtcctctagagaaccccctgaganccccgctcctcaccatggactggacctggaggatcctcttcttggttggcagcagccacaagacncccactcccaggtgcaggtggtgcagtcgtgggctgnggtagaagacgcccgggctcagtgaggtctctgacagacctncggctacaccttcagtgcaacacgttccngtggtgccgcctacggcccgtggacgaacgggtcttgacggtggacgtgggattagggtttacgngtgaagacggttggcggtccataaacgtttancgactaacggaggtaaggttcgggtacgtagggtctagcgtaacggtcggtaacccgggacgtaccgaccgtaccgtaccgaccctactaaaccgtacagtacgtaaaccgacgtaactacggtacttagaacttagttacgaccgacgtacccggtacttacgttaacttacgtagttacgaccgtagacgtaccgggcggaccggaacgtaccggtagttacccggttagttaccggttacggttaccggtacggtacccttccccggtaccccttaacggg

SEQ ID NO: 286664 - DNA, 695 bp, Homo sapiens
  misc_feature: GYAE6OF02I628X.51.12.B01.1.454.CMB.1.raw
  modified_base (160)..(160): a, c, t, g, unknown or other
  misc_feature (160)..(160): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccanaagagcccactcccaggtgcaggtggtgcagtcgtggggctggaggtcgaagacggcccggggctcgagtgaaggtcctccgtgacaacggtactcgtggcctactaccttcaggtacggacaaccgaacgtcctacgtgggtacgccgtcccgaacggccccgtaggaaccgtacgggtccttggaacgtgggaatcgggtagttggtttagtcgtacggtagtaacgtgggtacgcccgtataaaagtttcgagtaccaaggtggtaacggtttcggggactaggggtctaacgtcgaacgttccgggaaccgggactaccggtacgtaacgtccgaactaacgtaaccgttaacagtcggaacgtaccgactaacgtcgtaacgtacttacgttacgacgtaccgtacgtccttataccgtttagcgttacgactaccggacggtaacggcgggtacggtaacgtacgggttaccggtactacgtttacggttcgggaccggttaccgggaccttaccccggtcccgtaagg

SEQ ID NO: 286665 - DNA, 793 bp, Homo sapiens
  misc_feature: GYAE6OF02GHCPI.51.12.B01.1.454.CMB.1.raw
tcagcgatcgtatacacgaccggtgctcgatttagtagtgtagattccgcgggggagcatcacccagcaaccacatctgtccgtctagagaaccccgtcgagagccccgctcctcaccatggactggacctggaggatcctcttctggtgcagcagccacaagagcccactccaggtgcaggtcggtgcagtcgtggggctggaggtacgaaggaacgcccgggggtcctcgagttcggaacggtctcctaggaccgaaacggtacctcgttacggcttaacctaccttacgaacggttcggaacctaaacgtaccggtaccaaccggttggggttcgaccggtacccgaccggtaccccccgtaaggtaccggtaaacgggtccgtttaggaacgggtacgggtaagtggggtaacgtttagggttttacgtcgttagacgtaacgtgggtacgaccgtaataaacgtttgaccgccgaagtacgggtaacgggttttccggggcgtaaggggttcctaacgtcgtacggtacgggtaacccggggtaacgaccggtttaccgacgtacgaccctaacggaaaccttacgacgttaagggacctacggtaaccacgttacgcggtaaccttacggtttacgaaccggtaccgtaaccggtccgttaacttaccgttaacgttcggtaacgtaacccgaactacggaacgggaccggacggaccggtaagggtcggttaccgttggtttaaccggtcgggttccggtaacgtcccgtacccgtacccgtaagg

SEQ ID NO: 286666 - DNA, 785 bp, Homo sapiens
  misc_feature: GYAE6OF02HJIKU.51.12.B01.1.454.CMB.1.raw
  modified_base (151)..(151): a, c, t, g, unknown or other
  misc_feature (151)..(151): n is a, c, g, or t
  modified_base (358)..(358): a, c, t, g, unknown or other
  misc_feature (358)..(358): n is a, c, g, or t
tcagcgatcgtatacacgaccggtgctcgatttagtagtgtagattccgcgggggagcatcacccagcaaccacatctgtcctctagaaaaccccctgagagccccgctcctcaccatggacctggacctggagatcctcttctggtggcngcagccacagagcccatcccaggtgcaggtggtgcagtctggggctggaggtgaagacgcccgggctcagtgaaggtctccgtgcaagccttgcggtcctacgaccttcaggttcggactaaccgacgtcccgaacgtgggtcgccgccgacggcccctgggaaccaggggtccttaggacgttggacgtgggtacttgggttttanccgttagggaaccgttaacgttcggtaggaccccgtagtaaaacgttttgaccggccgaaacggtagggtacgggttttacggggctaaacgggtacctagttccggtaacgtccggggacccgggtaacgtccggttaaaccgtacttccgggaacccttaacttaaaccgttaccgaaggttaccggtaaaccgttgtaacccgtacgttaccgacgtaacctttacggttaaccgaacccggaaccgtaccggtacccgttccgtttaaaatttccggttagtccggaaacctacggtaacgggtaccggaccgggttaccggaaacgttaaaccgggtcggtttaaccgtaccctttaccggggttagtttacccgggtaacccgccggtttaccccccgaacccggttaacggttacccggg

SEQ ID NO: 286667 - DNA, 741 bp, Homo sapiens
  misc_feature: GYAE6OF02FM27Y.51.12.B01.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (345)..(345): a, c, t, g, unknown or other
  misc_feature (345)..(345): n is a, c, g, or t
  modified_base (381)..(381): a, c, t, g, unknown or other
  misc_feature (381)..(381): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagacgcccactcccaggtgcgaggtggtgcgagtcgtggggctggaggtgaagagcccgggcncagtgaggtctcngcaagcctntgctacaccttgagtgacaactacgtccagtcgggtgccgtcgaccggcccctagggacaggggtcttaggaggtcggagttgggggacttgggtttancgttaggacgtacggttggacgccgaattaaagttntcgacacggtagggttacgggtttacgggggactaggggttacacgtacgacggttaccggggaaacccgggtacgtaccgtacctacggtaccgtaacccgtaacttaacccgttacgaacgttacgggaaccttaccggaaccgtccggttacgtaacgggtacttaacggttcggaacccgtacccggtaccgggttccttaagttaaccgtttcgggacgttaccggtacggaacgtacgggtaccggaccgggtaacgggaaccggtagggttacccggtttaccgttaaccggtttacgggttaccggggttccggtaaccggggttcccctttacccggccccgttaacgggg

SEQ ID NO: 286668 - DNA, 1026 bp, Homo sapiens
  misc_feature: GYAE6OF02H0MH3.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctccctcaccatggactggacctggaggatcctcttcttggtggcagcagccacaagacgcccactcccaggtgcgtaggtggtgcgagtcgtggggctggaggtgaaggaacggccgggcctgagtgacggtcctccgtgacgaacgaccgtcgtcggacctaacctacccttacgaggtaggaccaacgaaccgtccgacggttgggtcggaccgaccgacggccccgtaggaccggtaacggggtcgttacggaggtagggtcgtaggggtagttttaggggttttacggtcgtaacggtaacggtaacgttcgggtccggtaaccccggtaagtttaaaacgttcggtacgggtaccccgtaacggggttaaacggggttacccgggggttttaaccgggggggaccggttaaccggggggtttaacccgtaacgttcccgttaaaccgggggtacccgggggtaaaccccgggggggtacccgttaacccccgggttaccccggttaaacccgttaacccccgggaaaccccgttaaaacccgttaaacccggttttaaacccggtaaacggtttacccgggttaaaaccggttaacccggttaaacccggtaaccggttttaccgggtaaaccgtaccgggttttaacgttttaaccgggaaacccgggttaaccccgggtttaacccgggggttacccccttttaaccggtttaaacggttttacccttacgggggtaacccgtaaacccgggtaaccgtaacggggaacccgggggtacccgggtaacccggggtaacgttaaaccggggttacccgggtttaaccgtttaccggttttaccccgggttaggggttttacccggaaccccgggtttcccggtttaccccccggaaccccggtttaacggg

SEQ ID NO: 286669 - DNA, 731 bp, Homo sapiens
  misc_feature: GYAE6OF02IQWUO.51.12.B01.1.454.CMB.1.raw
  modified_base (261)..(261): a, c, t, g, unknown or other
  misc_feature (261)..(261): n is a, c, g, or t
  modified_base (416)..(416): a, c, t, g, unknown or other
  misc_feature (416)..(416): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggactcctcttcttggtggcagcagccacaagacgcccactcccgaggtgcaggtggtgcagtctgggctgaggtgaagagccgggcctcgagtgaaggtctcctgcaacgactcgtgctactaccttnagtggacaacgtaaccgtcacgtgggtcgccgcccgacggcccccgtgggaaccgtaaggggtcttacggaggttacggagtcgggggtaattaggggttttaacgtcgttaggaacggtaaaccgttgggttcgacccggaaactaaaagtttntacgactaacggtaagggttacggtttcgggggacttaggggtactaagtcgaacggttcgggaacccggggtaactaccgggtcccgtaacgtacccgacctaaaccgtaaacgtttaaaccgacgttacgggtaaactacggtaacccgtacgttacctacgtaacgttactttacggaaccgtacgtaccggtaccgttcgttaactttacgcgttaagccgtaacgaggtaacggccggacggtaacgtaaggtccggttacggtacgtttacggtcggttaccggacgtacccgtacccgtcccgtacgg

SEQ ID NO: 286670 - DNA, 806 bp, Homo sapiens
  misc_feature: GYAE6OF02ICRSU.51.12.B01.1.454.CMB.1.raw
  modified_base (164)..(164): a, c, t, g, unknown or other
  misc_feature (164)..(164): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagngcccactcccaggtgcaggtcggtgcagtctggggctgaggtgaagaagcccggggctcgagtgaaggtctaccgtgacaacgacctcgtaggctaccgacctttcagtcggacaacgaacgtccaacgtgggtgccgccgaacggccccctaggtaaccgaacggggtcttacggtaggttacgggagttaggggagtttagggttttagtcgttacggtaggaaaccgtggggttcgacccggaacttaaaagttacgtcgacgtaaacgaagggttacgggtttacgggggacgtaagggggtcctaagtttaccgaacggtaccgggttaacccggggggaactaaccggttacccgtaacggttacccgggtaaccctaaaacctaaaaccgtttaacctaacggtttacggggtaaaaccttccgggtaaaccgtaacggttaccgtaagtaaccgttaacgtttacggtaaacccgtacggaacccgggtaccgtttaccgttaagtttaaccgttacgggtacgaccgaactacgggtaaaggcccgggtaacgggaacgtagggtaaccgggtttacgtacgtttacggtttacgggtaccggtacggtacccttaccccgtaccccgtaagg

SEQ ID NO: 286671 - DNA, 910 bp, Homo sapiens
  misc_feature: GYAE6OF02IF8Q5.51.12.B01.1.454.CMB.1.raw
  modified_base (252)..(252): a, c, t, g, unknown or other
  misc_feature (252)..(252): n is a, c, g, or t
  modified_base (322)..(322): a, c, t, g, unknown or other
  misc_feature (322)..(322): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagacgcccactcccgaggtgcgaggtggtgacagtcgtggggctaggaggtagaaggaacggcccgggctcgaggtgaacggtcctccgnggacaacgaccttcgtggacttaccgaccttcgaaggtcggaccaaacgaaccgtcccgacgtggggtcnccgcccgaccgggcccccttaagggaccgaacgggttccttagggaggttaggaggttacggggtagtttacggggttttagttaccggtaggtaaggtaaaccggttgggtaccggtacccgtaacgttaaaaagttccgttcggaaccccgttaacggaaggggtttaccggggtttccggggaacggtacgggttacaagttacggtacgggttaccggggacccggggtaaccgtacccggttaccaccggtaccgtaacccgtaaccgttaaacccgtttacgaaaccggttacgggtaaacccttacgtaacccggtaccggtttccggtaacccggtaaccgtttacggtttaccggaaacccgggtacccggttaaccgggttccccggttaagttttaaccggtttaccgtacggtacccgggaaccgttaaccggaaccgggtaacgggtcccggggaaaccgggttaaccggtacgggtaacccggttttacccggttacccggttttaagggttccccggggtttacggtaacccggggttccccctttacccccggggtaacccttaaccggggg

SEQ ID NO: 286672 - DNA, 657 bp, Homo sapiens
  misc_feature: GYAE6OF02GZSHY.51.12.B01.1.454.CMB.1.raw
  modified_base (361)..(361): a, c, t, g, unknown or other
  misc_feature (361)..(361): n is a, c, g, or t
tcagcgatcgtatacacgaccggtgctcgatttagtagtgtagattccgtgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagacgcccggggctcagtgaaggtctcctgcaagcctctggctacaccttcagtggcaacaacgtccacgtgggtgccgccacggccccgtggacgaagggcttggagtggagtgggatggtttagtcgtgagacgtggtcgccgactaaattngcacgaggtaggtttcggggacaggggtcacgtcgagtcgggaccggggactacgtccgaacgtccgaccactaaccttacgagtcggtaactacgaccgtagtctaggtactagtttacggaccgtaaccgtaccgggtaccgttacttaacgtttaccggttagtaccggtaccgtaaccgtaggaaccgggtaccggggaccgggaaccggtaggggtaacggtttacccggtacgttttacgggttccggggtttaccggacgggtcccgttccccgtacccccggtaacgg

SEQ ID NO: 286673 - DNA, 751 bp, Homo sapiens
  misc_feature: GYAE6OF02GENZY.51.12.B01.1.454.CMB.1.raw
  modified_base (175)..(175): a, c, t, g, unknown or other
  misc_feature (175)..(175): n is a, c, g, or t
  modified_base (199)..(199): a, c, t, g, unknown or other
  misc_feature (199)..(199): n is a, c, g, or t
  modified_base (203)..(203): a, c, t, g, unknown or other
  misc_feature (203)..(203): n is a, c, g, or t
  modified_base (210)..(210): a, c, t, g, unknown or other
  misc_feature (210)..(210): n is a, c, g, or t
  modified_base (353)..(353): a, c, t, g, unknown or other
  misc_feature (353)..(353): n is a, c, g, or t
  modified_base (425)..(425): a, c, t, g, unknown or other
  misc_feature (425)..(425): n is a, c, g, or t
tcagcgatcgtatacacgaccggtgctcgatttagtagtgtagattccggcgggggagcatcgacccagcaaccgacatctgtcctctagagaaccccctggacgagccccgctccttcaccgatggactggacctggaggactcctcttcgttggtggcagcagccacaaggcncccactccaggtgctaggtcggtnccgnggttcgnggggctcggagggtagtaaaggacggtccccggggactcgaaggtcggaaacggttcctccgttggcctaaaacgtccctacgtcggacctactaccgtttagacggtcggacctaaacgtacgtacccacgttaggggtacnccggtccgaaccggtccccgtagggaacggtaacgggtcttggacggtgggaaggttcgggagtttagggtntcgaaggtacgtacgtcgggtacacgtactaaattcgagacctaggtcgggttacgggtttggggactacgggtcttaacgtgtacgtaaccgggccgggtaacctcggtaccgtagtcccgactaaaccgtacgtaccgtagtacgggtaccacgtacgtccgttacgtacgtacgttacgttcgaacggaaccgttcggacctttacgtagttaccgtggttaacaccgttaggacggaccggtcgggtaacgtccgggtaacggtagttaccgtcgtttacgggaccggttacggtacccggtttccaccgtaccccggtagg

SEQ ID NO: 286674 - DNA, 739 bp, Homo sapiens
  misc_feature: GYAE6OF02JET23.51.12.B01.1.454.CMB.1.raw
  modified_base (123)..(123): a, c, t, g, unknown or other
  misc_feature (123)..(123): n is a, c, g, or t
  modified_base (133)..(133): a, c, t, g, unknown or other
  misc_feature (133)..(133): n is a, c, g, or t
  modified_base (306)..(306): a, c, t, g, unknown or other
  misc_feature (306)..(306): n is a, c, g, or t
tcagcgatcgtatacacgaccggtgctcgatttagtagtgtagattccgcgggggagcatcacccagcaaccacatctgtcctctagagaaccccctgagagccccgctcctcaccatggacnggttttaccnggaggatcctcttcttggtggcagcagccacaagacgcccactcccaggtgcagggtggtgcagtcgtggggctggaggtgaaggacggcccggggcctcgagtgaaggtcctccgtgacgagacctcgtggcctacgtaccttcgaggtcgacaaacacgtccagtgggtcnccgtccacggcccctaggacgacgggtctggagtaggatgggtattggtttagcgtagaacgtagtggtcgacgtaactaattacgtcgacaacggtagggttaccggggttacggggacgaggggttacacgttacgaggtccgggtaacccggggacctaaccggtacccgtacggtacccgacctaaaccgttaacttaccgaacggttaccggaacttaccgaacgttacgttactacggtagttacgttacggtaacccgaccggttaccggtaccgtttaccgtttacgttaccggtaggttcgaacgtacggaagggtaaccgggtacgggaccgggtaacgtacggggttacggtttacccggtacggttttaccggtcgggttaacggtaccggtccccgttacccggtaccccggttaacggg

SEQ ID NO: 286675 - DNA, 765 bp, Homo sapiens
  misc_feature: GYAE6OF02JDHN6.51.12.B01.1.454.CMB.1.raw
  modified_base (257)..(257): a, c, t, g, unknown or other
  misc_feature (257)..(257): n is a, c, g, or t
  modified_base (345)..(345): a, c, t, g, unknown or other
  misc_feature (345)..(345): n is a, c, g, or t
  modified_base (395)..(395): a, c, t, g, unknown or other
  misc_feature (395)..(395): n is a, c, g, or t
  modified_base (471)..(471): a, c, t, g, unknown or other
  misc_feature (471)..(471): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccaacctccgaggtcgcgagggtcggtgcagtcggtgggtctaggtaggagaaaggaaccggccccgggctacgaggtaggaacggttccncgtacggacaaacgtccgttcgtcggacctaacctaccgttacgtagggtagacctaaacgtaaccggttccccaaggtttggggacnccggtaacccgccggtacccccgtagggaaactaacgggtcctttaaggnggttacggaggttcggtagtttacggtttacgtcgttaggaaacgtaacgtggtccgacccgaaattaaagttcgngactaaagggtggttaaacggggtttccggggaactacgggtataactcggaagtcgggaacccgggtaacgtacggtaacctacgtaccgtaaccgtaaaccttaactaaccgtagtacggaacgtacgaacgtacgtactacgtacgttaagttcgaaacaccggtacctaccgtttacgtaacttcgtacgttcgaccgtaacgtacgtaacggacggtccggtaaagacggttacggtacctaacggttacggtacggtttaccggacgttcctaccccgtccgtaacgg

SEQ ID NO: 286676 - DNA, 720 bp, Homo sapiens
  misc_feature: GYAE6OF02IBE8N.51.12.B01.1.454.CMB.1.raw
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcaggtggtgcagtcgtggggctggaggtgaagaggcccgggctcgagtgaaggtctccgtgacaacgacctcgtggcctacaccttcgagtgacaacacgtccacgtggtgccgaccgacggcccccgtaggaccgaagggtctaggagtcggagtgggtagttgggtttacgtcgtgaacgtaacgtgggtacgcccgtaagtaaattcgtacgacgtacggaagggttacgggtttacggacggtagggtacagtcgaagtcgggaaccgggacctaaccgtacgtactaccggaccaaccgtaaccgttacaggtacggtaaaccgtacgtaacgtacgttacgtacgaacgttacgtttacggaaccggtaccgaaccgggttcccgttacgtttaacgttacgttacggtacgtaccgtaacggtaacggaacgggtaccggggaccggaacggtacgggtaccgggtttaccgttacgttaacggttccgggtaccggttaccgggtcccgttaccccgtaccccgtaacccgg

SEQ ID NO: 286677 - DNA, 607 bp, Homo sapiens
  misc_feature: GYAE6OF02G0ZZA.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctggaggtgaagagcccgggcctcgagtgaagtctcctgcaagacctcgtggctaccaccttcagtcgacaactaacgtccacgtgggtgccgaccacggcccctagggaccagggtcttggaggtggagtgggtatgggtttagtcgtggacgtaacgtgggtacgaccgataaattcgtgaccgaagagggttacgggtttccggggacgtagggtctactcgaggtcggaccgggacacgtcacgtcgaccacgtaactacagtgaactgactgtctgactgttacgacgacgtacggccttactacgttcgtggtcgacgagtacgacggccgggacgacgtacggtacggttccgtacgtttacggttcggttaccggacggttccctacccgtacccgtacgg

SEQ ID NO: 286678 - DNA, 833 bp, Homo sapiens
  misc_feature: GYAE6OF02IS802.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttgggtggcagcagccacaagacgcccactcccaggtgcgaggtggtgcagtcgtgggctgaggtagaagacggcccgggcctcagtgaacggtctcctgacacgaccttcgcggacctacaccttcgaggtacggtaaccaaaccgtaaccgtccgtacggtaggggtccgccggacccggtaccggtaccccccgtaaggggaaccgtaacggggtccgttagggagggttacgggtaggttacggggtaaggttttaggggtttttacgtacgttaggtaacggtaacgtcgggttacggaccgtaacgttaaaattacggtacgacctaaacgggtagggttacgggtttaccggggacgtacgggtactaggttaaccgacggttacgggaacccggggtaaccgtaccggtaaccccgtcgtaaaaaaacccgtcccgtaaaccgttaaaccgttaaccggtaacgtacggtaaacgttaccggtaacccgtacgttacgtacgtaaccgttaagttaccggtaacggtaaccggtaccggttccgttaacgttaacgttacgttacggtacgaaccgtaccggtaacggaacgggaccgggtaaccgggtaaccgtaacgggttacggttaccggttacgtacgttcgggttaacggccgtaccgttccccgtaaccgtacgg

SEQ ID NO: 286679 - DNA, 717 bp, Homo sapiens
  misc_feature: GYAE6OF02GLRAL.51.12.B01.1.454.CMB.1.raw
  modified_base (195)..(195): a, c, t, g, unknown or other
  misc_feature (195)..(195): n is a, c, g, or t
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (320)..(320): a, c, t, g, unknown or other
  misc_feature (320)..(320): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcacgccaacaagacgcccactcccaggtcgcgagggtggtcnctagtcgtggggactggaggtagaaggacggccccggggctcaggtgacggtcctcngacaacgcctgcggactactccgttnacggtcgacaactaccgtcagtcggtcgccgcgtacggcccnggacgaggtcttgaggtcgagtcgggagttggtttacgtcgtacggaagtaccgttggcgtacccggtaataaacgttaggcgacgaacggtagggttacggttcggggtaactcgggtactagtaacgtacggtacgggaaccgggtactacccgtacgtacgtccgtaaccgtaaacgttaacgtaacgtacggtacgtaactaccggaacttcggtacgtacctaagtttcgtacggaccgacgggtaacccgttccggtaattaccgtacggtacgttaccggaacgttacggaggtaccggtaccgggaccggtaacgttaccgggtaacgttccggttaaccttacgggttccgtacggaccggtttaccctcccggtacccgttaacggg

SEQ ID NO: 286680 - DNA, 809 bp, Homo sapiens
  misc_feature: GYAE6OF02ICQOE.51.12.B01.1.454.CMB.1.raw
  modified_base (165)..(165): a, c, t, g, unknown or other
  misc_feature (165)..(165): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
tcagcgatcgtatacacgaccggtgctcgatttagtagtgtagattccgcgggggagcatcacccagcaaccacatctgtcctctagacgaaccccctgagagcccccgctcctcaccatggactggacctggaggatcctcttctggtggcagcagccacaagngcccacctcccaggtgcaggtggtgcagtcgtggggctggaggtgaaggacggcccgggctcgagtgaggtctcngcacgacctnggcctacaccttcagtgacaacacgtccagtggngccgcgcggcccgtaggacgaggtcgtaggagtggagtggtgttcggttgtcgaggtacgaggttggacgccgtaataaacgttgtacgactaacggacgggttacgggtttcggacggtagggtacacgttcgtaacggacgggtaccccgggtaactcccgtaacgaccgttaccggaacctaaccgttaaccgtagtaccggttaacggtaacccttacggaaccgttcggttaccgtaacgtaaccgtttacggttaacggaacccggttaccgtaccccggggttaaccttttcccgtttaaaaggtttcccggtaaacgggtaacccgtacgggttaaaacggaaccccgggtaaacgggtccccggggggtaaacggtaaaacccggggtttacggggtttaacccggggtttacccccgtttttaaaagggtttccccgggtttttaacggggttacccggggtaccccgtttaaccccccgtttttacccccccgggaaccccgggtttaacgggg

SEQ ID NO: 286681 - DNA, 827 bp, Homo sapiens
  misc_feature: GYAE6OF02F7STV.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggtactcctcttcttggtggcagcacgccacaagacgcccactcccgaggtcgcgagggtggtcgcgtacggtcgtggggcgttaggagggttagaaacggtaaccggccccggggtccttacgagggttacggtaacggttcctccgtagaccgtaaccggtacccgttcggtcggtaccttaccgtacccgttcgtaggtcggaacctaaaccgtaacccggtcccgtagggttcggggaccgtacccggcccggtacccggtccccggtacgggaacggtacgggtccgttaggacggtaggtacggtgggtaacgtttaggtttacgtacgtaggtacgtacggttcggtacgaccgtaataacgttacgtcgacgtacggtaggtacggtcggacgtaggtctagcgtaggtaccggtacggacctacgccgtcgtaccgtaccgaacgttacgtacgtacggtacgtaaccgtaccggtcgtaccgttaacgtcgaaccgtttcggtaacgacccgttaccggtccgttaccgttacgtttacgtaccgtacggtaccggacgtaacgggtacgaaccgggtccggtaaccgggaacgttaaccgggttcggtaaaccccgtttgggttacccggttaccgggtttaacggcccccgttacccggtttaccccgacccgggtttacggg

SEQ ID NO: 286682 - DNA, 828 bp, Homo sapiens
  misc_feature: GYAE6OF02GAW5V.51.12.B01.1.454.CMB.1.raw
tcagcgatcgtatacacgaccggtgctcgatttagtagtgtagattccgcgggggagcatcacccagcaaccacatctgtcctctagacgaacccctgagacgccccgctcctcaccatggactggacctggaggactcctcttcttggtggcagcagccaacaagacgcccactcccgaggtcgcgtaggtggtgctagtcgtggggctggaggtgaagacggcccgggcctcgagtgaaggtctccgtgacaacgtacctcgtcggaccttaactacccgttcaggttcggacctaaaccgaaaccgtcccaacgtggggtacgccggacctaccggccccgttagggaacgtaaacgggtcctttggaacggttagggacgttacgggggtaatttcggggttttaacgtcgtaggtaaaccggtaaacggttcggggttacgaccccggtaacgttaaaaagtttacgtcggaccgtaacggtaagggggttaacggttttccggggggacgttaaggggtccttaaagtccgtaacgggtaccgggaaacccgggggtaaccgtaaccccgggttaccgtaacggttcccggtaacccgtaaacccgttaaaccgtttaaccgtaaacgttaacggggtaaaccgttacggtaacccgtaacgttcgtacgtaacgttacgtttacgaaccggtaccgtaccggtccgttacttaagttaccgtgtacgccgtagacggaagccgggaccggaacgtagggtaccggttacgtacgtttacggttcgggttaccggtacggtcccttccggtccccgtaacgg

SEQ ID NO: 286683 - DNA, 833 bp, Homo sapiens
  misc_feature: GYAE6OF02GCI17.51.12.B01.1.454.CMB.1.raw
  modified_base (260)..(260): a, c, t, g, unknown or other
  misc_feature (260)..(260): n is a, c, g, or t
  modified_base (365)..(365): a, c, t, g, unknown or other
  misc_feature (365)..(365): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggagatcctcttctggtggcagcagccacaagagcccactcccaggtgcaggtggtgcagtcgtggggctggaggtgaagaacggccccggggtcctcaggtgaaggtctcctgcaagacctctggctacnctcagtgacaacaacgtccacgtggtgcgcacggcccctggacaaggctgagtggatgggattggtttagtctagtacgtaacgtggtgaccgactaaagttagngcaacgagggtacggtttacggggacgtagggtacagtacgtagtacgggaacccggggtccgtaacggttacccgagttacccgacccgtaacccgtaaaaccgttttaccgaaacggtttaacggaaaccttacccgggtaaccctaacggttacccgttacggaacccgttttaaacgttttaaccgggaaacccggttaaccccgtaaacccggggtttacccggttttaacccgtttaaaccgggttttaaccctttacggggttaaccgaacccgggttaaacccgtaacgggggtaaaccgggtaaccgggggggtaaacccggtaaaccggggtaaacggggtttaacggggtttaccccggtttaacccgtttttaaacccgggtttccgggggtttaaacccggtaacggggtttccccccggtttacccccggtaccccccggtttaaacccggggg

SEQ ID NO: 286684 - DNA, 867 bp, Homo sapiens
  misc_feature: GYAE6OF02HG9T7.51.12.B01.1.454.CMB.1.raw
tcagcgatcgtatacacgaccggtgctcgatttagtagtgtagattccggcgggggagcatcacccagcaaccacatctgtcctctagacgaacccccctgagacgcccccgctccctcacatggactggacctggaggatccttcttgttgggtggcgagcacgacccaacgaaagaccgcccccacctaccccgaggtcgacgtagggtggtgaccgtagtccggtggggactggagggagaaaggaaccggccccggggcctcggaggtagaacggtcctccgtaggaccaacgtacctcgtcggaccttaaccgtacccttgaggtacggaactaaaccaccgttaccgtacggttcgggcggcccgacccgaccggtacccccggaggtaaccggtaacgggtcttaggtagggtacggtaacggttgggtaaggtttacggttttacggtaccggttaagggaccggttaagggttcggggtaccggtaccggttaaaccgtaaaagtttacggtacgacccggtaagtaacggggttggggtttaccggacggggtacgtacctagtaccgtaacggtaccgggacccgggataacccggtctaacgtacccggaaccttaacgtaacgtttaacgacggtaaggttaaccgaccgtaactaacggttcgacggtttaacttacggttaaccgacgtaaccgggtacccggttccgtttaaccgtaagtttaccgggtcggttaaaccgacgttaaccgagggtaacccggtcgggaagtaaccggagggttacccggttaccgtaaccggtttacggtcgggtttaccggacggttaccttacccccgaaccgttaagg

SEQ ID NO: 286685 - DNA, 640 bp, Homo sapiens
  misc_feature: GYAE6OF02IK20K.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaaggcccgggcctcaggtgaacggtctcctgacaacgacctcgtcggtacctacctaccttcgaggtcggaccaaacaaccgtccacgtgggtgccgccgacggccccgtggacgaagggtcgttgaggtggagtgggtagttggtttagtcgtaggagtaacgtggtcgaccgataaagttgcgacacggtagggtaggtttcggggcagggtcagtcgagtcggaccgggactaccgtccactcgaccaactaacgtaacagtacggtaactcgacctagtacgtacgacttagttacgaacgtaccgtacgtccgtacttacgttacgtgtacgacgaagtacgaacggtcgggacggtaccgaggttacggttaccgtacgtttacggttcggtaccggtcgtacccgtcccggtaccccgtaggg

SEQ ID NO: 286686 - DNA, 602 bp, Homo sapiens
  misc_feature: GYAE6OF02HKC83.51.12.B01.1.454.CMB.1.raw
  modified_base (293)..(293): a, c, t, g, unknown or other
  misc_feature (293)..(293): n is a, c, g, or t
  modified_base (306)..(306): a, c, t, g, unknown or other
  misc_feature (306)..(306): n is a, c, g, or t
  modified_base (534)..(534): a, c, t, g, unknown or other
  misc_feature (534)..(534): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctggaggatcctcttcttggtggcagcagccacaagagcccactcccaggtgcgaggtggtgcgagtcgtggggctggaggtgaagacggcccgggctcgagtgaaggtcctcctgacaacgcctcgtggcctacaccttgagtcggacaacgacgtccagtggncgccgacggcccnggacgaggctggagtggagtgggtagttggtttacgtcgtaggacgtaacgtggtacgacgtaactaattagtgaccgaagtgggttacggttcggggactagggtacacgtcgaggtcgggaaccgggactaccgtccgacgtccgaccaactaactaacaggtacggtaactcgaacgtgtacgtcgtacttagttacgacgtaccgacgtccgtacttagttcgngtacgaccgacgaggacggcggacgagaggtacgtcgtagtaggtcggtcgcgtcctcccgaccgtag

SEQ ID NO: 286687 - DNA, 845 bp, Homo sapiens
  misc_feature: GYAE6OF02H63O4.51.12.B01.1.454.CMB.1.raw
  modified_base (602)..(602): a, c, t, g, unknown or other
  misc_feature (602)..(602): n is a, c, g, or t
tcagcgatcgtatacacgaccggtgctcgatttagtagtgtagattccgcggggagcatcacccagcaaccacatctgtcctctagacgaaccccctgagagcccccgctccctcaccatggactggacctggaggatcctcttcttggtggcagcagccacaagacgccccacctccccgaggtgcagggtggtcgctacggtcgtggggctaggtagggtgaaacggaacggccccgggggtacctacgacgggtaggtaacggttcctacccgttgacgaaacgtaccgttcgtcgggtacccttacgaaccccttttacgaacggttacgggaacctaaaaccgtaaaccgtaccccgtaacgtcgggggttaccgcccggaccccgaccggtccccccgttaagggaccgtaaacggggtctttaagggaggtacggtaggtggggttaagtttacgggtttacgttcgtaaggtacggtaacgttcgggtaccggtacccgttaagttaaacgtttcgacgtaccgaacggtagggttccggggtccgggtaaggtacggttacagtttcgtacggtaaccgggaccgggtaaccncccggtactacgtaccgcgtaaaacctaccgttagacgttacggttaaaccgtcgaaccgttattccgaagttaaccgttgttaaccggaaccgtaccgtaacccgttaccgtcgtttaattccggtaagccgttaaccgaacgtaggacccggtaccgggcgtaaccgggtcggttaacggtcctttacggttcggtttacccgggtggtaacccgtcccgttaccccggccgtttaaccgg

SEQ ID NO: 286688 - DNA, 875 bp, Homo sapiens
  misc_feature: GYAE6OF02GMKHN.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcgttggtggctagcagccaactaagacgcccacgtcccaggtgcgaggtggtgcagtcgtggggcgtggacgggtgaacggaacggccccgggggtcctcgaggtacggaacggttcctccgtgaccgaacgtacccgtcgtcggccttacctaccgttaccaggtcggaacctaaaccgtaccgtccctaggtcggggtcgcccggtacccgaccgggccccgtagggaaccgaacgggtccgttaggacggtagggacggtttggggtaacgtttgggtttcgtagtaggtaacggttaacggttcgggtacggacccgtaagttaaacgttcgacggtaccgttaacgggtaaggggttacggggtttaccggggacgttaacgggggtactaccggttacgtaaccgggtaccggggtaaaccccggggtaccttaacccggttcccgaaccggtacccggtaacccttaaaccgtaacccgttaaccgacgttaaccggtaaaccgtaccggaaaccgttacggttaccgtacggttaacgtacggtttaccggaaccgtaccgggtacccgttacccgttaactttaccgttacggttacgtaccgggtacaaccggtacgggaacggtccgggaccggtaacggttacgggtacccggtttaccggtaccgtttacgggtccgggttaacggtcccggttacccgttacccggtaccccgtaacggg

SEQ ID NO: 286689 - DNA, 884 bp, Homo sapiens
  misc_feature: GYAE6OF02IS413.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcacgccaacaagacgcccactcccgaggtgcgaggtggtgcagtcgtggggctggaggtagaacggacgggcccggggtcctcgaggtggaacggtctccgtgacaacgacctcgtcggcctaaccaccttcgacggtaggacctaaaccaaccgtacccgtacggttcggggtcgcccggccccgaccgggtcccccgtaggggaaccggtaaacggggttccgtttacgggaagggttagggtagggttacgggggttagtttttacggggttttaaggttccggttaggggtaaacggtaacggttggggtaacggacccgtaagtttaaattcggtacggtaccgtaacggtagggggttacggggtttccgggggacgttaacggggttaccgtaagtccggtaacgggtacccggggtaaacccggggtacccgtaaccgtcccgtaaccggtacccgtaacccgtaaaccgttaaccgttaacggtaacggttaccggtaaaccgttaccgtaaccgtacggttaacgtcggtaactttaggtacccggtaacgtacccggtaccggttaccgttacgtttacgttaaccgtttcggaacgtaccgaacggttaccggacgggaaccgggtaacggacggttaacgggttccggttaccggttacgtttacgggttccgggttaccggtcccggtttaccccgtccccgttaacccggtacggg

SEQ ID NO: 286690 - DNA, 697 bp, Homo sapiens
  misc_feature: GYAE6OF02FI786.51.12.B01.1.454.CMB.1.raw
  modified_base (293)..(293): a, c, t, g, unknown or other
  misc_feature (293)..(293): n is a, c, g, or t
  modified_base (384)..(384): a, c, t, g, unknown or other
  misc_feature (384)..(384): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactgggacctggaggatcctcttcttggtggcagcagccacaagagcccacctcccaggtgcaggtggtgcagtctggggctggaggtgaagacggcccggggcctcgagtgaaggtctcctgcaacgacctctggctaccaccttcaggtgacaacaaccgtccaagtgggngccgccacggtcccctagggacaagggcttggagtggagtgggagttgggtttagtcgtaggaatacggtggtacgccgactaaagttacngacaacggagggtaggtttcgggggactaggggtctatccgagtcgggacccgggactaccggtaccacgtccgaccgtaacctaacgttacgaacgtacggtaactaccggaaccgacgtacgtacgtaacgttacgttacgtaaccggacgacccggttaccgttaacgtttaaccgttacgttaggtacggtcgtaaaccgaggtaaccgggccggggtaccgggaacgtaacgggtaacggtttcccgtacgtttacgggtttacgggttcggaccggttccccgttacccggtacccccgggttacgg

SEQ ID NO: 286691 - DNA, 640 bp, Homo sapiens
  misc_feature: GYAE6OF02HERLY.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctggaggtgaagacggcccggggctcgagtgaacggtctcctgcaacgacctcgtggccgtacctaccttcagtggacaacgaaccgtaccacgtgggtcgccgccgacggccccgtcggacgaacgggtcgtggagtggagtgggagtggttgtcgtgagtacgtggtgacaataatatgcacgaggtaggttcgggtacacggggggggtacagtcgagtacggaccgggacgtacgtaccgacgtccgaccgaactaactactacgtacggtaactacgacgtacgtctagacgttacgttacgaccgaccgaccgtaccgttacgttacgttacgtcgtacgtacgacgacggacggtacggacggtaccgacgggtacggttacgttacgttacggttcggtaccggacggtccgtacccgtaccccggtaaccgg

SEQ ID NO: 286692 - DNA, 658 bp, Homo sapiens
  misc_feature: GYAE6OF02FXEUZ.51.12.B01.1.454.CMB.1.raw
  modified_base (376)..(376): a, c, t, g, unknown or other
  misc_feature (376)..(376): n is a, c, g, or t
  modified_base (421)..(421): a, c, t, g, unknown or other
  misc_feature (421)..(421): n is a, c, g, or t
  modified_base (435)..(435): a, c, t, g, unknown or other
  misc_feature (435)..(435): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggacggatcctcttcttggtggcagcagccacaagagcccactcccaggtgcaggtggtgcagtctggggctgaggtgaagaacgccccggggcctcagtgaaggtcctccgtgcaagacctctggctacaccttgagtgcaacacgtccacgtggtgccgccgacggtcccctgggaccgaagggtctaggcgtaggagtgggattggtttagtcgtaggacgtacgttggcgccgactaattagngacacgaggtacgttcggggctaggtcagtcagtacggacggacncgtacagtcgccanacttacagttacggactcgaacctgtactcgtacttagttacgacgtaacggtaccggtacccgttacgtttaaccgtttacctgggttaccgaacgtaccggacggtaaccgggccgggtaaaccggtaaccggtacgggtaacccgggtttacctacccggtttacggttaccgggttacccgttaccgggtacccgttaccccgtaccccggttaaacgg

SEQ ID NO: 286693 - DNA, 711 bp, Homo sapiens
  misc_feature: GYAE6OF02HEN5E.51.12.B01.1.454.CMB.1.raw
tcagcgatcgtatacacgaccggtgctcgatttagtagtgtagattccggcgggggagcatcacccagcaaccacatctgtcctctagagaacccctgagagccccgctcctcaccatggactggacctggaggatcctcttcttggtgcacgcagccacgaagagcccactcccaggtgcaggtggtgccgagtcgtggggctgaggtagaagacggcccgggctcagtgagtctctgacaagtacctgtcggcgtactccgttcgagtcgacaactaccgtccagtcggtgaccgaccgacggtcccctagggacaacgggtccttaggtaggtaggacgtgggagttcggtttacgtcgtaggacgtaacgtgggcgtaccgacgttaaattacggtacgacgtacgaagggtacggttttcggggacgtaggggtccacgttacgtacggtaccgggtaaccggggaaccgtaaccggtacccgtaacgtccgtaccgaacgtaaccgttaacgaacgtacggaacgtaccgaacgtacgtacgtagaaccgttagttccggaacgtaccgtaccggtccgttacgttacttacgggtcgtacgtaccgacggtaggtaacggacggtacggaaccaagggtacggtacccgttcgttaaccggttcgggttaccggacgggtccctttacccggccccttaacggg

SEQ ID NO: 286694 - DNA, 707 bp, Homo sapiens
  misc_feature: GYAE6OF02I00GK.51.12.B01.1.454.CMB.1.raw
  modified_base (144)..(144): a, c, t, g, unknown or other
  misc_feature (144)..(144): n is a, c, g, or t
  modified_base (252)..(252): a, c, t, g, unknown or other
  misc_feature (252)..(252): n is a, c, g, or t
tcagcgatcgtatacacgaccggtgctcgatttagtagtgtagattccgcgggggagcatcacccagcaaccacatctgtcctctagacgaacccctgagacgccccgctcctcaccatggactggacctggaggatcctcttnttggtggcagcagccacaagacgcccactcccgaggtgcaggtggtgcagtctggggctgaggtgaacgacgccgggcctcgagtgaacggtctcgtgcagacctcgngctacgacttcgagtggcaacaacgtcacgtgggtcacgccgacggtccctaggtaccgtaaggtcttgacggtaggacgtggtattggttatcgtgacgtcgtaggtcgccgtaagtaattcgcgacgtaacgtgggtacgggtttaggggacgttaacgggtcgtaacgttacgaggtaccggggacccgggtaaccgtaaccgggccttacggaccccggtaacaaccggttaaaccttaaccgtacggtacggtaaccgttacgggtacccctagttaccgtttacgaaccgttacggtttacgaaccggtacccgtacggtacccgttacgtttaacgttacgtacgtcgaacgacgtacgaacggacgggtaccggtaactcggtacgtaccggttacgtaccgggtttcggtaaccggtaaggtccccgtacccgttcccgtaaccgg

SEQ ID NO: 286695 - DNA, 636 bp, Homo sapiens
  misc_feature: GYAE6OF02JZC63.51.12.B01.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (295)..(295): a, c, t, g, unknown or other
  misc_feature (295)..(295): n is a, c, g, or t
  modified_base (301)..(301): a, c, t, g, unknown or other
  misc_feature (301)..(301): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttctggtggccagcagccaacaagacgcccactcccaggtgcgaggtggtgcagtctgggctgaggtgaagacgccgggctnagtgagtctcngcagctngctacnctcagtgacaacacgtcacgtggcncgacacggccctggacaggcttgngtaggntgggattggttacgcgtagagtacgttggcgccgagtaaattgcgacaggaggttacgggtttcggggctagggtctagtctaacggtacgggaccgggtagtaaccgttcgacgttaccggaccctaaaccgtaacgtttacaaggttacggaaccgttacggaacccgtacggttacgtacgtacgttagtttaacggaccgtaccggtacccggtccggttacttacgttacgtcggttagaaccggacgaggaacggtccgggaacggtaacggtacggtacggttacgttcgttaacggtcggtaccggcgtaccgtccctacccgtagg

SEQ ID NO: 286696 - DNA, 167 bp, Homo sapiens
  misc_feature: GYAE6OF02IGM97.51.12.B01.1.454.CMB.1.raw
  modified_base (157)..(167): a, c, t, g, unknown or other
  misc_feature (157)..(167): n is a, c, g, or t
tcagcgatcgtatacacgaccggtgctcgatttagtagtgtagattccgcgggcacgaccggtgctcgatttagagtgctacgaagggaaagggcagcgtcactctgttcccaccctcctctcgtagcactctgagcgggctggcaaggcgcatagnnnnnnnnnnn

SEQ ID NO: 286697 - DNA, 826 bp, Homo sapiens
  misc_feature: GYAE6OF02FKC2Z.51.12.B01.1.454.CMB.1.raw
tcagcgatcgtatacacgaccggtgctcgatttagtagtgtagattccgcgggggagcatcacccagcaaccacatctgtcctctagagaaccccctgagacgccccgctcctcaccatggactggacctggaggatcctcttcttggtggcagcagccacaagacgcccacctcccaggtgcgaggtggtgcagtcgtggggctggaggtgaagacggcccgggctcgagtgaagtcctctgcacgacctgcggctactacctcgagtcggacaacgacctaccgacgtggcgccgaccgaccggtccccgtagggaccgaacgggtcgtcggaggtacgggtagtgggtagtttaggttacgtcgtagtacgtaacgtggggtacgtaccgtacgtaaacgtttagtagaccgtaacggtaacggggtacggtttcgggggaacggttaccgggtactaccgtacggtacggttaccgggggaacccggtaacggtacccttcccggaaacgttaccccggaaaccccttaaccgtttaaaacccgttaacggtacccgttaaacgggttaaccgttaacccggaacccttccgggtaccgtagttacgtttaaaccgttaccgggtaaaccaacccgggttaacccggttccgttaaccttttaacggttaccgttaacggttaccgtaaccggaaccgtaacgggtaaccgggaccgggttaacggaaccgttaaccggggtacgtttaccggggttaccttttaaccggggttcggttaaccgggtacctcccccggtttacccggtaccccggttaacgg

SEQ ID NO: 286698 - DNA, 723 bp, Homo sapiens
  misc_feature: GYAE6OF02FR452.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagacgcccgggctcagtagaggtctctgacaagcctctggctacacttcagtggcaacacgtccacgtggtagccgtccacggcccctggacaagggtcttggacgtggagtcggggattggttttactcgtagacggtaacgtgggttacgacccggtaataaaacgtttgtacggacctaacggtacgggtaacgggttttccgggggacttaacgggggttacctagttaccggtaggtaccgggaacccggggtacgtaacccggtacccgtacgtccgaacccgtaaaccgtaaacccgttacctaaggtacgggttaaacctacggtaaaccctagttaaccgtagttaacctacgttttacgaaccggtaacccgaccgggtacccgttactttaacgttacttcggtacgtacgacgtacggaacggtcgggacggtaacggacggttacggttaccggtccgtttagggtcggttaccggtcggtaccttccccgtaccggtaacgg

SEQ ID NO: 286699 - DNA, 773 bp, Homo sapiens
  misc_feature: GYAE6OF02GDVBV.51.12.B01.1.454.CMB.1.raw
  modified_base (168)..(168): a, c, t, g, unknown or other
  misc_feature (168)..(168): n is a, c, g, or t
  modified_base (654)..(654): a, c, t, g, unknown or other
  misc_feature (654)..(654): n is a, c, g, or t
  modified_base (766)..(766): a, c, t, g, unknown or other
  misc_feature (766)..(766): n is a, c, g, or t
tcagcgatcgtatacacgaccggtgctcgatttagtagtgtagattccgcgggggagcatcacccagcaaccacatctgtcctctaggagaaccccctgagagccccgctcctcaccatggactggacctgggaggactccttcttctggtggcagcagccacagacncccactcccgaggtgcaggtggtgacctaggtcgtggggcttaggaggtagaacggacggccccggggtctcaggtacgaaggttcctccgtaggacaacgtacccgtcgtacgtaccttacctacctttcggacgttcggaacctaaacccggtaaccttacccgacggttggggtccgacccggtacccgaccgggttccccgagggtaaccgcggggtcgtttacggaggttcggaggtaggtacggtttaggttccgttacggttaacggacggttacggtaccggggtacggtacccgaagttttaaacggtttgaccgtaaccgtacgggttacgggggttaaccggtttcggggacttagggtaccgttagaccggtggtaccgggacggtaccgacgtaccgtacgtacgaaccacgttaacgacgtagtacgtacgacgtacctagcttacgcttacgacacgtcggcccttacgtnttacgtacgtcgtacgaccgacgacgggtacgccggggtacgtaaggtccggtaccgttacgttaccgggtttacgtccgggttaccggccgtttaccccggttacccccgngggtacg

SEQ ID NO: 286700 - DNA, 796 bp, Homo sapiens
  misc_feature: GYAE6OF02F11WX.51.12.B01.1.454.CMB.1.raw
tcagcgatcgtatacacgaccggtgctcgatttagtagtgtagattccgcgggggagcatcacccagcaaccacatctgtcctctagagaacccctgagagccccgctcctcaccatggactggacctggaggatcctcttcttggtggcagcagccacaagagcccactcccaggtgcagggtggtgcagtcgtggggctggaggtgaagacggcccggggcctcagtgaaggtctcctgcaagccctcgtggctacaccttcgagtggcaacaccgtccacgtggggtgccgccgacggtcccccgtggaaccgaacggggctttaggaggttcgggaaggtcggggaagttgggtttaagttcgttaggtaaggaaaccggttggggtcggacccgtagtaaaacgttgttacgggaccaacggtaacggggtacgggttttccggggggacgtaacgggggttaccgagttacggtagggttaccggggaaacccgggggtaccgtaaccccgggttaccctaacgttacccggacccgtaaaccgtaaacccgtttaaccgaacggttaacgggtaaacctaccgggtaacctaacggttaccgtacgtaaccttacgtttacggaaccggtaaccgtaccgggtaccgttaccgttacttaaccgtcgtgaccgtacgtaacgggacggaccgggtacgggaaccggtaacgggtacggttaccgttacgtttaccgggttcgggtttaccggtacgggtccccgtttacccgtacccccggttaacggg

SEQ ID NO: 286701 - DNA, 643 bp, Homo sapiens
  misc_feature: GYAE6OF02JDFX5.51.12.B01.1.454.CMB.1.raw
  modified_base (220)..(220): a, c, t, g, unknown or other
  misc_feature (220)..(220): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
  modified_base (312)..(312): a, c, t, g, unknown or other
  misc_feature (312)..(312): n is a, c, g, or t
  modified_base (519)..(519): a, c, t, g, unknown or other
  misc_feature (519)..(519): n is a, c, g, or t
  modified_base (556)..(556): a, c, t, g, unknown or other
  misc_feature (556)..(556): n is a, c, g, or t
tcagcgatcgtatacacgaccggtgctcgatttagtagtgtagattccgcgggggagcatcacccagcaaccacatctgtcctctagagaaccccctgagagcccccgctcctcaccatggactggacctgggaggatcctcttcgttggtggcagcagcccaacaaagcgccccactccccaaggtgcaggtggtgacagtcgtggggctggagggtanaagacggcccgggctcgagtgacggtcctctagacaacgccncgtacgcctaccnccttcgagtgaccaactacgtccacgtggcgccgccncggccccgtaggacgtacgggtcttggaggtggaggtagggtagtttagggtttacgtcgtaaggtaacgtacgtcggtacgaccgtaataaagttcgtagactaacggtaggtcgggttaccgggagtaggtcagtcgacggtccgggaaccggctaccgcctactccccgactaacttacctagacgaggtacctagactgtacngtactacgtcgaccgtagtccgtacttcgtacttacnggacacgaacgaggacggcggcgaaggtcggtacgttcggtaaccgttcggttacggtacgttaccgtcccgtacccgtcccggtag

SEQ ID NO: 286702 - DNA, 696 bp, Homo sapiens
  misc_feature: GYAE6OF02HXTQB.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctgggaggactcctcttcgttggtggcagcagccacaagacgcccactcccgaggtgcgaggtggtgcagtcgtggggctggaggtagaaggaacggcccgggtacctcgagtggaacggtctccgtgacaacgtcctacgtggcctacctaccttacgagtacggactaaccgaaccgtcgacgtgggtcgaccggcccgaccggtccccgtaggaaccggaaacgggtcgttaggtaggttaggacggttagggtacgtttagggttttacgttcgtacggaacggtaacgtcgggtaccgcgtaaacgttaaattgacgtacgaacggtacggttaggttcgggacgtagggtacgtacgtacgtacggtacgggtacccgggtactaccggtactacgtcccgactaacgtaacctacgagtacggtaactacgaccgtacgttgtaacgacttacgtacgaccgtacgtccgtaactgttacgtcgtcgaggactaagacgcggacggcgacgtagttgtaccgttcgtacggttcggcgtacggtaccctcccggtaccgtag

SEQ ID NO: 286703 - DNA, 858 bp, Homo sapiens
  misc_feature: GYAE6OF02IUTH9.51.12.B01.1.454.CMB.1.raw
  modified_base (165)..(165): a, c, t, g, unknown or other
  misc_feature (165)..(165): n is a, c, g, or t
tcagcgatcgtatacacgaccggtgctcgatttagtagtgtagattccgcgggggagcatcacccagcaaccacatctgtcctctagagaaccccctgagagccccgctcctcaccagtggactggacctggaggatcctcttcttggtggcagcagccagaagngcccactccccgaggtgcaggtgtacgcagtcgtgggactggaggtagaacggaacggtccccggggcttacgaggtacggtaacggtctcccgtaggaccaacggacccttcgtaggtacctaacctacccgttagacggttacggaaccgaaaccgtaaccgtcccacgttaggggtaccgaccgtaccgaccggtccccgtaggaaccgtaacgggtcttaggtacgtgggtacgttacgggtagttacggtttagcgttacggtaagtacggttgggcctaccggtaaccgtttaaagttcgagacgtaacggttaggggtacgtttcggggaacgttacggggtacctacggttacgtaacgtacccggggtaaccgggtaccgtaaccggttaccgtaacggttacccgtaacccgtaaacgttaaccgttaaccgtaacggtaaccggaaccgttaacggtacccgttaacgtaaccgttacggtaaccttaagggtttaccggaaacccgtaccgtaacccggggttacctttaacgtaaacccttttacgggtacgttaccggtaacccgtaagtacgggaaaccgggttccggaaaccgggttacgtaacgggttacggttacccgtttacgttacggttaccggtcgggtaaccctttcccggtacccgtacccgttaaggg

SEQ ID NO: 286704 - DNA, 786 bp, Homo sapiens
  misc_feature: GYAE6OF02G5WX0.51.12.B01.1.454.CMB.1.raw
  modified_base (230)..(230): a, c, t, g, unknown or other
  misc_feature (230)..(230): n is a, c, g, or t
  modified_base (600)..(600): a, c, t, g, unknown or other
  misc_feature (600)..(600): n is a, c, g, or t
tcagcgatcgtatacacgaccggtgctcgatttagtagtgtagattccgcgggggagcatcacccagcaaccacatctgtcctctagacgaaccccctgagagcccccgctcctcaccatggacctggacctggaggatcctcttcgttggtggcagcacgccacaagagccccactcccgaggtgcagggtggtgcagtcgtgggctggagtgaagacgcccgggctgngtgaaggtctacctgacaacgcctcgtgacctacgtaccttacgtaggtcggaccaaacctaaccgtccgtacggtgggtcggcccgcccgaaccgggcccccgtaaggggaccgtaacggggtaccttgggaggtaggaacggttaggggttacgtttaggggttttacgtccgttaaggacggttaaacggtcgggttccgaaccgtaacgtaaaaagttctaccgggaacgtaccggtaaggggttaccggggtttccgggggtacggtaacggggttacctacgtacgtaacggtaccggggaacccgggtacgtaccccgtccgtaacgtcccgaaccacttaaagtacctacggtacggtaacnccgtaaccgtgtactagtacttacgttacgaacccgtaccggtaccggtttcccttacttaaccgttcggtacgtaaccggtaaccgacggtacgggaaccggtacggaccgggaaccgtacggttaccggttccttaccggtttaggtcgggtaaccggaccttcccgtcccgtacccggtacgg

SEQ ID NO: 286705 - DNA, 850 bp, Homo sapiens
  misc_feature: GYAE6OF02F9LV5.51.12.B01.1.454.CMB.1.raw
  modified_base (57)..(57): a, c, t, g, unknown or other
  misc_feature (57)..(57): n is a, c, g, or t
  modified_base (108)..(108): a, c, t, g, unknown or other
  misc_feature (108)..(108): n is a, c, g, or t
  modified_base (608)..(608): a, c, t, g, unknown or other
  misc_feature (608)..(608): n is a, c, g, or t
tcagcgatcgtatacacgaccggtgctcgatttagtagtgtagattccgcgggggancatcacccagcaaccacatctgtcctctagacgaacccctgagagccccgntcctcaccatggactggacctggagactcctcttctggtggcagcacgccacaagacgccctacgtcccgaggtcgacgtagggtggtgcagtcgtggggctaggaggtaggaagaccgggccccgggtactcgaaggtcggaacggttcctcgtacgacaacgtacccgttcgtacggaccttaaccgccgtttacgacggttacgaacctaaaccgtacccgtccgttagttcggggtacgccccggtcccggaaccgggttcccccgtaagggtaaccgtacggggttacctttagggtaacgggttacggtagggttaccggggttaggttttaacggggtttttacggtaccggttagggaaaccggttacggttccgggttaccggaaccccgtaagttaaaacttcggacggtaacgtacgggtacgggttacgggtttcgggaccgtttaggtactacgttacgaggtcgggaacccgggtatcccggtacncgtaaccgtactaaccgtaacttaccgagttaaccggcttaacgaccgtagtaccgttcgtaacttcgttaacggacctaacgggtaccgttcttactacgttaacgacggtcgaagtaccgtaggggtaaccgtaccgggaccggttaacggttacggtaacccgggttttaccgtttccggaacggtttttcggggaaacccgtccgggttcccccttaaaccccgttccgggaaccggg

SEQ ID NO: 286706 - DNA, 714 bp, Homo sapiens
  misc_feature: GYAE6OF02JCX4C.51.12.B01.1.454.CMB.1.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (290)..(290): a, c, t, g, unknown or other
  misc_feature (290)..(290): n is a, c, g, or t
  modified_base (541)..(541): a, c, t, g, unknown or other
  misc_feature (541)..(541): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcagggtggtgcagtctggggctgaggtgaggaagccggggcctcgngtgaggtctcctgcaacgacctctggctaacnccgttcagtggacaacacgtccacgtgggtgcncccgtacggccccgtaggacgtaacgggtcttcggaggtcggacgtggggaattcgggttttaagtccgtggaacggtaagttcgggtcgtaccggacttaaaagttcggtacggcaccggagggttacggtttccgggggccgtagggttacctagtacgtacggtaccgggaaccgggtacctacggtaccgtactacccggtaccgaacctaaaccgttaccgtaggtaacgtacgtaccggtaaacnccggtactacggaccgttagtttaccggaccgtaccggtaccggtacccggttaccgttaacgttacgtacggtaagtccgaacgtaggaaacgggtccggacgggtacgaaggttccggtaccgttcgtttaaccgtgggttccgacggtccccgtacctccccgtaacggg

SEQ ID NO: 286707 - DNA, 902 bp, Homo sapiens
  misc_feature: GYAE6OF02IUVVQ.51.12.B01.1.454.CMB.1.raw
tcagcgatcgtatacacgaccggtgctcgatttagtagtgtagattccgcgggggagccatcacccagcaaccacagtctgtccgtcagagaaccccctgagagccccgctcctcaccatcggactggaccctgggacggagtcctcttcttcggtggcagcagccacaagacgaccctactcccaggtgccgtaggtggtcgctacgtccgtaggggtactcggtaggttagaacggaacggccccggggggtaccttccgaaggtacggtaaacgggttcctcccgttagtaaccgaaaccggtaccgttccggtacggtaccttaaccgtaacccgtttggtaacggttcggaacccttaaaaccgtaccgttccgtaacggtgggtaccgccgtaccggaccggtaccccgtagggaaccgtaagggtccttaggaaggtcgggtaacgtcgggtaaacgttcggtttaacggtacgttaacggtaaaccgttaccggtacggttacggtaccccggtaaacttaaacgtttaccgggaccggtaacggtacgggttacggggttacggggtttacccgggaaccgttaccgggggtaaaccttaaccgtaccggtaacgggtaacccgggtacccgggtaaacgtaacccgttccggacgttacccgaaccgaaacgttaacgtaacgtaacggtcggaaccgtacggaccgttacgtacgtagtaccttacggttaaccaccggtaccgtaccgtaccttaccgttaggttcccgaaggttccgaacgacggtaggaccggtccgggaaaccgtaggtaacgtaaccgggttactaccgggtttacggtaaccggggtttccaccgggtttaccctacccgggtaacccttaaggg

SEQ ID NO: 286708 - DNA, 719 bp, Homo sapiens
  misc_feature: GYAE6OF02IRQ0W.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaaagacgcccactcccaggtgcaggtggtgcagtcgtggggctgaggtgaagaacgcccggggcctcgagtgaacggtctcctgacaagacctcgtggctactaccttcgagtcggacaaccgaacgtccaacgtgggtcgccgtaccgacggcccccgtaggaacgtaacggggtcgttacggagtggaggtacggggtagttgggttttaacgtcgtaggaacgtaaccggtgggttcgaccgtaacgtaaaattcgtacggactacggtagggttacggtttacggggacgtaagggtacgtagtaccgtagttaccgggaaccggggtaacgtaccggtaccgtaacgtcccggaacctaacgtaaaccgtttacgtaagttaacggaaacttacgaacccgtagttaccgtaagtacgttacgtacgtaaccgtaccgaccgttacgtaacttacgttacgtacgtccgaagtaaccgaaggacggacggtaacgaaggtaggtcgtacgttacgttcggttacggtaccgccgtccgtacccgtacgtaacgg

SEQ ID NO: 286709 - DNA, 792 bp, Homo sapiens
  misc_feature: GYAE6OF02HUMEY.51.12.B01.1.454.CMB.1.raw
  modified_base (168)..(168): a, c, t, g, unknown or other
  misc_feature (168)..(168): n is a, c, g, or t
  modified_base (191)..(191): a, c, t, g, unknown or other
  misc_feature (191)..(191): n is a, c, g, or t
tcagcgatcgtatacacgaccggtgctcgatttagtagtgtagattccgcgggggagcatcacccagcaaccacatctgtcctctagagaaccccctgagacgccccgctcctcaccatggactggacctggaggatcctcttcgttggtgcagtcagccacaagacncccactcccgaggtgcaggtggncagtccgtgggctggaggtgaagacggccgggtctgtacgaggtacggtcctccgtcgacgtaaacgtcctcgtcggacttaccgtaccgttcgtacggttcggaccaaacgtaaccgtacccgtaacggtcgggtcgacccgcccgtacccggtccccgtacggtaaccggtaacgggtccgttaggtaccggtaggtaacggtacgggttaggttacggtttacgttacgtaggtaacggtacggttacggtccggaccgtaacgtaaagttcgtacgaacgtaacggtacgggtacgggtttacggtaccggtaagggtacctagtaaccgtaaggtacccgggtaaccggggaacgtaccgggtacctcgtaaccgtactaaaccgtaaactacggttaacgaaccggtaacgtacgtaacctaccggtacgttaacgacggttaacgttaccggaaccggtaaccgtcccgggtacctttaccgttaacgttacgtcgggtaccgaacgtaccgaacggtcggagggtaacccgaacggttacgggtcgtttaccgacgttacggtaggtccgcggtcccttcccgtaacgtccgg

SEQ ID NO: 286710 - DNA, 755 bp, Homo sapiens
  misc_feature: GYAE6OF02F5IPD.51.12.B01.1.454.CMB.1.raw
  modified_base (450)..(450): a, c, t, g, unknown or other
  misc_feature (450)..(450): n is a, c, g, or t
tcagcgatcgtatacacgaccggtgctcgatttagtagtgtagattccgcgggggagcgatcacccagcaaccacatctgtcctctagagaacccctgagagccccgctcctcacctatcgactcggacctgaggactcctcttctggtgcaggcagccacaagcgcccactcccaggtgcaggtggtgcagtcgttgggctggaggtgaaggaacgcccggggcctcgagtaggaacggttctcctgacgtaacgtaccctcgcggtcctactaccttacgaggttcggaccaaacctaacgtccaacggttgggacgccgacccggtacggtacccccgtaggaaccggtaacgggtaccttaggtaccggtaggtaaccgtgggaacgtttagggttttacgtaccgttaaggaaccgtaacgtcggtacgaccgtactaaggttcngtacacgtagggacgttcgggacgtacgtacgatacgtagttacggaaccggtaccgtaccgtacgtacgtacgaccgtaacttaacgtaccgaagtaccggtaacgtacgtaccgtaagtacgtacgtaaccgtagtttaaccggaaccgtacgtacccggttccgttacgttaacgttaccgtacgttccgaaccgttaccggaacgtacggtaccggtaacgggaacctaacgggttacgttaacgtcccgttaacggtttcggtaaccggttcgtacccgttaccccgtacgttaacccgg

SEQ ID NO: 286711 - DNA, 693 bp, Homo sapiens
  misc_feature: GYAE6OF02JTP9H.51.12.B01.1.454.CMB.1.raw
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccaacaagacgccccacctcccaggtgcgaggtggtgcagtcgtggggctggaggtgaaggaacggcccgggctcgagtgaacggttcctccgtgacgaacgacccttcgtcggcctaacctaccttcgaggtacgacaaacgaaccgtccacggttacgggtcgccgaccgccggaccccgtggacggaaggtcttaggacggtggaggtggtagttggtttacgtgtaggaagtacgtggtacgacgtaactaaagttacgacgtacgtacggtaggtacgggtttacgggacggtacgggtcacgttacgacggtacgggacccgggactaccgtacgacggtaccacctaacgtaacctacgtaacgtcgacgtacgaaccgtcgtctacgtacttagtacgaccgtacggtccgtaccgttacgttacttacgtcgtacgcgtaacgacgggaacgtaccgggacgtaacgtacgggtaccgttacgttaccggtacgttccggtacgtacgtcccgtccgtacccgtacgg

SEQ ID NO: 286712 - DNA, 624 bp, Homo sapiens
  misc_feature: GYAE6OF02F5ODQ.51.12.B01.1.454.CMB.1.raw
  modified_base (546)..(546): a, c, t, g, unknown or other
  misc_feature (546)..(546): n is a, c, g, or t
tcagcgatcgtatacacgaccggtgctcgatttagtagtgtagattccgcgggggagcatcacccagcaaccacatctgtcctctagagaaccccctgagagccccgctcctcaccatggactggacctggaggatcctcttcttggtggcagcagccacaagagcccactcccaggtgcaggtggtgcagtcgtggggctgaggtgaagaacggccccggggtctcaggtgaacggtcctccgtgcaaagaccttcgtcggctacaccttcgagtggaccaaacaccgtccacgtgggtcgccgccgacggccccgtaggacgaggtcttggaggtggtagtgggtagttgggtttacgcgtaggacgtaacgtggtcgaccgtataaattgcgacgacgtagggttaggttcggggctagggtctagcgtagtaccgggaaccgggtacctacgtcctacgtccgaccaaacgtaaccttacgaggtacgaactcgacgtacgtctagacttagttcgacgacgtacggtccttagtattacgngtcgacgtagacgacggtcgggacgacggtagtacggttctagttcggtcggttccgacgtccctacccggtcctagg

SEQ ID NO: 286713 - DNA, 171 bp, Homo sapiens
  misc_feature: GYAE6OF01A9D8Z.13.37.D04.1.454.CMB.1.raw
  modified_base (171)..(171): a, c, t, g, unknown or other
  misc_feature (171)..(171): n is a, c, g, or t
tcagtcacgtactacacgaccggtgctcgatttagtagcatactgttgggtttggggaagaggaagactgacggtccccaggagttcaggtgctgggcacagcggccctgggctgcctggtcaaggactacttcctagtacgtgactgagcgggctggcaaggcgcatagn

SEQ ID NO: 286714 - DNA, 173 bp, Homo sapiens
  misc_feature: GYAE6OF01DAGGC.13.37.D04.1.454.CMB.1.raw
  modified_base (171)..(173): a, c, t, g, unknown or other
  misc_feature (171)..(173): n is a, c, g, or t
tcagtcacgtactacacgaccggtgctcgatttagtagcatactgttgggtttggggaagaggaagactgacggtccccaggagttcaggtgctgggcacagcggccctgggctgcctggtcaaggactacttcctagtacgtgactgagcgggctggcaaggcgcatagnnn

SEQ ID NO: 286715 - DNA, 174 bp, Homo sapiens
  misc_feature: GYAE6OF01BQNNV.13.37.D04.1.454.CMB.1.raw
  modified_base (173)..(174): a, c, t, g, unknown or other
  misc_feature (173)..(174): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagnn

SEQ ID NO: 286716 - DNA, 173 bp, Homo sapiens
  misc_feature: GYAE6OF01BEZRR.13.37.D04.1.454.CMB.1.raw
  modified_base (173)..(173): a, c, t, g, unknown or other
  misc_feature (173)..(173): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagn

SEQ ID NO: 286717 - DNA, 190 bp, Homo sapiens
  misc_feature: GYAE6OF01DZS3B.13.37.D04.1.454.CMB.1.raw
  modified_base (189)..(190): a, c, t, g, unknown or other
  misc_feature (189)..(190): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccacctcggtcactctgttcccaccctcctctagtacgtgactgagcgggctggcaaggcgcatagnn

SEQ ID NO: 286718 - DNA, 190 bp, Homo sapiens
  misc_feature: GYAE6OF01D3TBW.13.37.D04.1.454.CMB.1.raw
  modified_base (189)..(190): a, c, t, g, unknown or other
  misc_feature (189)..(190): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccaccctcctctagtacgtgactgagcgggctggcaaggcgcatagnn

SEQ ID NO: 286719 - DNA, 192 bp, Homo sapiens
  misc_feature: GYAE6OF01DD3TI.13.37.D04.1.454.CMB.1.raw
  modified_base (189)..(192): a, c, t, g, unknown or other
  misc_feature (189)..(192): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccaccctcctctagtacgtgactgagcgggctggcaaggcgcatagnnnn

SEQ ID NO: 286720 - DNA, 189 bp, Homo sapiens
  misc_feature: GYAE6OF01DKSBC.13.37.D04.1.454.CMB.1.raw
  modified_base (189)..(189): a, c, t, g, unknown or other
  misc_feature (189)..(189): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccaccctcctctagtacgtgactgagcgggctggcaaggcgcatagn

SEQ ID NO: 286721 - DNA, 565 bp, Homo sapiens
  misc_feature: GYAE6OF01BITY5.13.37.D04.1.454.CMB.1.raw
tcagtcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaagggctggagtgggtttcgggtattagtgctcttgatgatagcacatactatgcagactccgttaaggccgcttcaccatctccagagacaattccaagaacacgctatatctgcagatgaacagcctgggagccgaggacacggccgtttatcactgtgcgaaagatattgtaatgatggtagctgctactactactttttgacttacgtgggccagggaaccctggtcaccgtctcttcagcctccaccaacggcccatccgtccttccccctggccaccctcctccaacgacgccacctcgtcggggccacacggccggcccgtgggcctcggcccgtgggtccgaacggtacttaccgttccctacgttacgtcgtactcggaaggccgggcgtgggaccgg

SEQ ID NO: 286722 - DNA, 174 bp, Homo sapiens; identical to SEQ ID NO: 286715
  misc_feature: GYAE6OF01EFPLI.13.37.D04.1.454.CMB.1.raw
  modified_base (173)..(174): a, c, t, g, unknown or other
  misc_feature (173)..(174): n is a, c, g, or t

SEQ ID NO: 286723 - DNA, 173 bp, Homo sapiens; identical to SEQ ID NO: 286716
  misc_feature: GYAE6OF01DZYZK.13.37.D04.1.454.CMB.1.raw
  modified_base (173)..(173): a, c, t, g, unknown or other
  misc_feature (173)..(173): n is a, c, g, or t

SEQ ID NO: 286724 - DNA, 180 bp, Homo sapiens
  misc_feature: GYAE6OF01CFWAD.13.37.D04.1.454.CMB.1.raw
  modified_base (173)..(180): a, c, t, g, unknown or other
  misc_feature (173)..(180): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagnnnnnnnn

SEQ ID NO: 286725 - DNA, 421 bp, Homo sapiens
  misc_feature: GYAE6OF01E0M51.13.37.D04.1.454.CMB.1.raw
  modified_base (414)..(421): a, c, t, g, unknown or other
  misc_feature (414)..(421): n is a, c, g, or t
tcagtcacgtactacacgaccggtgctcgatttagtagcatactgttgggtttggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctcggtcactctcgttcccgccctcctctagtacgtgactgagcgggctggcaaggcgcatagnnnnnnnn

SEQ ID NO: 286726 - DNA, 415 bp, Homo sapiens
  misc_feature: GYAE6OF01CYUU4.13.37.D04.1.454.CMB.1.raw
  modified_base (411)..(415): a, c, t, g, unknown or other
  misc_feature (411)..(415): n is a, c, g, or t
tcagtcacgtactacacgaccggtgctcgatttagtagcatactgttgggtttggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctcggtcactctgtcccgcctcctctagtacgtgactgagcgggctggcaaggcgcatagnnnnn

SEQ ID NO: 286727 - DNA, 175 bp, Homo sapiens
  misc_feature: GYAE6OF01B9O8R.13.37.D04.1.454.CMB.1.raw
  modified_base (173)..(175): a, c, t, g, unknown or other
  misc_feature (173)..(175): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagnnn

SEQ ID NO: 286728 - DNA, 173 bp, Homo sapiens; identical to SEQ ID NO: 286716
  misc_feature: GYAE6OF01BG0UA.13.37.D04.1.454.CMB.1.raw
  modified_base (173)..(173): a, c, t, g, unknown or other
  misc_feature (173)..(173): n is a, c, g, or t

SEQ ID NO: 286729 - DNA, 173 bp, Homo sapiens
  misc_feature: GYAE6OF01A73G4.13.37.D04.1.454.CMB.1.raw
  modified_base (172)..(173): a, c, t, g, unknown or other
  misc_feature (172)..(173): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcggctggcaaggcgcatagnn

SEQ ID NO: 286730 - DNA, 189 bp, Homo sapiens; identical to SEQ ID NO: 286720
  misc_feature: GYAE6OF01EISPS.13.37.D04.1.454.CMB.1.raw
  modified_base (189)..(189): a, c, t, g, unknown or other
  misc_feature (189)..(189): n is a, c, g, or t

SEQ ID NO: 286731 - DNA, 420 bp, Homo sapiens
  misc_feature: GYAE6OF01EVGQT.13.37.D04.1.454.CMB.1.raw
  modified_base (408)..(408): a, c, t, g, unknown or other
  misc_feature (408)..(408): n is a, c, g, or t
  modified_base (414)..(420): a, c, t, g, unknown or other
  misc_feature (414)..(420): n is a, c, g, or t
tcagtcacgtactacacgaccggtgctcgatttagtagcatactgttgggtttggggacagccatcatcacctgctctggagataaattgggggagaaatttgcttcctggtatcagaagaagccaggccagtcccccgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgacccgtctaggtcagcccaaggctgccccctcggtcactctgttccccaccctcctctataccgtgactgagcgggctggcaaggcncatagnnnnnnn

SEQ ID NO: 286732 - DNA, 523 bp, Homo sapiens
  misc_feature: GYAE6OF01EO16Z.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaagttgggggataatttgcttcctggtatcagaagaagccaggccagtcccctgtggtggtcatttatcaagataccaaacggccctcagggatccctgagcgattctctggttccaactctagggaatacagccactctgaccatcaacgggctcaggctatggatgaggctgactattactgtcaggtgtggacagcaacacctatgtggtattcggcggagggaccagcgtcgaccgtcgtacggtcacggcccgaaggcctcggccccctcggtccacttctcgttaccccc

SEQ ID NO: 286733 - DNA, 547 bp, Homo sapiens
  misc_feature: GYAE6OF01CRC3C.13.37.D04.1.454.CMB.1.raw
  modified_base (237)..(237): a, c, t, g, unknown or other
  misc_feature (237)..(237): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaagtgggganaatttgcttctggtatcagaagaagccaggccagtcccctgtggtggtcatttatcaagataccaaacggccctgagggactccctgagcgattctctggttaccaactcgtagggaatacgacgccactctgaccataccgaacgggactcgaggctagtggatggaggtctaggacttattacgtgtcgaggtggtagggacagcaacacctagtggtggttattcgggacggaggaccaggctcgaccgtcgtacggcacggcccgaggcctcggccccctacggtccaccttcgtccgttaccccc

SEQ ID NO: 286734 - DNA, 545 bp, Homo sapiens
  misc_feature: GYAE6OF01B7YZK.13.37.D04.1.454.CMB.1.raw
  modified_base (239)..(239): a, c, t, g, unknown or other
  misc_feature (239)..(239): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaagttggggganaaatttgcttcctggtatcagaagaagccaggccagtcccctgtggtgtcatttatcaagatacccaaacggccctcagggatcccgtgagcgattctctggttccaactctagggaatacgagccactctacgaccatccgaacgggactcgaggctagtggatgaggtctgacttattactgtcgaggtgtgggacagcaacactagtgtggtacttcgggcggaggaccaggctgaccgtcgtacggtcacggcccgaaggtcctccgtcccccgtcggtacccaccttccgtccgttccccc

SEQ ID NO: 286735 - DNA, 198 bp, Homo sapiens
  misc_feature: GYAE6OF01CEV1E.13.37.D04.1.454.CMB.1.raw
  modified_base (189)..(198): a, c, t, g, unknown or other
  misc_feature (189)..(198): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccgccctcctctagtacgtgactgagcgggctggcaaggcgcatagnnnnnnnnnn

SEQ ID NO: 286736 - DNA, 173 bp, Homo sapiens; identical to SEQ ID NO: 286716
  misc_feature: GYAE6OF01BF622.13.37.D04.1.454.CMB.1.raw
  modified_base (173)..(173): a, c, t, g, unknown or other
  misc_feature (173)..(173): n is a, c, g, or t

SEQ ID NO: 286737 - DNA, 824 bp, Homo sapiens
  misc_feature: GYAE6OF01CKKFO.13.37.D04.1.454.CMB.1.raw
  modified_base (230)..(230): a, c, t, g, unknown or other
  misc_feature (230)..(230): n is a, c, g, or t
  modified_base (259)..(259): a, c, t, g, unknown or other
  misc_feature (259)..(259): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatcggcctcctataaggtcgacccaggccaccctcagtcgtccgtcgcccccgaggaccagacagccatcatcactgctctgganataagtggggaataattgcttcgtggtancgagaagaacgcgaggccacggtcccctggtggtggtctaagtttactacgaacgtactaacccgaaaccggtccctacggacgggtacctcccgtaggacgtcgttaacttcgttaccgttacggttaacccaaacgttcggtaacgggtaaacttaacccgacgtaccctaaccgttaccgtaaccgtaaccgtaacgtaacccggaaaccgggtaccttaacccggtaaggtaccctaaggttacggaacgttaggacggtactacggtaactttacgttaacgtggtaacggtagggttacggacgggaacctaacggaccgtaaaccgtaccgttaaggtacgggtttacgggtaaccggttacgggggaccgggtaacgggtaacccgtaaacggtcccggttaacccgggtaacccggttacccgggttaaaccggtacccggaaccccgggtaaaccccccggtaacgggtccccccgttacccccgggtaccccccggtttaccggtacccccgttaaacccggttccccggtttacccccgttaaccccccccgg

SEQ ID NO: 286738 - DNA, 603 bp, Homo sapiens
  misc_feature: GYAE6OF01D5UHD.13.37.D04.1.454.CMB.1.raw
  modified_base (229)..(229): a, c, t, g, unknown or other
  misc_feature (229)..(229): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
tcagtcacgtactacacgaccggtgctcgatttagtagcatactgttgggtttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacngcagtgatcgttagggacttatagactttcgtctcctaggtaccaacaccacccaggcaacggcccccagacgtcatctagtttaggcggggacaagtacggcgccgtcgagggtactttccactcgctttctcgtcggcctcaagtctaggcaaccnccggcctcctanacactctcgtcgtcctcaggtctggacggacgnggcgtcgaccttattactcgtcttcgcttacaagttagtcgtaccgttacggttttcttcgttcggttcggttcgttccggggacgggtacgggtacccgtaaagggttccgtacccggttcgtacgggtccacggacccgacggtccgtccgcccccgtggtccctaccg

SEQ ID NO: 286739 - DNA, 844 bp, Homo sapiens
  misc_feature: GYAE6OF01CNPNU.13.37.D04.1.454.CMB.1.raw
tcagtcacgtactacacgaccggtgctcgatttagtagcatactgttgggtttggggtctgagagaggagcccagccctgggattttcaggttgttttctatttggtgatcaggactgaacagagagaactcaccatggtagtttggctgaactggtcttttcttgtggtcttatttaagaggtgtccagtgtgaggtgactaacgtggttggagtcggtgggggaggtcgtttgggttcgacggtccggttcggggggttccctggtacgtacttcgtcggtgtcgaccgacgtccttcgtggttaatttttagtttagcgtaagttatcgcctatcggagtccggttcgggcccgccgacggccgtaccgggaaggggacgggtcgtagggtagggtttcgggtttagggttaagtttggtcgtcgttgttagtagtagtaagtacgactaactaattactacgtcgtacgtaaccggttaccgttaacccgggttaacgggcccgttacctaccctaacctacgttacccgtaaccgaacgggtaaacctaacctttaaaacctaacccgaaaaggaaaccccttgtttccccggttttaagttttaaacctaaaccgaaaattccggaaacgtaccggccgttaagggaaccggtaccgacccgttaagtacccggaacccggttacggtaccgtttagttaaccgttcgtacgggtacgacggtaaacgggacggtacccggggtaccccggtaaaccccgttaaacggttaaacccgtttaccgaacgggttaccttacggggtacccgggtaccgggtcccgggtaaacccgggggg

SEQ ID NO: 286740 - DNA, 704 bp, Homo sapiens
  misc_feature: GYAE6OF01CNV1E.13.37.D04.1.454.CMB.1.raw
tcagtcacgtactacacgaccggtgctcgatttagtagcatactgttgggtttggggctggccctcagtaagcagcatcggaggtgcctcagccatggcatggatcctctcttcctcggcgtcctggcttactgctcagcctccatcggcctcctagtaaggtcgacccaggccaccctcagtcgtccgtcgcccccaggacacgacagccatcactcacctgctacgtaggaagtagtaaggttgggggaataaagtttgcgttcctaggtatacgagaacgaacgccacggcctacgtccccgtggttacggtggttcctaagttttactacaaacggtactaaacccgaaaccggtccctacggaacgggtaccttcccgaggacgtaccggttacttccgttacgttaccgtttaaccgaaccgttacggtaacgggtaactaacccgtacggtccctaacttccgtaaccggacctaacgtaccggaacggtacctaccggagtacgtacggtaggtactaggacgtctagtacttacttgtcgtagtagggtgtacggactacgactaaccgtacgtagtggtacgtacggtcgggacggtacggacacggtacctacgggtacctaccgtacggaccaccggtaccgacggtcccttaccccggcccttcggacctaccgtccgttccccgtccccg

SEQ ID NO: 286741 - DNA, 460 bp, Homo sapiens
  misc_feature: GYAE6OF01DDZK4.13.37.D04.1.454.CMB.1.raw
  modified_base (195)..(195): a, c, t, g, unknown or other
  misc_feature (195)..(195): n is a, c, g, or t
  modified_base (384)..(384): a, c, t, g, unknown or other
  misc_feature (384)..(384): n is a, c, g, or t
  modified_base (437)..(460): a, c, t, g, unknown or other
  misc_feature (437)..(460): n is a, c, g, or t
tcagtcacgtactacacgaccggtgctcgatttagtagcatactgttgggtttggggacagccatcatcacctgctctggagataaattggggggagaaatttgcttcctggtatcagaagaagccaggccagtcccctgtggtggtcatttatcaagataccaaacggcccctcagggatccctgagcgattcnctggttcccaactctagggaatacacgccactctgaccatccgaacgggactcgaggctagtggatggaggctgactattactgtcgaggtgtggacagacaacacctatggtgtagtcggcggaggaccaagctcgacgtcctaggtcacgcccaagcctacgcccccgtcggtcactctcgtccccncctctctacgtacgtgactggagccggtcgtgggacgaacggcgcagtagcgnnnnnnnnnnnnnnnnnnnnnnnn

SEQ ID NO: 286742 - DNA, 414 bp, Homo sapiens
  misc_feature: GYAE6OF01B1VHK.13.37.D04.1.454.CMB.1.raw
  modified_base (382)..(382): a, c, t, g, unknown or other
  misc_feature (382)..(382): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (408)..(414): a, c, t, g, unknown or other
  misc_feature (408)..(414): n is a, c, g, or t
tcagtcacgtactacacgaccggtgctcgatttagtagcatactgttgggtttggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggctcgaggctatggatgaggctgacttattactgtcaggtgtggacagcaacactatgtggtagtcggcggaggacagctcgaccgtcgtaggtcacgcccaggctccgcccctgccactctcgtcccgcctctcgtacgtcgtcnctgacggcggtcgtggcgagcnangnnnnnnn

SEQ ID NO: 286743 - DNA, 672 bp, Homo sapiens
  misc_feature: GYAE6OF01BF4AF.13.37.D04.1.454.CMB.1.raw
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
tcagtcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcggtattagtgctcttgatgatagcacatactatgcagactccgttaagggccncttcaccatctccagagacaattccaagaaccacgctatatctgcagatgaacagccgtgggacgccgaggaccacggtccgtttancacgtggtagacgaaagtatattagtaatgatggtagctgactactactacgttttacgacgtacgtcggggacctacgggtaaccctcggtacctaccgttcttacgttaccgacgtcccttacccgaacccgtaacgggcccctaacgttccggtccctttcccccgtggaccccctacccgtccctaccgaacgtacgccctacccgtcggtcggggacccacggacggacccggtcccgtagggtccctacggtcccgtacgggtacgtaaacggtacccttaccgtttcccgtaaggttacccgtaggtaaccgttcgggaaccggtccgggtccgtcgggtaacccgg

SEQ ID NO: 286744 - DNA, 176 bp, Homo sapiens
  misc_feature: GYAE6OF01BPXCM.13.37.D04.1.454.CMB.1.raw
  modified_base (174)..(176): a, c, t, g, unknown or other
  misc_feature (174)..(176): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaaggcgcatagnnn

SEQ ID NO: 286745 - DNA, 174 bp, Homo sapiens
  misc_feature: GYAE6OF01CFII8.13.37.D04.1.454.CMB.1.raw
  modified_base (172)..(174): a, c, t, g, unknown or other
  misc_feature (172)..(174): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcggctggcaaggcgcatagnnn

SEQ ID NO: 286746 - DNA, 176 bp, Homo sapiens
  misc_feature: GYAE6OF01BZ6DM.13.37.D04.1.454.CMB.1.raw
  modified_base (173)..(176): a, c, t, g, unknown or other
  misc_feature (173)..(176): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagnnnn

SEQ ID NO: 286747 - DNA, 672 bp, Homo sapiens
  misc_feature: GYAE6OF01CI0J4.13.37.D04.1.454.CMB.1.raw
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (418)..(418): a, c, t, g, unknown or other
  misc_feature (418)..(418): n is a, c, g, or t
tcagtcacgtactacacgaccggtgctcgatttagtagcatactgttggggtttggggctggccctcagtaagcagcatcggaggtgcctcagccatggcatggatccctctcttcctcggcgtcctggcttactgctcagcctccatggcctcctataaggtgacccaggcaccctcagtgtccgtcgcccccgaggacagacacgccatcatcacctgctctggagataaaggttggggataattgcttctggtatgaagaagaagccaggccagtcccctgtggtggtctatttancaagactaacccaaacggccctagacgggctcctgacncgtattctctgttccaatcgtaggtaatacgacgcctaactctacgaacctacgtaccgaacgggtctacgaggtcttagnggaactggacggtcgtagtaacttattaccgtgtacgtacgggttggtagggactacggaactaaccgaccgttagtcgggttaggttacggttacggggacgggtacgggtaaccggaacggtcgtaaccgggtaccccggtttaccggtaccgggtaccgtaaccggaccccggtaaacgggtccccgttaccccggtccccccggttacgggttacccttccccgttcccgttcccgtttaaccccccccg

SEQ ID NO: 286748 - DNA, 180 bp, Homo sapiens
  misc_feature: GYAE6OF01BUPEG.13.37.D04.1.454.CMB.1.raw
  modified_base (172)..(180): a, c, t, g, unknown or other
  misc_feature (172)..(180): n is a, c, g, or t
tcagtcacgtactacacgaccggtgctcgatttagtagcatactgttgggtttgggggaagaggaagactgacggtcccccaggagttcaggtgctgggcacagcggcctgggctgcctggtcaaggactacttcctagtacgtgactgagcgggctggcaaggcgcatagnnnnnnnnn

SEQ ID NO: 286749 - DNA, 855 bp, Homo sapiens
  misc_feature: GYAE6OF01CSKV3.13.37.D04.1.454.CMB.1.raw
  modified_base (150)..(150): a, c, t, g, unknown or other
  misc_feature (150)..(150): n is a, c, g, or t
tcagtcacgtactacacgaccggtgctcgatttagtagcatactgttgggtttgggggaggcttggttcagccgtggggggtccctgagactctcgtgtgcagcctctggtattttagttttagctagttatgccatgagcgtgggtccnccaggctccgagggaaggggctgggaggttggggtttcgggtattagtgcttcttgatgaatagcacatactatgcagtacctacggttaacgggcctcttaccacctatcctccaagaagtaacctaattaccaaacgaacacgtaccttaatacgtctcgacgaagaagttagaaacctacggcccggtaaggggaccggacccggaaacggtaaccggtaccggttacccgttttacaccgtaacggttaggtacggtaaacgtaaaaagtagttaatttaaggtaaattaggtaagttacggtacgtccgttagtaccttaacccgtttatttaacgttttacggtaacctacggggtacgggtacccgtaaacggggtacccttcggtcccgtaacccgttccttccttaccggaccgtaccctaaccccgtacccggtaaaccgggtcccttaaccggttcccggttaccccccttaccccccgttcggaaccccctttacccccgtaccgtaacccaaccgggtacccgtacccgtaccccggtacccggggtaccggggacaacccggacccgggttcccggggtccccttcgggcccgttaccgggtcccgtacgggtaaccgtaaaccggttaccctttaccgttaacgttaggtacccaacgggttccgagggcggcggtccggtgggaacccg

SEQ ID NO: 286750 - DNA, 721 bp, Homo sapiens
  misc_feature: GYAE6OF01ANRM8.13.37.D04.1.454.CMB.1.raw
  modified_base (612)..(612): a, c, t, g, unknown or other
  misc_feature (612)..(612): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatcggcctcctagtaaggtcgacccaggccaccctcgagtgtcccgtcgcccccaggacagacacgccatcactcacctgctcgtaggagtaagtaaaggttgggggaataagtttcgtactttccgtggtatcgagacaagtaagtcgacggccacggtcccctggtcgtcgttggtcctattacctatacgaagacgtcgaccgaacggccggccccgtacggacgggtacctcccgaggtacgtccgtactttccgtcgtccggtacccttaacccgaacgttccggtacgggtaacccgtcgaccgtccctaccgtacgtaccgaacctacgtaccggacccgggaccggaaccccgtaggtaccgtaggtacggaggttacgggaccgttcgtaacggtactttaacgttacgtccggtacgggtacgggtccgggtacggaccggtaacgccgaacgtccnccggtccgcccttagtcgttaccggtcggttaccggaagggttaccggaccggtaccgtaccctacccggttactaacggacccgaccgacccgaacccgtaacccccg

SEQ ID NO: 286751 - DNA, 418 bp, Homo sapiens
  misc_feature: GYAE6OF01ELMT6.13.37.D04.1.454.CMB.1.raw
  modified_base (409)..(418): a, c, t, g, unknown or other
  misc_feature (409)..(418): n is a, c, g, or t
tcagtcacgtactacacgaccggtgctcgatttagtagcatactgttgggtttggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtggacagcaacacctatgtggtattcggcggaggaccaagctgaccgtctaggtccacgccaaggctcgccccctcggtcactcgtcgttcccgcctcctctagtcgtgactgagcggctgcgagcgcatagnnnnnnnnnn

SEQ ID NO: 286752 - DNA, 844 bp, Homo sapiens
  misc_feature: GYAE6OF01CI73T.13.37.D04.1.454.CMB.1.raw
tcagtcacgtactacacgaccggtgctcgatttagtagcatactgttgggtttggggtctgagagaggagcccagccctgggattttcaggtgttttcatttggtgatcaggactgaacagagagaactcaccatggagtttgggctgactggtctttttcttgtggctattttaagaggtgtccagtgtgaggtgcaactgttggagtcgtgggggagcgttggttcaggtccgtggggggtccctgacgacctcgtcgtgtgcacgcctcgtggttattttagtttagctagttatcgacctagtgacgcgttcggggtccccgaccgacgggccgtacccggagggggtaacgggggtccgtaggggtacgggttttcgggggttttacgggttaagtttgggttcgttccgttacggtttaggtaagttacggtaacgttaaccggtacctaacgtaacttacgttaagtacgaccgtaacggtacccggtttaaacccgggttaccgggcccgttacccgtttacccacccgttacttccccgaacccgtaagggtaaactaacccttaaacgttcccgaaaaacgtaacccgtaccggtaactttaagttaccttcggtacgtaacccgtaagttaacgtaaacccggaaccgtccggtacccggggtaggggaacccggtaacccgggaaccggtaacccggttaccccgggtttacgtttaaccgaccgttacggtacgggtaacggtaaaaccggttaaagttatttaaaggttaacgtaagttacggttaagttacgggtacttccgtacgtaaccgtttaaccgttttaaccg

SEQ ID NO: 286753 - DNA, 759 bp, Homo sapiens
  misc_feature: GYAE6OF01AQKD1.13.37.D04.1.454.CMB.1.raw
  modified_base (514)..(514): a, c, t, g, unknown or other
  misc_feature (514)..(514): n is a, c, g, or t
tcagtcacgtactacacgaccggtgctcgatttagtagcatactgttgggtttgggctggccctcagtaagcagcatcggaggtgcctcagccatggcatggatccctctcttcctcggcgtcctggcttactgctcagccctccatcggcctcctagtaaggtcgacccaggccaccctcaggtcgtccgtcgcccccgaggacagacacgccatcatccacctgctcgtaggagtaagttaagggttagggggaattaaagttttcgtcctttccgtgggttactacgaaggaaagaacgccgaacggccgacgttcccccgtggttcggttcggtactaattttacgaacgaaacgtacgtaaacccgaaccggtccctacggacggtaccgtcccgtgacgcgtacttctcggttacgtaccaacgtcggtaggtaactaccgacgcctacgttccgaccgtaaccgtacgtaacccggaacggtacctacggtacggtacgttaacggngggtaacgttacggacggtcttaacgtaactttacgttacggtcggtacgggtacggttagggtaacccggaacgtaaaccgtaaccgtacgttaagttcggttaacggttacgggtacggggaacgggtacggaaccgtacgtacggtaccgtaccggtaccgttacgccgtacccggacccggccgtcccgacccgttccccggtcggttacccaccgttcccgttcccgtacccccttcccg

SEQ ID NO: 286754 - DNA, 675 bp, Homo sapiens
  misc_feature: GYAE6OF01DCEVH.13.37.D04.1.454.CMB.1.raw
  modified_base (327)..(327): a, c, t, g, unknown or other
  misc_feature (327)..(327): n is a, c, g, or t
tcagtcacgtactacacgaccggtgctcgatttagtagcatactgttgggtttgggggggggtcacaagaggcagcgctctcgggacgtctccaccatggcctgggctctgctgctcctcactctcctcactcaggacacagggtcctgggcccagtctgccctgactcagcctgcctcgtgtctggtctctggacagtcgatcaccatcctcctgcactaggaaacagcagtgattcgttgggtacttagtagtacttgtcctccgttacggtaacccaaccacccacccgaggccaacggcccccagacgtcatctagtttaggnggggacaaggtcggcggccgtcgagggtactttcccgacttcgtcctttcgtcgtcggaccttaccgaaagttccgtgggaccaaccgaccgtccctacccgtagaacctaacttccgttccgtcggttcctaccgaggtcctaggacggacgaggtccttacgtccctttagtaccgtgtctcgtacctacgattagtcggtacgtttacggtttcttcgttggttcgggtttccgttaccggggtcggtacgggttaacctaaacggttccggtacccggttaccgtggtacccacggtaccccgtaacggtccccgttcccgtacccccggtgttcccgtacccg

SEQ ID NO: 286755 - DNA, 739 bp, Homo sapiens
  misc_feature: GYAE6OF01DJP9M.13.37.D04.1.454.CMB.1.raw
  modified_base (217)..(217): a, c, t, g, unknown or other
  misc_feature (217)..(217): n is a, c, g, or t
  modified_base (236)..(236): a, c, t, g, unknown or other
  misc_feature (236)..(236): n is a, c, g, or t
tcagtcacgtactacacgaccggtgctcgatttagtagcatactgttgggtttggggctggccctcagtaagcagcatcggaggtgcctcagccatggcatggatccctctccttcctcggcgtcctggcttactgctcacgccctccatcggcctcctaagtaaggtcgacccaggccaccctcagtcgtccgtcgcccccaggacagacagccancatcgacctgctcgtgganattaaaggtggggaataattcgcttcgtgtatacaagaagaacgccgacggccgacgtcccgtaggtggtgtactatttacagaacgacgtaccgaaaccgtcccgtacgacgggtacctcccgtagacgtactagttcctcgttacgtacctaacgtcgtacgggaactacgacccgcctacgtactacgacctacgtaaccggaaccggtacgtacgacggtacgttaaggtggtaacgttaggacggtaccgtacgttaacccgtttacgtttaaccgttggttaccggtaacgggttacgggtaccggggaactaccggtaactaaacccgtcgtttaaagttcgggttaaggttaccggttcggggaacggtaccgggtaaccgtaaccggttacgaccggttaccggtacccggtacggacccgtacggaccccgaacggtccccgtaccccggtccccttacggtacctacccggttcgttccccggttccccccg

SEQ ID NO: 286756 - DNA, 895 bp, Homo sapiens
  misc_feature: GYAE6OF01EWOHN.13.37.D04.1.454.CMB.1.raw
  modified_base (244)..(244): a, c, t, g, unknown or other
  misc_feature (244)..(244): n is a, c, g, or t
  modified_base (355)..(355): a, c, t, g, unknown or other
  misc_feature (355)..(355): n is a, c, g, or t
tcagtcacgtactacacgaccggtgctcgatttagtagcatactgttgggtttgggggaggcttggttcagcctggggggtccctgagactctcgtgtgcagcctctggattttagtttagctagtttactgcctatagacgcgtcgggtcccgccgaggcctccgaggggagggctgggaggttggggtttacggttattaggtcgtcttacgttagattcgatacgaccactaacttacgtntcgacgtaacgtaccgttaccggttaacggccgttaccttaccgaacctactccgaccgaggaacgacctaacgttaccgaaacgtaaccacgtactaactatcgacgtanaactagtacgaaacgcggtccggtaaggggaccggacccggtaacgggacccggttaaccgggtttacccgtttaacgtccggtaaggttccgggtaagaaaacgttaaagggtttattttaacgggtttaacggttaagtacgggtaacgtttacggaaacgtttccggttacccgtttaaacttaaaccgttttacccgtttttacggtttaaccggtaacccgggtttccggggaacccggggaaccccgttaaccccggggttactacccggtttaccccggttacccttacccgtttaccctaccgtccccgttaaccccgtaacccgaaccccggtacccggtacccgttacccgttccccgggttcccccttccccggacccgtccccctaacccgtaccgtaaccgaccgtaccgcccgtccggtccgggaccgtaccgaccgaccggtccggccggtcgtccggtaccgtcgacggtaacgtccgtacttcgtacggtacgtagtcgtcgacggtcggcggtcgtacgacg

SEQ ID NO: 286757 - DNA, 779 bp, Homo sapiens
  misc_feature: GYAE6OF01BL67O.13.37.D04.1.454.CMB.1.raw
  modified_base (231)..(231): a, c, t, g, unknown or other
  misc_feature (231)..(231): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtccctggcttactgctcagcctcatggcctcctataggtcacccaggccaccctcagtcgtcccgtcgccccccaggaccagaccagccatcatcacctgctctagganattaagtggacagaataaatgttacttccgtaggtactacagacagaacgtccgacggcccctacggttccccctggtcggtccgtggttaccactttctaacgtcgaaagtactaccgacccgaaaccggcccggtaccccgtacggacgggtaccttcccgagggtacgtcccttagttcccgtacggtccgtacccttaccctaaacgtccgggtaacggtaaccctcgtaccgtacccctacgttccacgaaccctgtacccggaccgggtaccccgggacccgacgggtacgttacggtagggtaacgtacggacccgggtacttaacggtttaccttaacggttttaaccggcgggtttaaccggggacgggtttacggggtaaccgggaacctcggggacaccgggtcccgtaacccgccggttacccggtattttccgggtacgtttaccccgggaacggttaccggggtaccccgggtaacgttacccgggttcccaacccggttaccctaacggtcccgaaccccgggttaaaccccg

SEQ ID NO: 286758 - DNA, 173 bp, Homo sapiens
  misc_feature: GYAE6OF02HJQXK.13.37.D04.1.454.CMB.1.raw
  modified_base (172)..(173): a, c, t, g, unknown or other
  misc_feature (172)..(173): n is a, c, g, or t
tcagtcacgtactacacgaccggtgctcgatttagtagcatactgttgggtttgcgggaagaggaagactgacggtccccaggagttcaggtgctgggcacagcggccctgggctgcctggtcaaggactacttcctagtacgtgactgagcgggctggcaaggcgcatagnn

SEQ ID NO: 286759 - DNA, 174 bp, Homo sapiens
  misc_feature: GYAE6OF02G1WYN.13.37.D04.1.454.CMB.1.raw
  modified_base (172)..(174): a, c, t, g, unknown or other
  misc_feature (172)..(174): n is a, c, g, or t
tcagtcacgtactacacgaccggtgctcgatttagtagcatactgttgggtttggggaagaggaagactgacggtcccccaggagttcaggtgctgggcacagcggccctgggctgcctggtcaaggactacttcctagtacgtgactgagcgggctggcaaggcgcatagnnn

SEQ ID NO: 286760 - DNA, 178 bp, Homo sapiens
  misc_feature: GYAE6OF02JVA5V.13.37.D04.1.454.CMB.1.raw
  modified_base (173)..(178): a, c, t, g, unknown or other
  misc_feature (173)..(178): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagnnnnnn

SEQ ID NO: 286761 - DNA, 173 bp, Homo sapiens
  misc_feature: GYAE6OF02GMD5Z.13.37.D04.1.454.CMB.1.raw
  modified_base (172)..(173): a, c, t, g, unknown or other
  misc_feature (172)..(173): n is a, c, g, or t
tcagtcacgtactacacgaccggtgctcgatttagtagcatactgttgggtttggggaagaggaagactgacggtcccccaggagttcaggtgctgggcacagcggccctgggctgcctggtcaaggactacttcctagtacgtgactgagcgggctggcaaggcgcatagnn

SEQ ID NO: 286762 - DNA, 174 bp, Homo sapiens
  misc_feature: GYAE6OF02JDINN.13.37.D04.1.454.CMB.1.raw
  modified_base (168)..(174): a, c, t, g, unknown or other
  misc_feature (168)..(174): n is a, c, g, or t
tcagtcacgtactacacgaccggtgctcgatttagtagcatactgttggttgggaagaggaagactgacggtccccaggagttcaggtgctgggcacagcggccctgggctgcctggtcaaggactacttcctagtacgtgactgagcgggctggcaaggcgcatagnnnnnnn

SEQ ID NO: 286763 - DNA, 174 bp, Homo sapiens; identical to SEQ ID NO: 286715
  misc_feature: GYAE6OF02IBUVT.13.37.D04.1.454.CMB.1.raw
  modified_base (173)..(174): a, c, t, g, unknown or other
  misc_feature (173)..(174): n is a, c, g, or t

SEQ ID NO: 286764 - DNA, 172 bp, Homo sapiens
  misc_feature: GYAE6OF02HIP4M.13.37.D04.1.454.CMB.1.raw
  modified_base (171)..(172): a, c, t, g, unknown or other
  misc_feature (171)..(172): n is a, c, g, or t
tcagtcacgtactacacgaccggtgctcgatttagtagcatactgttgggtttggggaagaggaagactgacggtccccaggagttcaggtgctgggcacagcggccctgggctgcctggtcaaggactacttcctagtacgtgactgagcgggctggcaaggcgcatagnn

SEQ ID NO: 286765 - DNA, 198 bp, Homo sapiens
  misc_feature: GYAE6OF02GMZWN.13.37.D04.1.454.CMB.1.raw
  modified_base (189)..(198): a, c, t, g, unknown or other
  misc_feature (189)..(198): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccaccctcctctagtacgtgactgagcgggctggcaaggcgcatagnnnnnnnnnn

SEQ ID NO: 286766 - DNA, 191 bp, Homo sapiens
  misc_feature: GYAE6OF02HY1EY.13.37.D04.1.454.CMB.1.raw
  modified_base (189)..(191): a, c, t, g, unknown or other
  misc_feature (189)..(191): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgccccctcggtcactctgttcccaccctcctctagtacgtgactgagcgggctggcaaggcgcatagnnn

SEQ ID NO: 286767 - DNA, 416 bp, Homo sapiens
  misc_feature: GYAE6OF02IEYGM.13.37.D04.1.454.CMB.1.raw
  modified_base (275)..(275): a, c, t, g, unknown or other
  misc_feature (275)..(275): n is a, c, g, or t
  modified_base (405)..(405): a, c, t, g, unknown or other
  misc_feature (405)..(405): n is a, c, g, or t
  modified_base (411)..(416): a, c, t, g, unknown or other
  misc_feature (411)..(416): n is a, c, g, or t
tcagtcacgtactacacgaccggtgctcgatttagtagcatactgttgggtttggggacagccatcatcacctgctctggagataaattggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtntgggacagcaacacctatgtggtattcggcggagggaccaagctgaccgtcctaggtcagcccaaggctgccccctggtcactctgttcccgccctcctctagtacgtgactgagcgggctggcaaggcncatagnnnnnn

SEQ ID NO: 286768 - DNA, 188 bp, Homo sapiens
  misc_feature: GYAE6OF02HZ6DD.13.37.D04.1.454.CMB.1.raw
  modified_base (187)..(188): a, c, t, g, unknown or other
  misc_feature (187)..(188): n is a, c, g, or t
tcagtcacgtactacacgaccggtgctcgatttagtagcatactgttgggtttgggacagcaacacctatgtggtattcggcggagggaccaagctgaccgtcctaggtcagcccaaggctgcccctcggtcactctgttcccgcctcctctagtacgtgactgagcgggctggcaaggcgcatagnn

SEQ ID NO: 286769 - DNA, 200 bp, Homo sapiens
  misc_feature: GYAE6OF02GT0VR.13.37.D04.1.454.CMB.1.raw
  modified_base (178)..(200): a, c, t, g, unknown or other
  misc_feature (178)..(200): n is a, c, g, or t
tcagtcacgtactacacgaccggtgctcgatttagtagcatactgttgggtttggggggaagaggaagactgacggtcccccaggacgttcagggtgctgggaccacagcggccctgggctgcctggtcaaggactacttcctagtacgtgactgagcgggctggcaaggcgcatagnnnnnnnnnnnnnnnnnnnnnnn

SEQ ID NO: 286770 - DNA, 744 bp, Homo sapiens
  misc_feature: GYAE6OF02J3DW6.13.37.D04.1.454.CMB.1.raw
  modified_base (436)..(436): a, c, t, g, unknown or other
  misc_feature (436)..(436): n is a, c, g, or t
  modified_base (624)..(624): a, c, t, g, unknown or other
  misc_feature (624)..(624): n is a, c, g, or t
tcagtcacgtactacacgaccggtgctcgatttagtagcatactgttggtttgggctggccctcagtaagcagcatcggaggtgcctcagccatggcatggactcctctctcctcggctctggcttactgctcagcctcatcgcctactagtacggtcgaccaggcctaccgtgacgttcgtcccgtacgaccccaggaccacgaccacgcctaatccgtaactccgtaaccgtgtaccgttacgtaaagggtaaaacttacggttcggaacctaagttaaccttaaccttacgttaccgtttaccgtaaggtacaccggacggtaccgtacggtaccgtcgtaaccggtcccttaccggtcctagtccgtagtacgtacttactacgtacgtacgacgtacgcccgacggacgcccgtactacggacgtcctcgngtaccgtacgttctccgtaccggtactaccctacgtacgtaggtaccgacctacgtaccgacctacgtacgaccgtacgtccgaaccgggcgggaccgtacggtattacgaggtagtcggacgtacttacggtacctacgttcggtacggacggacggtcgggtaccgaactacgccgtacgtccccnggtttacgccccggtatttacggaccgtttccgggaaaccgtaccggttacccgggaaaccttaccggtacccgtaccgtaaccgtcccggacgacccccgtacccgaccggttaacccc

SEQ ID NO: 286771 - DNA, 482 bp, Homo sapiens
  misc_feature: GYAE6OF02IF6NR.13.37.D04.1.454.CMB.1.raw
  modified_base (436)..(436): a, c, t, g, unknown or other
  misc_feature (436)..(436): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccagcatcacctgctctggaaataaattggcagataaatatacttcctggtatcagcagaagtcaggccagtcccctgtgctggtcatctatcaagatgccaagcggcccctcagggatccctgagcgattctctggctccaactctgggaactcagccactctgaccatcagcggacccaggctatgatgagctgactatactgtcaggcgtgggacagcagcactgcccgntatgtcttcggactggaccaaggtcacgtcctagtcacgccaacgg

SEQ ID NO: 286772 - DNA, 173 bp, Homo sapiens
  misc_feature: GYAE6OF02HGT98.13.37.D04.1.454.CMB.1.raw
  modified_base (172)..(173): a, c, t, g, unknown or other
  misc_feature (172)..(173): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaggactacttcctagtacgtgactgagcgggctggcaaggcgcatagnn

SEQ ID NO: 286773 - DNA, 417 bp, Homo sapiens
  misc_feature: GYAE6OF02IJXKN.13.37.D04.1.454.CMB.1.raw
  modified_base (411)..(417): a, c, t, g, unknown or other
  misc_feature (411)..(417): n is a, c, g, or t
tcagtcacgtactacacgaccggtgctcgatttagtagcatactgttgggtttggggacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctggtcactctgttcccacctcctctagtacgtgactgagcgggctggcaaggcgcatagnnnnnnn

SEQ ID NO: 286774 - DNA, 185 bp, Homo sapiens
  misc_feature: GYAE6OF02G56KJ.13.37.D04.1.454.CMB.1.raw
  modified_base (173)..(185): a, c, t, g, unknown or other
  misc_feature (173)..(185): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcggctggcaaggtcgcatagnnnnnnnnnnnnn

SEQ ID NO: 286775 - DNA, 188 bp, Homo sapiens
  misc_feature: GYAE6OF02GBMB6.13.37.D04.1.454.CMB.1.raw
  modified_base (173)..(188): a, c, t, g, unknown or other
  misc_feature (173)..(188): n is a, c, g, or t
tcagtcacgtactacacgaccggtgctcgatttagtagcatactgttgggtttgggggaagaggaagactgacggtcccccaggagttcaggtgctgggcacagcggccctgggctgcctggtcaaggactacttcctagtacgtgactgagcgggctggcaaggcgcatagnnnnnnnnnnnnnnnn

SEQ ID NO: 286776 - DNA, 521 bp, Homo sapiens
  misc_feature: GYAE6OF02IXP8T.13.37.D04.1.454.CMB.1.raw
  modified_base (446)..(446): a, c, t, g, unknown or other
  misc_feature (446)..(446): n is a, c, g, or t
  modified_base (508)..(508): a, c, t, g, unknown or other
  misc_feature (508)..(508): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaattgggggagaaatttgcttcctggtatcagaagaagccaggccagtccccctgtggtggtcatttatcaagataccaaacggccctcagggatccctgagcgattctctcggttccaactcgtgggaactacgagccactctgaccatcaacgggctcgagctagtgatgagctgactattactgtcaggcgtgggacaggcagccacgtcgcccgntagtgtcttcggacgtggaccaggtcaccgtacctagtcacgaccgaacggcccaaccccgntacgtccactccg

SEQ ID NO: 286777 - DNA, 175 bp, Homo sapiens; identical to SEQ ID NO: 286727
  misc_feature: GYAE6OF02FXWAB.13.37.D04.1.454.CMB.1.raw
  modified_base (173)..(175): a, c, t, g, unknown or other
  misc_feature (173)..(175): n is a, c, g, or t

SEQ ID NO: 286778 - DNA, 586 bp, Homo sapiens
  misc_feature: GYAE6OF02I1JO3.13.37.D04.1.454.CMB.1.raw
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctgagataaattggggganaaatttgcttcctggtatcagaagaagccaaggccagtcccctgtggtggtcatttatcaagataaccgaaacggcctcagggacttcccngagcgattctctggttcccaactcgtagggaacttacaggccaactctgaacccataccaacgggactcaggtctaagtcggatgaggctaggactattactgtcagggtgtagggacaggacaacgtacccgtatggtaggttaacgttcgggacggtaacgggaccaaggctacggaccgtcgtaacggtaccacggacccgaggtacccgttcggcccccgttaggtccaacccgttccgtacccggttaccccc

SEQ ID NO: 286779 - DNA, 189 bp, Homo sapiens; identical to SEQ ID NO: 286720
  misc_feature: GYAE6OF02GK9QB.13.37.D04.1.454.CMB.1.raw
  modified_base (189)..(189): a, c, t, g, unknown or other
  misc_feature (189)..(189): n is a, c, g, or t

SEQ ID NO: 286780 - DNA, 180 bp, Homo sapiens; identical to SEQ ID NO: 286724
  misc_feature: GYAE6OF02GVT4M.13.37.D04.1.454.CMB.1.raw
  modified_base (173)..(180): a, c, t, g, unknown or other
  misc_feature (173)..(180): n is a, c, g, or t

SEQ ID NO: 286781 - DNA, 525 bp, Homo sapiens
  misc_feature: GYAE6OF02G3UYB.13.37.D04.1.454.CMB.1.raw
  modified_base (238)..(238): a, c, t, g, unknown or other
  misc_feature (238)..(238): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagtcacgtactacacgaccggtgctcgatttagtagcatactgttgggtttggggctggccctcagtaagcagcatcggaggtgcctcagccatggcatggatccctctcttcctcggcgtcctggcttactgctcagcctccatggcctcctataaggtgacccaggcacccttagtgtccgtgcccccaggacagacagccatcatcacctgctctggagataaattggggganaaatttgcttcctggtatcagaagaagccaggccagtcccctgtggtggtcatttancaagataccaaacggccctnagggatccctgagcgattctctggttccaactctgggaatacagccatctgaccatcaacgggactcaggctatggatgaggctgactattactgtcaggtgtgggacagcaacacctatgtggtattcggcggagggacaagctgaccgtcctaggtcacgcccgaaggcctcgccccctcggtccaccgtcttcgttcccctaccccg

SEQ ID NO: 286782 - DNA, 178 bp, Homo sapiens
  misc_feature: GYAE6OF02JEVGG.13.37.D04.1.454.CMB.1.raw
  modified_base (174)..(178): a, c, t, g, unknown or other
  misc_feature (174)..(178): n is a, c, g, or t
tcagtcacgtactacacgaccggtgctcgatttagtagcatactgttgggtttgggggaaggaggaagactgacggtcccccaggagttcaggtgctgggcacagcggccctgggctgcctggtcaaggactacttcctagtacgtgactgagcgggctggcaaggcgcatagnnnnn

SEQ ID NO: 286783 - DNA, 891 bp, Homo sapiens
  misc_feature: GYAE6OF02GL781.13.37.D04.1.454.CMB.1.raw
tcagtcacgtactacacgaccggtgctcgatttagtagcatactgttgggtttggggctggccctcagtaagcagcatcggaggtgcctcagccatggcatggatccctctcttcctcggcgtccttgcttactgcacaggactccggtggcctctatgagctgactcacgccacctgagtcgtccgtcgtaccccgaggacagacacgaccagcatccacgtgactacgtaaggtaaacttaagtcggactaagtaacgttaaacttacgttaccgtttaccggtagggttaactaccgaacggtaccgtaacgggtaaccggtccgtaaaccgggtccccttaaccggttccccgttaggttaccggttaccggttacgggttaaccttaacgttaccgttaacgttaaccggaaacggttaccgttaccgggaacccggtaaccgggttccccggtacccgttaacgggtaaccggggttaccttccccggtaggtaaccggtccggttaaccgttttccgtacggtaccggtacccgttaacccggttaaccgttccgggttaaccgggtaacccttaccggtacccggttacccgttaaccggttccggtaaccggtaacccgtaccgggtaccggaaccgggttacccggtacccgtaggttaccggtagttaccgggtacgttacggggtaccttacggttacgttaccgttaaccgttacggcggttacggaccggttacggtacgacgtaccgtaccgacgtccgtaccggtccgtaccggtttacgtcgttaccggggttacctaaccgggttaccgtacgggtaacccgttaccgggacccgtttaacccggtaccggttaaccgccccgtaaacccggg

SEQ ID NO: 286784 - DNA, 173 bp, Homo sapiens; identical to SEQ ID NO: 286716
  misc_feature: GYAE6OF02HYDPS.13.37.D04.1.454.CMB.1.raw
  modified_base (173)..(173): a, c, t, g, unknown or other
  misc_feature (173)..(173): n is a, c, g, or t

SEQ ID NO: 286785 - DNA, 591 bp, Homo sapiens
  misc_feature: GYAE6OF02IEF3C.13.37.D04.1.454.CMB.1.raw
tcagtcacgtactacacgaccggtgctcgatttagtagcatactgttgggtttgggggaggcttggttcagcctggggggtccctgagactctcgtgtgcagcctctggatttagttttagcagttatgccatgagctgggtccgccaggctccagggaaggggctggagtgggtttcgggtattagtgctcttgatgatagcacatactatgcagactccgttaagggccgcttcaccatctccagagacaattcccaagaacacgctatatctgcagatgaacagcctgggagccgaggacacggccgtttatcactgtgacgaaagatattgtaatgatggtagctgctactactacttttgactacgtggggccagggaccctggtcaccgtctcttcacgccctccaccgaacgggcccacgttccggtccttcccccgtggccctaccctcccctccaacgaccgccacccgttccgtcgggggccacgacgccgggcccgtcggggcctcgtcccgtggtaccgaacggtaccttaccgttcccttagtacgttcgaaccgtggacggcgggccgtaggaccgg
